United States Patent 10,407,724 (METHODS AND COMPOSITIONS FOR SCREENING AND TREATING DEVELOPMENTAL DISORDERS) - sequence listing, part 23

SEQ ID NO: 604 - DNA, 289311 bp, Homo sapiens
gagaggcttataatatctggttacaaagaatgtagagagatagcaactaccaaattgggataggaaatcaaccctgcataaattgttttaatatatattctgtttgctaaaatttacatttattttcacaatatgtcttgatgacagtgcccaccaagccaactagcccttagctcatgacactactttcagttacactaatgaggagaaagaagggagaaagaagactgacattttgtgggtccaaaattatccacagtgaatgccaggtgcttcacatgtctgtgctctcctataaccctcacagcaagcttcagaggtaacaactggcccctctttccctccacacatctctttatgaaagagaaatcagaagtaaaataaccagaccagggtcatacagctttaagagccatcgctgttatttgaaccatgctaggctaaaacccacatttattctattgaaacagtttctccaaaaatcagagtgttttatatctgatcaaatgatgggtggttccttctcctgatctgttttatctcatatatttatgtaatgttttattacttataaagtaccatcatgttcatcatattatatcatccttacaacagccctatgaagtacgaaatgctgatatcctgtccttatagtgtattatcaagaagtggcttcagaaaaatcaagtaatttgcccaaggtcagtcaggtctgacaccaaagccaatgcttttgttccctcacatcttctcttttctagacacatgagccagcggagttgatttgcatggcagctgtgcatgatagtttcaagcctgggcaactctatgggtattcgccacaaggcttccgtgacttctaatgaactgaaacaaagcagttagccatggattataatgccaccgtggtcccatgacaaatgacaaggaggttgcagtaatgaaattttattactgcaaatagagaccacatctgagatctagcacggccacatttaccattgtgggaaacaaaatgaaacacctgggaaaggatctccactgactttagcagtgagctaacaggattaagaagatctcccagaaacactgattacaatggcaaatgtgtggcacctaagataaggaccaaatatttattctggcagagattaaatcttttcttttcctgaatcaaatatggatcttgcagaaaatctgcccaagaatatatcttgctgatcagcgaactcactgagccagaaccgtacttggccactgctgtcactgaaaagctacagaatgctgctttaaaggtctccatgcttcccctaaaactgttttccatccatgattaattagtgacttaggggtgaattgaatcaccagctgtcctttccatgcatccaggatttatgtactggtttctcattgaagaacagtggtgcaataaacagccctcatttgtggggtgggcagaggagtaatggtgtctgcagtcatggtttcttaactcctctagtacttccattctgctaagcaggttatggctcacattattacagcctagcttatttaggcatgagggtcgtgggcagtgacacacacacacccttagaaatgaataccagttctttaagagaaagcagaaaagtcatattaccatttctgaattccttgagaaataagaagaataaaatggacaataatattagctatgggcatgaaaagtacaaaaagaacccataatcaggttcatttatatatgcatgcatattttaaagctaggtgcttttcctagtgcagagatgtagatagcggtttcaacaaacagatttacgaaatcatgagtgtgtttagtcacaattttgggaggtacctggaactcttttcccagagaacagaacatggggattgcagacatcattttatattgcatattatgtaatcagggcacaaaggaaatactgaggtccaccctgtatctctgcatccttgaatgctcacagcctgctttggttgatcattctatattcctcgcttctaagatcaagacttctgcatgacttgtccattcttttattggatacaagatgaactgacatactaagtgataaatggaaacttgaggaaagccttcattttgggaaaagaagtgaagtgtaccaaactatatatagaaaccagtgtccctccctccagaactcttaatttgttgactttaggtgtagtaggtgcttaataaattttgtatttgtgtatttaatgaatacatgaatgaataaaacaaatgactaaatctgagatttagaaaaactcttttctatatcttgatttatatggattctggacttttctcacattcttctttttcttttcctccttctggttttcctccttctcttccttttacttcttcttgaataaaaaaataatagaagataacaaaggatcgtgaactagtactgtgactcagtcttgtagaatgtcagaattactactgatatggtttggctgtgttcccacgcaaatctcatcttgaattatagttcccataatcccaacgtgttgtgggagggagccagtgggaggtaattggctcatgtgagcagttacctccatgttgttctcatgatagtgagtgagttctcatgatatctgatggttttatgagggggttttcctcttttgcctggcacttctccttcctgctgccacgtgaagaaggatgtgtttgctttccaggcccccacagccatgctgaactgtgagtcaattaaacctcttttgttcataaattacccagtctcaggtgtgtctttactcacagaatggaaaggactaatacaactactaaattttattatccttgaatgcccaacatattgccagtaatttggaaaactaaagaaattgagcaagatgtctcccttctgtccttacacatgcctccaacaccctgcaatgctatgtctttccaagagcttaagagaggctgattatatttgaatagtaaggttacatttatttcatgtctcattgtgactactagttccaacttttagtcataaccaattattagagaagagtcagagttttaatagcattattatgtatgctttgtgttttagtgcacttcccaggaggttggtgatatcaccaccagcatcaccatttgcatcattattatctgtattagtccatcctcacattgctataaagaaatacctgagaatgagtgatttataaagaaaagagtttttaattggctcacagttctgcaggatgtataggaagcatagcagcatctgcttctggggagccctcaggaagcttccaatcatggcaaataggggaggaagagtctcacatgacaggagcaggaacaagagagacacagggaagatgccacacactttaaacaaccagatctcataagaactcactcactatcacgagaacaggaccaagggaatggtactaaaacgttcatgagaaattgtccccatgatccaatcacctcccaccaggccccatctccaacactggagattacaactgaacaggagatttgggtggggacacatccacaccatatcaccgtcttcactgccatagtgttactcttatctaattcattgcaatttcccttctgacaagtctttgatggccacagaggttctcttctgctgtgttgcataagctctggtcttgaatatatctctctttggattaatctgaggagtagggctacaagttgggaagcatggcagccatctaatcatgaaaattctaggtgagtttcattggcctctactggggttaccttttctatgtggtttggaactgcagaaccattatgtgcatgtgtgtgtgtgtacgcgtgtgtgtgtgtgtgtgtatatttatatacacacacacatatatccagcccctctgacattggctcctaaccattctgtacacctctgctttgccttgatcgcatgaaaatatgctgagaagctcatatttccactttaattgtaaatctgaattgataaatgatttaaggtccagtgtcttggtgtactctcttagtaaacaggcctaattcatctcacagaaataaactttgcattgtcattgcatagctactaggtagttccaggcctgatttgccttgaggggaattgaatgatgtaacctgtgcggtgcagcctgtgagagcaatttgggtggtttttatgccattggtttttatgctcaggatgaaagctcatggagaaatgtagaatgctattattatcttatcttcatgctgacagctccctctgggcacctacaggtttattgctggttggaggatcaagtttaaagggagagaacttcgtggttggtgataactatgccttttgtgtttctttattataggaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggtacatgttgttcgctcaatggtcctactctttttgactctcccattctcacttttcagtggtgatttttctcatgactgtcaccaaattccagaacactgagtgaagtacacattcatgatttttttgtatgagaagataagtcatctctttaggacttgatccagtatagggagcttctggagactttaccaactatgcactggacactttttgtcaacctttgactgatacagcctgactggctcataccaaagacaattacggtagattttgcagggcctgtagatgaggagcagtgaagggaaggatcatctctatcatgagctagtgtcgataatcataagatgctccatttgagacccagactttgtggtgccatttagtcggatgcagttgaaggtgcagatgccagagagagactctaaaaggacaattactgaacttgaagacacagatcaagtcatggtaacaatgagagaaaaactaaggtggaattttattcgtttggtggactttgctagtttttattttctcacttaccctaagcctgcctggatattcaaaggttggtcctagtagtcattttaatagcaagcatgctggtgtggcaggaaaaggggttaatcatctgtttaaattttacagtcaagaaacattcagcaacaaattcccagagccagatggctgaatcaagcacaacgggagaaaaggttgccttccttaaaagagatcattcaaataatccctcagctttccctcttgcctctcacttctcccaggaaaagtcctgaatgctgatcgtaaaagtgccaggaatggaagggacaacccttcagcaaagggccattgttccacaattgcactgtcatctgatggatgcaagagaatagtgagaatattgcacttctcactaatgtgggcatgaagtgatgtgctactctctatcctacacaccaaactcctcacaattttctcaccacttttctctaacttcctttacagtgaggtgggcacaataacaaagaagcttgaagcacattttcacatgtctaagagccattagctaataatggttatgcttgtgagaaagatacaaagtgaatttgcctatttgtaggccaagactttgaatggcttgaaggctgttgtatctccacacctaactcagcattaattttctttaaaagcctatcagaagtatctgcgctgttgggttgttccctaactgctagagtcccgctatatctgtttaagaattgtaagagcatctggaaacagcatgcaagacccccaaggtattgaggcaaaaagctccacccactattgatttgccatctcggtttccataaaacagccagctcagccattgctaggggtctcagaatttcttagattaaggcacataaatgcccttatgaggttatctttgagtatttgaagaaagccaaagctattaacagcttctaggaatttttatcattcaaattcactacacactaatagacttaatttttaaatgcttcctgcttaatccctgatggatgggggagagggtgaaaggaataaaagcagtccagtatcttaaaagctgttcataggctcatagaaaaaaatcaatctctctctccatatgtgttatcattggccttgctagtgttgctgaagggtttgttgtgtttctgttaggaatttcaaagatttctaaattgatgttaaccacttgccttgagccaatatagaatctacaagtttgctgccagcaatgagcaggctctttaatggtcatttttaaagccacagctatgtaaccaaaccggagattcttgctgtgcgcctatcttttggtgtctttctttagttccaaattatgggttgcttcctatatgttttcaaaacagattaagcctttctttaatagcattgctccctcctgaaaactattattatcattggaaactgttatttagtaacgatatgtgttattatttcaggacagggtacagtatagcatttataagtatgggccttggagtcaactggctagagttgggatcttggtttcatcacctgtgagtctaaagaccttgaaatgtcctaagcattgaaatatttggtgcctctccccacatgtaattcaaaatacagtaacactgaaccataaaataagtgtaagaatttctaagagtttttatttttctcctctgatgatttctgtaatgctttcaaaatatattagattctttcttcccaaattctcattttgtactttctctgttttgttgttctttaagaagatgttcattcttctccctgagactgtttcctagtctagacaaccagggtaatgataatacctggttaatgtgaagattaagtgagttgaccacatgtataatgctgggacaattaagtcaatcctcaataaatgttagctgtgaggattaccaatcatttggctagcattttaaattaggacatatttttgagtacagatttcttcattttgaagatgaaataccctatcaattagacaaggtagatattttttattctccatttcaaataaaaacagagacccaaggaggtgctatgcccttcctaaggtcacatagcaagtgaaggaagacctaggacaagatttttctgtttccaattgggcagttttcactattgctcccccagagaattgggggatgttctgaaaaatgcatagctagaaatgagtatttttcttcttgtgtcatcttagatttctttctttaaagaagtgtcatatctcaaaggtcactttccaatgatcacacaaaagtggttattgtgaggtgttgagttcaaaatcctcatttaaaagttttattggcaccagtgaccccaagctgctctccttacaacaatggcaatgtgctcccatgaagcagctgaaagaatagtgagtatttaaaggagctatatccccttaccttgctgcctcaattaaaaagttgttgtgtgatatactagatcgaggtttatgttccactctgccaagacttcctaggagcggttcactttttgagccttggataccttattttctctcctctctgcttccctgtgctattaaaaggatcaatttaactattaataatttaaagtatcatgagaaaaatctggcaatgtttattttaaatcataagatcaaaattccccgtgtctgggccatcaaacaaagccatcaacctggcaaggcagtcttgacagtttctacaaaaatgtgtccttttgttttctaaagtcattctattttattattttatcaataacagtaggtttagaaatcatcaagggtttagtctcactactcacttattactaatgtttaaacagtaaagacatacagagtagctcctatagaagatttatgttaagttatctcacttggagaacatgctctcggggaattgttcctgcctacaaggtctgaatgagtcagctgtgcaccgggatgaatgggtcatctccacagtcttctcatgggcatttatggggctctactgaaacatcccaccgtgaaatatttagaacccagctgggcacagggcatgtagcactggctctttctttgtgaatcagggaagaaacagaatgaaaatagttctatagcaatcggaatcttatatcactaaattctgggaggtagaactgaaaagcaacttctttctttgaacctgaaaatagaaaagctaagaaacaggagagggaaataaaagaagaatcagcccagagctatcatccaggcactgacaaatgttccttataaagtctctgattgttgtccctatacaatgcggtggtaggaacaagggagggggggtgaaaggtgacttgagtatgaggaattaattttagccacagctctaggccccctggaaggctgagctgactgggtttgttccatatcttctctctgctgtgagtgggtggccggtgatactgtcactgctgtaagatccctgagcatggtccagtaaaggcttttcaggtcctatctaggcttcctgggacatgcagactgatacacagcttcaatctttgtatgtcagggggtgctgaggagagcagggcataccaactcagttcaagtgctcttcacagaattcctcttcttcagtctttaaaatgcacacggatgacctacatttaaatcctatttgaccacccaacttagaacgtgaaaaagaggtaaaagtagctccctttcaaggatgctacattagaaaactctctttatatttgagtttgtcaaattccacagaaacttgtctttataggggttggaagagaaaacattgctatggtacttataaaacattgctatagtacttattgatgaccaaaataccttcatatcggttattacatttgagcctcactccatcctgtgaaggacagggtttggtattattactcctgccatacccattttaaggttacgttatcaaggctctgaaaggctaaataactttcccagtgtcacacagcttaaggagcagagccaacacttttctatcctgatcctcagactgcacagcctcaaactttctgctcactttcctatttctcagagccacgattttattaataatgacagtatttctttttgtaaaaacatattctcaaatggaaatctctgcctggagtagtctagttagtaaggtttttcaacctattgacatttggggctggacacatctttgctgttggtgtgtaaggaagggggcggggtactgttttgcacattgcaggatgtttagcagcatccatgacttttaccccctggatgccactctcatgtttccacaagtgccaaataccctctggtcagcaaaatcacccccatataagagccgctgacttagagaaagtttccaacatattttgtttaaatgttcatcatgtttttgtaatttagacagtatacatcggtataagaaagattttttttttgtccacatctcttcctcaattattgagactttaaaggattaaaaacaagtctatgtacttgacatgatgctgaaatttctcaggccttgggttttcattaattcctagccaggaggtttactttccttttctttatgtcttttcctgcgaacatttgagaccttgccagatttgaagcatgcattaaaacaagccccatctacctgctcattcatccgttcaggactagcgttgctttcagttcaacagggggaaaaacagagagagcagagtcctgcagagggaataagaagtataaatacaatcaagaaggaaagccatatttgaacaaggtttcaggactacagacatataagggcaaccagagaaagcctcacttaatgaatgtgtttgaacattgtgaggaacattttaaaaccatcttataaagaaggtgctccaacattcagtcacaaaatgtatcaattaatcactcaaactagtgtatcttgaatattcacactgctaactagtcatcctttccaatttgtcagaaatgaattaggattcacatgtttgtgagtttctatttccaagggaattatttccacattatgcagtttgtcttcggttaacaaaaatgttttaaaagaatgttttcaataggcacttatatatacatatttgtgtaaagcaatggtctgcaacctggctgaaattgagaatcccctgggaagtttaataaattgccagtgctcgggcactggtctcagggcatctaatttaactgaactggggtgtggtccatggatcagcagcatcagcttcccctgggagcttgttaaaaatgcagactctcaggcaccaccccgtacctgcaaaatcagatcccccagtgctatgggtacattgtaaattgagaaacactggcccaggcatttttttgtttgttttttgttgtttttaaaaaaagctcctaaggtgattctctgtgtagctaagtttgacattcactgatatgtagaagctaaaaaatgtgtctttctttcagactgactaccggtactgttcaatgtggtagccgccaaccatatgttgctattgagcagtgtggctggtatgacggagattctgaaatttttgttttattatgtacttatgtcctaggcactgaaggctttaaatacatttctcattcagtcctcactccaacactatgaggctataggttagaggctagtattagccagtgcaggactacaatatgccatcttttatttccttttatgtgttttctaccatgtaaacgatgggcatttgccttcatgtaccttctgaactcatctaatgagttttgatattatacaatcacagggataataactccaccctatccaagcagctgttggagagtcattaaagggtgatgattaagcatgagggttttggagtcagactttctaggtgtaaccaagggcccctggccctgtcacttgccagcttgcccacaaccttgagaaggttcccgctgtcgagaagtttctctatgctttgatctccatgatcatatatatgcattttctcgcattaaaaccaagtgaatgctcagattgacattactataggacacttcacaaaaaaagaaagtactggctagaggtatgtttcctaaacacacatggcaaactaccctttcttaagctatatttgtatgctctgacagcatggctatggtgcaaatctatcaacaaacttgaccctaagaagccagttacatgacctataaaatggggattgtgttcattgttctgtcttagaaagtggaaagttctttgaataccttaaagcattgcatgaataataattgtacctgcaggtgtattgtctggattatctaccacccgtatacattttaggaccattttttatcttgactttctacaatgaagtttacttatgaaaggtgagaataggggactaagagattttccatcttgctttctcatccttcatggagaattccacaatagtagaaacggttccaaagtgagggacatgtgcactgaataaacactttctcccagaggtgtaggaagtggcagatggtgccattcaccgtctctcagccaaactcacccaggtggtgatggctgccatttgccgaacatttatgacatactccccacttcatgggcagcatcctacttagtcttgaaaccacccattaggacagcgttggtcttattcccatttttttagattaggaacagtctatgggagtgtagcttagtttgggaaatgctggtattcaacccagaaccatctgacttaagagtcttaatgtttaatcacactctgctccttccttagattctcgtaaacaccctagaacagttgcatatcctagaaattctgggtttaactcaaatcttgacaatttagaatttttctctcaagttaaattatagaattcccccctcaggttaaatctctgatttctgcccagtctagaagtcagcatttccttgggcatctatacatatttggctttatctatatcatcggtgtggcctctggaagccttgtcagcctctttctttttgcgatcttgttttaccttctagtgccatatctatgcaaaaagaaagaacttttaaatgaaggtttgttttgccatttaatagtcttgcttggggagtgacagagtggcaagaaggtgcttagtatttttttaatttaatttttgttttatcaaggaaacttcctttcttctctgtgaattcccagccacagataaacaggcttgtatcttataagttaaatacaattactgctatcaaacctagagcctttttctctctcccataaatgtctctaagaagctgataagcatttcaaggcaaactggagcttggactaatgctaaaattaaacataaccacccagaagacaaagagaccagatagaaatacataaaacatttgaggtggtgggaacacatggacacagggcacatagaaacttgcccccaaaacattaggttaatacatagctcaaggttatttataaaggaattaacatacacaaaggagctttttataattataaggatttacatcagataataacaattgtagtagccaaagatattatttatctagaattcacttgtgaacagggcatgcttttggtctacagggctgttgagcaaaagaataattttgctgcaaccctctgtaggactttataggatgcacatttacattttccccatttttagtagactatcttgggatttaaagaagaagttggaattttaaaaattagaaagcacatcatatttatttagccatatgttaaatgttataaatattatagtttagggactcagtaaaatgaataattaaaaatttgagggtcacttctaggtacaatgtaaccagggatgtaagataaagaatttcttgatttccaaccataatgcatctattttaattaaataatatctttcaagattagaaatacagtgtagtcacactttatgggatttttaaaattatacttatctgaaatagtgtgacataaataaaaatattaataacatctccctctatgtgaggcatcagtaataacatacattcttctgaattaaaacaatcatcaaatattgcataatttcaaagctggttagtgaattacaagttttgttttccctattgtcacatggaagctctagtttaagtagttaatacaaattctggcctgcagaagttgtctctaattacgaaaacttagaattattatcccagccataaaatacaattaccctgtaccgtttttcctctgccccagagctgcctgaacaccaagtgtcctaccacccatacaagagcatagttttatttatgggaaaagtttccaagttccagtctcttcaatttaaattttgcacaaggttgcagagtctctctagttatttaaagtctaaaaagaacactgagcttctttgagaaaggtggtacataaatatccaataataataatatatattcacatacagtatgtcatttatacttctataaagcagagaaggtaatgaaaggtgctctatactgtaaatcactcaatcgattgtaatcatattgcagctcatctcaaagagataaagaccttccactcctctaaaatccctgtcaatatcctagcaggctgaagagaggggaaagggggtcagaagaggaaggagggaatgagtcaaggacaaagcggcactttgagtcttcagttcatggagttaacatgaatttgattggattcccagtgatatttacagttttctccataagatgcatttcttttccacacggtacttttacagcctttcagtaagtccctgatgctctgtgttggccttgatggcatagtttactaagtgccaatggtagatatatagcacagcataagaagacttagggactaagtttataagtagcaaatgtcaattcgacagaacttaaatgctgaagtgtatatcaaacaatagaagtcgattgatcatgggctagcaaaaaatttatattgcactttcaaacagcagaaacactgtaaaaacctttttactaactgctgttgcctttaatgtaatagaagtattcccctatcctcatcaccggggtagctctgagtggagccatttctttatgcacttattcattcaccttcattcactattcaacaaacatttgttccacatctactttatatgtgaattcatactaggtgatgggtatatggtgaaaaatgaaacacagctcctgacctcaaggatcctcaagtgtagttgaagagaaatacaagtacacaaggaagacatttttattgagcagttattaattgccaggtagggtactgggttcttgtatcaagtctttgcagtagccccaaggggtagatattactgttatcatttcacaaatgagaatctggagcttctcctagggtcaagctagcacatgaatacctggaactgaagcctgtatgtcttagaaggcaaacccaaagctcccgtacgctgccctatcttgaacctacaattccacaaagtgaaagaaggtgctactattgaggtgagatccaagttcagtagcgggtacacataaatgcctaatggagcctgaagatcagacaggggcgagcatggaatacaatttgggatgtgaccttgaattatctggaacaatgccaataagctctgctcccctacctagtgtgaaagatgacatgacaacttatacctttctcattgaggaaattaatgaccatggaattctttcttttacttaaattttttttttacagttttattgagggatgattgataggcaaaaaaatcctgcgcatactttgatgagtttagacatgtgcgtacacctgtgataccttcaacacagtcaaaataaacacattcatcgtaccttattttacttagtgtcatctccccagtggttccaaggtagaagtattaatctccctcatttacagatgagtaaaccaaggttcagggaggttgagcacatttgctgtggtcactgtccaccaagggtcaactctgagattccacacagatatgtttgccctcatttgccctcacaacctaatacccaggttgcccactccacttttccaatgtcttccaagagcactccagtttgcatcatctacagagctcaaattcacatggttgacagatacaaattcacatgcaaatgtactattatttcctacatcccagtgcatgcagaacactgtaatcccattattaaacatttactagaaatgtgcttctgcctgatgcacaattgccagcctcaatgtttaattaaactagatttgttttcattttaatcacattagagaaatgtgtttttctcagagttcagtggtgaaatcttcattccaaatgcctccaagtgactgaaaactgtatatcccagaggaagggatgagggtattacaacctatccttgcataaaatattttaggggaaaaatattaattaataacaggtaagactgggatacactatttgtttttgaatcatcatagcatcctggaaaggggtcctattattattattaccattttagagatgaggaaacgaagtctgagtggttaagtaacacactccagtgttgcacagctagtaggtggcagaaccaacatttggatgtagacagggaaaccctgatatctttatttagattagggatcaccaaaccttttcccccaaaggccaaataacaagtagcataggctttagaaaccaacctatcttataaatataaatatatttagatattaacttcaatattttattaatataaatatgatatgatttgcatgatctttgttgcagttattccagtctgctgttataatgcaaaatctactatagacaatacataaatgaataggcacagctgtattctaataaaacttgctttacaaaaacaagctgtgatgaaccacgtttccccattaggtttagctgggggaaccctgatttaaatcacggatagttggaagcctacagcttttactaatccatcagctttattttttgaattgtcttatctgtttggaataaagagagcaagagtatctctaagtggatgggttaaatccctagagagacagagaatagtactaccgtgtagggtgacatagacctactggtgaggttaattcaggataaagaaataaagagatacaatatgtaagaaggacaggcactccatttacgtatagttaaaaatgacaaacaacaaaatagctaaataccatttttttaattcaacaccaaagacagacacagattccattctagagcaagatttgaagatgatggacagaaagcattgtttctttacttctgttacttctacttaataagccgtggtgatttaaatacacccctctctcctaaaaaaatagtgcttacttttcttttaaattcaagaattttgattagccaccctagcctatttctcatagcccttatgcataaaggtgccagttgatgccttgcattgatctttcttttctcctacccgcaccctgattgatatgtctgtcttctaagtcttagagagcatgcccttcattatctcagcattggttgtccctgtcttgctgctgagagcttcctgcttgagcttcagttccattttcaagccattgatctgatgttctgaggatggactagcccactttagaggtggctcagcccacttcatgctattgagttttagagattttagaatcagatcccctatttattaaagcagcaagaccaggctatcagtttttatagatgtgcatatgcctaaaaccatgtagtatttaaaataaattttgacctacatcctctattccccaccacgcctggtacccaccattttactttctctttctatgtatttccttcacttttattttttgctttttggattccaaaaagtgagattgtatagtattttttttctgtgcaaagttataagggatgaataagtctagagatctaatgtacaacataaggactatatttaataatattgtattattatatattgataatttgccaagagagtagattttaggtattcatacgacaaagaagaaagaaaggaaagggagagaaacaatcactgtatgagatgatgggcatgttactttgcttgactacagtcatttcagtgtttatatgtatatcaagattacatatataccttatatgtatatataccttaaatatatactttttttaaaagccaaactaaagcacactgggtttttatttacaaaatagggacccccttcacagtttgctgacctcaattttgactccaattaagttatcaaagttctaactaccagaatagaaagcatatactgccagatttggccctatagtgcaagaaaagtggtcacagttttcttaatcctcttttaaaaaggaaagaaacaaacatagtaggtaatcagtaaatattaaactgtacaactgaggtttttggagctttctgacttcaatgactgcatatacacaacaaaaatataagttgttatacagcatccttgacaagcattaactataaatacttttataacaaaagaaaaatatcatttactacaaaacttttaagcttttgctttagaaatgtttctttattgaaacaaatatgattttattgaaatattttttatattagtacgatgactctttattggtctcaaagggtggattgccaagtataattaaacaaaatgataaataggaggaagatttcagtatccttgacagaaaaatacatataaatctaatatagatatatatgtaaaaagtaaatctaaaatcttagccaaggtttagaaatcttattacttcatttttatacctttataaaactgttgcgaggtgctgtttcaaataaaataaaaatttatgtaagtaaaatacaagctaaaatagaactgaaatgtctttaggtttacaaaatgaatagctggattagtttactgaatttttttctgtggtatgggtggcactggatctctagaatcggtaaaaataaaggcaatatattgttctcagggagcaattgagctctcctagaggaggcaaaccaagtgaaatctaatagttttgcttcattctgtgactttcccccgctatgacctcagaattttgagctacaagtaggtctataaagggaattttggaatactcttaatagatctgttcttgaaataagtcagctaaactgagtgaggtgctttgccaacacattaactgaaagtcctgaccaaccctgatcccagaccttcatggacaattctcttgttttatttccatttccagtagttgtatgtaattcttctaagagacttgttccaagccaaccttcctagtggtcttgttgaaatgagatagtggttgtaggtatcattgatgaacacataggccaaaacattattgaactattcagaaagtaaatctagcttattctgtggctgcataattatataactgtagctttctgtcaggttacagtggctttaattttctgatcaaataaaacaatcaatataattgtactttgttcctccctcttctggcttcgattctttgatttgtgccactcaccactctcattcttccaacctccccctactccactggcccctgcagctacttagaatagctagctgttgattaaagggaccaagagtttgagcagttactgtatactttcaaaccccactgccatttggaagtgaagtcccaactgacatagccaaactgtaaggacaaaagcaactctaatacctgctttcctttgtttatagcaactgctcaaattctcctctaaaagtattcattaagcatccttctctataaatctctgtggtagaaactgaataataggacttgaaccattattcaatcagaccaagtttaaacccaggttaaggaaagaggaagtctacacgtctttgctgctcactgtgtttagtatatatcctctataattcacaatcaaaagtaaatctttggacagcattcttgtttgggttagaagaaaaatttcaatccttgttcagaagtctaagcacttgtgaggattccaatatgatttttaaaggccaccatccctgatagtcagaaataaaaacattaaaccaagaagactgcaggctttcttctcacctgtccatctcttgtcctaattacaccttatacttactaatgttgtaagtgctttttgacaagacagcaatggtacatcaatagatactgcatgaacttgagtaggcaaatcaagtcactcagaggccttcttttaatctcttggatcattattgcaaagataaaagcaggtttctgaaggagtgaaattcaaaggaacctagtaattagaatggtgaaaataccaggtcacccggtccgtttccctgcttggttcagatatttctaacaatatgtactagtttaattttattcatctaatttaaaatgagagactttatctttcttccaccaagataatatatctgatttctcctctttggcttaaattttttttttcattcacatcttttattattagggttgtcagttgaaattattttgaataatttctttaaatcatggatttttttcttacatctcatatctaggagctatttcttgttgcaaggtgcaaggttctatggcacatacaaaagcatgctttcatttgggatatttataaaatctctctatacacacacacccatcaatgggcaaatataaaaagtattgcctttgtgctagcatgtagttaatattcaatgaatatctttacacgtaaaatcacctataatctttagacatgttcctcagatagccaagatttaatattacatataaagtcatatgaaatagcttaaagaaggaagaggcattgttattttatgtatatgtctcaaatgttataaaggttataagaacctttctgaacatcgaaaacttcaaagctaatagtttaatagtttgttggatacctgccatcttttgaggtggccaatagttgtcaactttttgagtatccttgagcactgaaggtatgtcaatgtttggtttcattgtgtgttaaggagggaattatagaagtagaatggagtaaaaagcttaaaaaagaaaaagcactgcttctaaggtgattctaatttcataggaaaaaaatactttaaggactaatattcaatacagagtagcggaatctgggtgccagataaatatttaacatttgtggataattttacataatcattggccactttcttaaaagtgttttttaaagccctaattttaaaaaatgctattctggccatcacatttacaatgtgaataatatttgagtcatgacgtaactataagttacttctaatgattgactgtcacttgagttgtaaatcacagcatttagcagtgctagttgtccttacttttggtaaccccttagtccctggatcttgatcattttggggtctttactctagagtctatctttgctctagagtctagctgccattcacatgctaaagaaatgccccttaaatagtacctataacatcctaaggaaatgatttctaaactcttctcaatgagtttaaaaaggctgctttttgctaatccataaactttaacaggggctgaagaggcagtgcctgctttttaaaaaccaatgttgcaggctgggcgcagtggctcacacctacagatgcatgcctatagtcgcagctatttgggcggctgaggcaggggaaggcgggaaaattgcttgagcccaggaggtgaaggttgcagggagctaagatcctgccattgtactccagcctgggcgatgagagtgaaaccctgtctcaaaacaaaacagaacaacagaaaaaaaggtaaaaccaaggttgcaaggtaggactgtttgtgtgtgtgtgtgtgtatgtgtgtgtgtgtgtctagttttgatctttaatgagagttttggtttgtttctattgttgtgtgttagtagggaatgtggtggaggagtgcctttctagtctaagtatacgtaagtgtattcatgaccagtattcaaagggtattcataccctgcagggacataaatggttttgttttggaatgttagggttaagaatgaaagtgatggccctgtttgctcagaaaaaaaagaaggtaatccttcagtgctctctgtgaaatcatgtatggaatgaaaaaattcattgatggggtgagaggtctcagtgccagcaagtcttactagtaaattcagaattcagcctgctgttcctagagatcttcctctccactcctcatccaaagagtgatagaaggaggtcagataagtaggtccttgtccctttagggagctacttaactctactcattatcgtcttggagtcaatccccacctcattccctgctcttcccctagtctgtgtctagaatcaaggatcagagaagcatcaacacatgcatcaacctttctccaattttccttccctttcccaactccctcagccttaccctctcctctcaggaactgcattattgcatctcttcttttggatttggtaattctttccttagaaagaggaacagggctaaggataggcaacaggggcccagctgtccatgtctccatccttggacccctaagacttttgccacacaaactcctttgaatctggagactgcaacggagctgcttccctcctcctgctgagccttcatggaaatcctcataggagatagtgtttcctttacccactctcggacccctgttcttcctggatctcctgaattcctggctatatcatttaggttcgctgcattgcaaaccactccaaaatttccgtggctcatgtgagtgtttttttctcttctgggttggcttggatggagctagatgatcttgatggcctcatgtacccctctggggtctcagttcagatagccgagtaggttcacatggctgggtttcttttctcatggaagttcacatggcaatctcaggtgtaggcagcaggcaagggcaagcattcatacacagatggctcttcaagcttctgcttatatcacatttgctagtgcccatatgcccaagcaagtctcacggcccacccagaaccccaagggtgaaaagatagattcaaactgttatgagaggagtaagagtctcactgccaagagacagattttgaaatgggattgtagctattttttttttttttccaatttaacacactggaaaagaagaaaggctctggttctactaatcatatttccctcgtaaattttctccttccaaccctgattcaggtctcaagctgtggttggaaatcagtgactttcactaagggattgtcctttcttttctttaggacatggctttttgaaattaatcttgattctttctgccatatcccaagccttacatttttttcctttttttctctatgtctgatcattttgctttaagtcaaattgattttttaaaaattaaatgcccattaagaaaattatccacattcatgttcccttggatgctttcaaatattttattttcctttgcttttggcagttacaatctatcagtgttatttgtaaaatgtcttatatttgtatagggtatgttctccctttcctcttttcttcttttctttttaaactaagatagatgtgttataaaacagcccccatgctgatccatacttttctctagacatttctgtgagctcagtactttgttgtttatcattatcctttgtttgtagccagatttgaggccatgttgcagttctcacaaacaaatcaatttgaattaatttgccaagtagaattaacgaggcattgtatgaattcaagacatactacaactacggcatcccctgaggttatttcttctctgggaaaattttgattcttgtaccacattttaatagtgtatatctgacctttgaatcttgcactaaatgatacatggctgccagctggtttaatttttgagaagccttaaaaattctatgcagccaaacaaataggagtgtagacaattctttaattattaactttacggggagaaagttgtcttcaagatcgatactctctgatgcttgcttgttgctaggagttctttttctaatgatgttctaagcagaagtttgagaaacatcaaaatagagaatatatatttcttagatggtctttgaggtctccacaacctaaaaatgatgggctccttctctcaaattataagctataaatcccagcaaactctactcccagaaactgtttttatttaattataaaatgggaaagcatttactctaaagagggaccatggtgattacctgaaattccttcactccctaaatggacatctacatctgtcactaatatattatttagcaaaagaatttccttcagactatgatgaccaatgcaaacaaaataaataagaaaatccagtcccctcccacccctcacacggtgaggaaatggtaatagagttcttcaaagaaactctaatttctgggtcttagatgaataacattagaagtgcttaaggaacttgaattctaagcccctttaatgttcgctcagaaataattaacaggagccagtcagaatagaaaactagtctgggaaaagtgtcctaaattttacactgtataataggatggatctcttaaactcgggactgatatataaaacttctccagtgtttcatttgaccaaaaattggcacacatttagctagatttaaaaaagaatatggtgatggctgagaactaacctgggctcattaaaaaacaaacaaacaaaaactcacgcatgctagtgtaactttctcttggatagcaatagcaaattggcaggtgaggaggatattataaataccatgcacagtgtatcttcatttccctaaagcagtatactgtaatgtacagagaactatgaagggatcttaaagagacctgcctgtgttccatcatttgaagctttctggttacactgtaaagtttgaggtaaactaaaataataaaagtaaaatttattatctcacagtttctataggtcagaatttgatagcagcttagttgagtgattctggcttaaggtgtctgatgagttgcagttggtatgaactacggctgcagtcatctcagtgctatctagacctgggagatctgattacctggaaatctttcactcacatggatgttgactggaagcatcagttactctctggctcagttccttgccttatgtatgtttccatagaacttcttaagtgtcttcatgacatgagtctagcttgctcgaaatgagtggtccgagagagagcaccttttatgactcagtctctaagtccacacactgttccttctaccgtgttttactctgtagaatcaagtcactaagtccagcccacaatcaaggttgaagaatcaaacctcacctcttacacagaggagtttcaaagtatttttagatattttatagctccatcataatcttcctattcagggactagaatgaatgcacaaaaaatatgcttattaaatttgcagataacacaaagctaagagaggtatctcctaccagaaacaaaaaatcctagagttaaacattttcttaccatgtttggatgctgttatgaaacaaaaagaatacatttaatgagatataaatacctgttggacgttcataaagtatgttgtatgaatgcaacgtggaacaatttctttgggaagccattcaactagaaactggcttgagttttagttagaaacaagcctaatatgcggtcctgttatgatgtggttgttgaagcaacggttgcaaatcagtatactagtcaggcctcctgtgggtggtgactagaacagtgattgttacttttagatattttgggaataataaattcattcttaggcaagggggttcaaggatggtctaaaatgtctacaattttataaacactggcaattctataggatgtatacagaaggattactatgtcataagtttcttgagcatcggagatattaataatagcatgactttcctgttgtcgggatgacaatgttcctgtgttgtgcagcggaattgtcctcccaaacctcctccctgtcctctgagctgtgtggggacaccacatatgtatgtttaaatgaacagaattttaaaaaatcaaatattctggcattctggcttcaaaaaccttgcgtttgatgttctctacttagaaataaataaccaaacatgagaggaatgagaggagatggggatggggagtgggaggaagagggtagatagaaataaaaggaagaacaacattacagagaagcagagatgacacagagggtggacacgtgggaaggcctggatcacaggggaaagagtgagccccaaaataacactgtggcttttgcagcaaggaggaaataagtgataagaggaaaggcacctggggaaatcttgaagggatcatatgtcaaacggctgaagagcaaacattaaagctttattttgaaaaggatatttgaaaatatttgacaccaaaaattctgtagggaagtaattcttgtggagtttgccttctttttagtttaactcttctgaatcaggtacttgttataacaaatcatatattgagggattattttgtgccacagatttgcaacatgctttatatacatttccttttaattctcaccgcaatcccatgttgcaattattattacgatccccttttaaatatgaagaaactaaaacttaaaatgcactaagacatggctaaaactaagcatggttaccagaaaggaacaagacaaaattcagacattgaaatcaactactgtagcttcagtgcatatttcagaataattgtggaaggaaaaaaaaagtgacatttgaggaaagaaagcaaattttacagtcagtttatgttttgttaatttataacatggcctttttgagaggggctcttaaataaagaattggtgccaggttaacctggcatactgaagaaagtttcatttgaagttgcttgaaaatattctcttaaattataggaatgaataaagaggttgcagtcgcctgggcctagttttattaacctaactgggattgaaagtatccttgatagaggaggagaaatgagcttcaggaagtgagttacaaatggcctcaaagtactgagaaaggataatgattggtaaaatatgttgtaattattgcatcaaagtaaatcattttagtacataatacctcagcagaaatggatttttgatttgtttaggatatgaaagagaagtctaatattaacatgtatgcacaaaacatgtatgttcaaccagcaacagacagcaaggaataggggcatgaacattcggatagctggacgtaatacaccagggttacatctccggcatggttccattcccattccatagcctataagatatttggacatgataggccaggtgtggtggctcttgcctgtaatcccagcactttgggaggtcgaggcgggtggatcacgaggtcaggagttggagaccagcctggccaacacagtgaaaccccatctctcctaaaaattagctgggcatgatggtgcatgcccatagtcccagctactcgggaggctgaggctgcagtgagccaagatcacaccactgcactccagcctgcctgtctcagagaagaaaaaaaaaaagatagttggacatgataactacatgtctacaggctcatcagagagagagcacaggcagaggctagagctcaatgcaaatatcgagactgaaaaaggttttggaaggctctcaaggcaaggatttaccctgactcccatccccctgctgttcaaggctccttactgggagaaagaactttcttttctaagccttaggtgagtgttagggaaggatcctaagaattaaaacaaatcacaggctctctcaactcccaacctcttttgattccccacaagctaagcccttgcctgagttattgcatttaatttggataaaaccatgcaatatagatattaccttttttaaaaaaacaaaaaacagatgaagacaccaagagtcatctagattaaataaattgcccaagttcacagaactgataaatgtctggacttgattcaaagtttgtctgactccatatccaatattcttttcactcatgtttgggccatctttgcttaaacagatcaactagcacagcctagagttggtaaacccatactacaactttaatttaggaaggaaatgatactgtctgctcgtatatatttgccattatcagaacatatccagaagacatgtagaggtgagctttatcagccaacttggtgtacgacagggtgatttgcacttctttccagggtctccctggctcaaggagccacttaaaaagctcccttacttaataatgcccttgtgctctgggtctattaatttacttcccacaagctgatcaattttctgttccaagacattaatttctttaccttggcacattaaaggatcaaagctcacaacatataaatagttctttttccttctgccccaaaggtgtgtagtgaggattaatgagatgatgcttataattgcattttgagctccttggtcgaaaggcactttataaatacaagatattagttttttgctgagatccatctatcacttacaagtggccaaacattctagatggcctttgggtgtgcaacacctccctctctgactctgagttggtctgggacaatgccagaaatgtggctcaagccaagttcagagtttctggagttcccttcctttagtgtcatatactttctctgaaacttaacttagaaagtgttctttgggggaagagacatggcaataacctctaaactgccctagtacttgagggcagcagtaccactacattgattttcttttgcctctgactttaatacatagcatttattctttgactgttcattagacccacagtctgattttttagtgtcaacaaagcaataaagaaaatttgttcctcctttatttcagggctcaagacaaaattcaaaaatgcctttggcattcattttgcacagacgaatgttgttaggatattcctattagcatgtccacgtgcttgacaacatttcaggtggtattaatagtctacctgcaagaaagtgctttctgccagcctggtgcaaattggcagaacctttaagccactctttctcagcttagcagcagtatatcatcattacctgtggctggaccaagaaatcacatttgtcaatgcctgaattgctcttttactttcagtggttttagaaatccactttgttttggaaatgggcttagctgagtatgttagaagatacagaaacatataaagtgatagataagggatttaagggaatattaaggatgttacattttctatggtcagttgatctttggaagatgacttttgtgggaccaaatagaatatggtcatcttttgaatgaaggactggtaagtgggaccaaatagaatatggtcatcttttgaatgaaggactgataaggtagtgagacaagggaagcataccgtggaactaatgagcttccttctgatcactagaaaagagtcgagtcatattaataatgatagtttaaatatgctgtactccctattattctatactaagtcctatggtaaattgagaaatggggaaactgaggccaagtgacttgcccacgatcacacagctaataagtgataaagttagaactcaggaccagatttgtctccagagcccatggtcttaactcctatgctgtattgattatggctttaagagtattagtataccttctaattaaataggacccatgtttggaccaataaagtgtaagcgcagtgttgtaaaagttattttccatgttatacaagagttctatttttcagttttttcacttgaaataattgtattccttggagactgttaataaatttcgagtctcaccttaaagaggaattgatgtatattgaggcctactcaagggtcagtttgctttccgtttctttcccttttacttttatcctaagtggattcacccaaagtggaaaatgtgaggttggagtgtaaaggttggaactatgaaccagttgggcttcaatactttcacctcaaagtattctgttcttcacaatattataattccacagtgcatgtgcttgttgcacacgtctccaggagttgaaatacttgatattagagccagtggtccaaatgaaaatgaccagaagaggccaaatgtataatgttctcaatcccttatcaaaaatagatgggaataaacacacatatatttaagtacaataaaatgtgactaatatgtttttttctaaaacccagtcccatataggtgtcggatccacagaagtaatttaagaatggtttatttgaagatctctttgtataatttatagatttctcagtgtgattaagaaatgaagttattacatttttttctctaattagtaatgcacgtatgcctccttttaatgatattatgatgtttactactcatagggccattctttcttgagtatagccatcactttctgttgaagaattgatttcactctttgtttaaatgtacatacttgttgctatatgaaatatatgactgaatatcattaaagatttagcaagaatgtaggtgaatttggtgaggtttgttcagcttttagagtagccctgtataagaatacttatatttagaaggttgtttgcgcttcagtcaaactagcaaatgaggcatggggcaaataactcattctcatgcacatgtttctaaaacagttcttactaatgtttgagataaattaaaataaacaccaacaagaacatgaaaagagactaagaacaatgttaatgcggcaacttaaacaaatttggttttccaaatgaccttccatctttcacaacttttaacagcatgcaagattgctatccttagtgccagatactatcaatctggtgtggaaaacttaaaacttttttctaaatgtctttaaagctgaggtggagaagaatgactctctgtcactttcagaagggtctaaggttgaatcatgaccatgctgtccttccccatgtcacttactgtttatctaacatagttatctctttttctagcctgtatcatgcccccagattattttctatggtgctttacgtttgaaagagagtagatgatgagggtggggatgcttaggagggacaagggccctgtgtatttggaggaagtaaattaatacagcttcttaattaatttggtgtatattaaattctagaaatttggaattttagttacttctgattttgccctgcattttgctaagaatatttagctttatacttgctatcgactacaccaatctattccgtagtgagtagaatgaaggtcattaatatatttaatgtgtagccaacaatggcagatacagaaaacccaaagtaatagaatacattcaaggcagatctggcgcaagccaattaccttttctcagtatagtattctgttgtgtctaaaaccctagaggatgaatgacatcctttatgatatctgtcacctgtagggtaggattatgagttatagatgtatattcgtttcaaaaaggtacacgttctttttctatgaaaacgtctaaaaagtttactcaactttattttgaatgaatagaatgttgtaccaagatctaccaaggtagaccattataatgatctctaatcgatagctatattctttcgccatgggctattgaaacaccaagaaattaacttgcctgtctctttttcctctttgcctgccctctccatttttttctatgagaaatgattccttgaggaaaattttaaattatccactgcagttcgaaactgttaattgttcctattgcattttatttttcaatacattaatatgttataccctgtaccaaccagatacagtcccaaaacataggctagaagcagattcatagttgcctcttttatgagttcttattttaaaaattcctggtagtaaagatatgagtcagcttgttagaataatttgtctgtatgagaagtgaatggggaaccttgtgaacatcctccaatattgctacccgtttcctatcctatacccccaccctcacaacacagaaggtaggtaccagtttattcccaggtggaatctcctcagccaataatgactcctatatggagatggccctgcaattgaaatgctttagcatgcccctattcatttggtctgatgctatatgcaattctaatattctttatggcttttagaattctttgtaaattgtttccaagccacctggtttgagatttttctttcatttttaatattggtagtttggaatggagttccccaagttgcaatataggcctatgaatcaaaagtaatgaattacaattcactaatttctgccagatcaatgtgaggttggttgatgagatagaacagttcccaaggcatggcttcatcattttgttatttgaagcatattcattaagggtgtatctccacagcaccactctccaagtctgtcctaattatggaaaccattcagcagtgttaataacagttacgaaggaagagggggggcatactggcagttaaaaccactatgtttgagccttgaaactaattagatatttcatgcttggaagaagtattcctaacaggctttatgaatggatgcttgttcagaaaggtcctcttacagtaaggtaagagaaagagaaagcaggagggagagaggaaaggagggaagtggagggaggctaaatatacaaaatcagtgtctattataaaatatcggtgctcaaaagtctacaaatgttgtaccactatattataattacctctatttcctttgacatttgagtttccttatttttaaaaatgtggaacaaatctggaaagatagtgatataaaagcttatctgtactgatctacctctttgacaaagataatgagatgcaaggacatcctttatgtaataagaagtctcccttggccatcaaggcttaaattgtcctctcctcctttcccctgtcggaacataaagctgttgcaaacacttgagaggagaagaaaagaaggacatggccctatgtttctgatgggaatacggtagattaatagtgcagcttgcgtgactgtggagcgagggtcccgtctcacatgtgaaactgatctggcaggtgaattagtcatgggtcaaggagatccttgtgtctcaactggcccaattaaggtgtggttgagatgagacagagagagagtgaaggtaaatccatttccgtaaacggccagacctcttaaggattcccattccatgccacttttccaaaacatgatggagtactgcatggctaagactaacctgacctttaaacctatcgaccaagggcagagtgacttcaactccacctctactaaagataaattgatatctatctctaaaaacttcataaaacaaaccaaaaaacctaggatgttttttaatgacttattgacttttcagattgttctttaagctgttttttaaactttaaaggcaacactgataatgaacgcttccaaatggtaaaacagaaaatccccttcaaatataatcggcctgtagaggagtggctgcaggaaaaaggtaaccgtcattaaaactttcattttaaaatcatttgatcctaaaccctcatttttaaagcctgcaaataaatgttccttaaatgataatcgcctgctgcataaatgactgttttaattttcattataatttgtgtcagcttccacctgccatatgttgataaatcatgctataatacattgccattaaaatacagttaaagggactaacttctagcctgctatcagcatgacaaacacaaacaagaaattccaggaacttctaaaacagaaatgtattatggcaatttaaccactgcatgacattatttattaatttgttttaaattaccttttacaccaaagctttctaaagaaattccaaaagggctttttaaacttacacctggaggctgttttggcttgtagcatgcttaacaaaacaaaaaacaaacaaaaaaacaaacaaacaaaaaaccatagattgactcttgtaacttaaactacttaaatattgtaaggggagcatttttttttaacatttgttcttaaagaaaaaaatgaaaaagatgaattttgcctttaaaacctacagaggcaaaattattttctaagagattaaggttgtgtcctagttgctgactgaaactaaaaacaaaaacaaacttattttacacttcggttgtgtgcatacacttgtgtatttgatgttttatgcaacaaaagtgtaagaagttaacataatgagttggaaaagaaaaggttcatgaaaggcaaaacagcagtctctgatttgctggagacaacaaccactgttaataaaagagggcagcggttataactgatgttagaattttcctgtatagcttctagctgttagaaaataaaccattgtttttcaatgaaaaacagtctctaagaagatacgtattctttgttgttgttgttgttgagccagtgtaagctactcttgtctcaacacctaaagggagctcttaacatttgtagagatttcattgagttatatagaagaagtaaccaggtatattacttagtatacaacttaaagagcaaaggactactacagttttaagttggaggaagacattcagacctttaaacgtggaaaatcctcacggagtgttaactgtttgccctgtttttaatgtatgtggtctaattaaaaataagaataactctaaaaagcaaataattttgtttagtaatcatcagctcataaagtccctttaacattaaagacaatgattgcctcactttaaacaggaaaagcaaactagatgcatgtctgagtctcatgtgcctgagaaacctttttgtttctttcaattttatgttaataatttttattttactccattgccttttaagtctaagtttaatagcatgccaggcattttcatttgtataaaccattataaagttattagtaggcttttagtttttcttacaatagaattgttacccgttggctttcacataaaaggtgctttcaaatatacaagttgaggggttgggatggggggaggggtggctgaggtgggactggggaagatatcctagtttcttaaatatatgtatgattatatatgcatataaatctgaaaagaattatttgcaaaccgtgagtttctcttctacattttgttctctgaaaaaaaatttttgttgtaatttgggtgagtaacatctatgcattctattgtcttacctcttcctctgcctagctaaccttcccttcaaaaggaataaaatataccaaagacttgtaaagacaatgaatataaaggataaagatagatggatgattagacagatgcatttggaagtatttggaatgcctctttggagttatttctgtcactggggtggagagctgggtcatagcattcccaagtctcttttctggctctgtctactattgactaactttctgaccttagacaatccacttaacctctctatatctcagatttcccatctgaggacgggcaaaataatactgcctattccccaagggtgttctgaggtttaattaattagtctttgtgcaacactgactggagacatgcaaagatttaatttaagcagtatgtgaacttgatgtccaaatgaggtaataattaatgacttccaagaggatgggtatctaaaacaaaaagtaacctgctacaattcctctaccagtgtttgttataaccaaattttgcattaagaaagataaaatagttctcagattaggatatatatgcataaatatgcacatatatatatatgtttttatgtacatataatggtcagttattataaaaatctgatcataagccatgagtgaaaataatgagaataatgagatctggcattgatttggggaaatcttgggcaaatgataaaaagaaactggtcagttcttcacattcttcatagggaatgaatagtgatggttttttctgttattcactaacccctgtttatctgagagataaattaatcagagtaagggatggcaggacacgaagagtgctctactgttcctttactgattgctagctttgccattaaccacctaatccaaggtacagggagctaggagagggttttactacagcagaagagcagatctagccagaaacagaccatgaaacaaacaagcaaacagaaaagcaaacactccctatggcaagatgaaaaactgaaacatagacaaccccctttactgtctcactccatcagtgtcttattctcaagaattgattagtcagatctctctgggaaagtagctgtagtcaggagtagaggggtagtttaaatcttgtagcccaggaaacctgccttgcctttcctgatgcttgggtcagtcttgaacaggcaaagagcactttgtggagtgaatgatggcaactggaatgaaggagactcatcatctctagccagtgtaattcagctttgcattttcagttttctctgatcctctttttatttgtaagcactggcataataacaccactggagagataagatgagaactattatagaggttatcattgtgaagtattttcaaggatattagaatgtaagattttctacctgtaatcaagtataactgttaacttatcaccagtgctgaactatacacaaaataaagagatggataaatattatgattcgccagcagttgtgtgcatggaaagtatctcttggcattaggctgtctaatgtaagatactgaattttttcctagaaatctcctgctaggcagctgcttctaatttctaattcattatgttaagctgcttcaaatgcctctgtggggttgagggagaatttattttccccttccatcatttcatgtcttttgtagtaagctcagggcttccagaaaaaaaaaaaaaaaaaactgtcatcaacaataaacagtaaagaggtatgaactccagcatattacttagtattattatgcattgaactttctgctgtgtcttgtgtgaagaggacagaggacaaaatacagacagtgatgcatatgcacaacacactaaatgaattgctgagaaaatgatgaaaatctatgagatctgttttgattgcatccttgggatctgggtaattctgtagtcattaaggccagcagatcccatattcaggttctggagatttttataaagtatagatcattttcactataacaaagttctctggccaattcaccatactgcagtgttgaaagcttccaaagggctattatttgtaaatcattcttgattaatgggcactatgagttgcctagtgtgcagaattaactcttgtctaaggagtatcctctgatcggatgagcattctcttctctgccacttccatttctttcattgttatacattgagaaggtatttcacattatacaccaggaattcaaggacagatcaacattgtgtagccttgaagaccatgtaatagtggtagatttttaaagcccaaacgtgacaatatccctctattcatattggaaattataaagcaaaaagctttataattttgttaaaaaccctctttttattaagtagtcataaataacaaaattgtttctagttatttctagctaaggtaattcaggtgattagattaagaatgagtggagcgttgtttgatcactaagtagagaaaacttcagaaggcgtatatttaattccattaataagtctttcttttttcctttcttcatatggaaaagcaaaatgaagtaatctggagacataacagtaaagaaggccttagcatattgctgttctgataaattgcaataaattttaaaaagctcttactttgagtttgcttgggaaaaaaatctcatacttgagagttttataagtagaaagagttgggaggaattttagttgggtttcattcttctaaactctatactggtatgttttttcattttgatacttttcagagcagtataaatggtgtcaaagtgggaactcgaaataaagtgaactattgatattcttcaactcattaacacacctctatgtcattttaaggagttttatatgttgctttcttcattaatatccatccattttaaaaaatttattaaatctgaaggacaacttccccaggactggagcattaccaatatgcttatatttcatactgagggaataatttagttgtgggaccataatccatcctcctaaaaacaaattaatagagataggaatttatctctcatgattttgttaaccagaaaatagaatattatgcccaatgaagatttataggaaatgatacgtttggtgactagaaatgatacgtttggtgactagtagttcatttttacaagtatgcaatgaatccaagtctcttaactgaaatttaatttcagctaatttaattatcagacctggtttttaaatttagttttctgagtcacctcactgagtttttttggccatatttaattcttttcattctcattattttacttcgtagctttaaacattaatgcagtaggtatccgtaatttattctggtcatcacctgatttgagtgtttctttctgtcatcctcaattatatacccaagaagaccataatacttcttatcattgaaccaagatttcttcttcctcactatgaaggaatagagacttgattgttcaagttatcaaagattttcagctagacagtggaagagataaccataatgaaatgttacttgctaacgtcagtactgaggttttgttgtctattttttcctccccttcaattgctcaaggaagcctgttatgatgcctggtccattcagaccaggtaaggcaaacaaggaaaacgtatgagaataataatgtttcctccacccaacccactaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcaggtaggcctttttccaagtattaattgcgtctgtatttttatctttgcaacattgttatcatggtcattgctttatgtagctaaagagtttgaattactatgtaagaaggatgctggcagatactcatagtaatgagacccaggagaagagaaaggtgaagtcattgctaaagaagtcataaaagtctgtggcactcctgggttgttattcttattgtatttatcactgaaatggtaaagctgttattcaaaacgagcaatggactacactttcagtatgaaatactctctcctttaattttattaccttttcaaataacagaaagggcaagggagggaaggaaaatctgttatcatatgaaaagctatatcctagttcaatttcattcacattctccagatggctttgctataacatgaatctttcattattgaggtcaatgggtaccattaaatcaagggcagttaaagttagaagtgcaactactccttgtaaaatgcagtctttatgtttgttatcaaatcctgattaatcatgtgtcaggtttgtgcccattttgttttctttatatttgatcaagatactaattacagtagaaaatttgaaggtttgagtttggctataccggaagtccttgtttttgtggcagtttttttccacttgaaagtaattatatccaaactaagcttaatactttgctgactcccttggcatttcataaatctagttagtagggggtaggaggttaactgaattattagccttaaatgctctggcataccatgagacattccaattgctgctgcgacaacaattacttacccctatcctagttagtgtttatagaaaaatcagtagattagcacttgtcctgtttgcttctttgttttaagacattatccaggagctcagttgtgtctttaacatcacctttacactgactccaatggacgtggttaacttaaagtcaataatcaattataccacctatgtgttcccatttttcagaattaaatgtatgtgagctaggtaatggtaagtgtattatctgttgccttcctttttccttttccttgagcagaagtatccagacagctctttgcatggctccacagtaacaatttggagttatatatgctgacagtgtcataagggcaattttatcgttttcaaaaggcttctaaaaacctggttagcatagtactgttaccgtcacacatgctattacctgcatacctacacacatgctcacgagaaaaaaaatagctcttctctactgatattaaaccaataactcctgacaccttgctctactcactgaaaagaagataaaaggcaatatatatttctattatgactctctctagctcaagagcagatctgtttattgttggtgaaaggatagttctgtctgcacaggtcttggcagacttgttttgtttctgtcagaatgtattctgctaactctgtgggaagcagagaagcaaatggctttttcttcataggaatggctggtcctgtagttctttttaaggccaaattttcactgaccttgagatgatttaatgttacacggggattcgggaaccaagctgtagtaattattggttttttggctttccctcctgtagcacatacataaatgggaataaactgggtgagttcctgaactctttccgcaaattaagaaagtcagaactttggaagaaaagtagggtacaagatacaaaatcttgctagtgattataactctaaacgttatagaacctatggccattttagaggagatgaacaactgggaatgccttctccaatagcctctctctggcatgtgtttctttaagtccagtaattatcgaactacatctacatgcttttccttttacttccaccaagtctacaaaaatgagttataaacctgttgagactctttggttttaagggtaagtacatcctcttggaggaaagccaatagcctacaagaattgattagactgcgatgagggattttaaaagccctggattttttggaagactaactagaggaaataactttctgccaagggttttggaaatcttttttgttcttgaccactagtcatcagaactctgccctgtgctccattaaaaacttaaaagcctcatcttcaagcctagtctggtcttaaacacattctgttgatcacatcaaacctatgttaggactggggacccaacaactattggattctattcaaagtttaggacaattcccagactctagagactgcaggtaaggaaggtcagtcccagaagcattaatatgcctatgtgaccccactacttttcttagatgaggaggattcataaagttctgatctctgggagatacttcagaagtgagtggggaaaaaaaggtagggaagactggatttcatattcaccgggcccattattcacttttttatctatatgtgaaatcatacatagaacattttccaaatgataccactgttctgtcctcttttgctaaatttaataacattgtcaaagcaaagttttcctaaaatgagactcctctaggagaaagaaaataagcatgtcagtccaccagtataaaaacctgtctgttcaaaaatcctctagttctttcttaaagcataagcaaagaaaacatcctttcaagagttctttcctggtcaacctgaggtagtgttgatttcagatcaaaggaaaactgtaaggtgctttcagtgctgcttttaaccgtgtgtgaatgtgaacaagtagtttttgagttggtatgtctgtctagtgttatagcctcttagaagtaattggtgctttgatctttctgattccattttgttacaggtaagagtgtagaactatctgtgaataacctggctgatgttaatttactcatagcaatcatgcccaagcatcaggtcttgatcctacattgagaaggatagctctaggtactctattgaattttaaaaaatttaagatgtgcattgagaaagcaggtgtgtgagtgataattctcaagtaaaggcctggcacttcataggtgctcagtaaatatttactgaatacatctgaaaacaagacaggctttattacctactttagagtcatttcacaatggaaggtagcatagcttgaggaaagtgtttcctccacagtgatcagggtgctttggccaaatttgttgtatttttcagtagtaaggctatagcatagtgattcagtgcatgcacttggagctagattagctgggtttaaaactttgttcatcctcatattagcttacatgaccccagacaagtcatgtaagttctagttaactatttatatgaaacaaattttcccataacttggtggtttaaaacaattatgtcattagatttcaaaattctgtgagacagaaatttgggcacagttcagcaaggcaattcttctgtgccatctagagagatgattgtgttcactcagtggctgactttgcctggagggtctggctttatttacataccttgtgctttgctgggttaactgggaagatgggactcagcagggcccttttccctctctatgtattctctgggattctccttgtggtttctccagcaaagcagatgggctgtgtttatagaggctcagggcttccagagagagtacttccaggggcaggaagtagagggtgccagttttatatagcctgggctgggtaactggcagtgtcacttgtacaatatgctattagtctaaacagtcacagagctttcccagtttcagaggaggagacataaatatcacttctcaataggaggaggagtagcaataatttgcaaccaacctaagtctaccacattactaaggctaccatattataaagtagggagggtggtgtacttctagtggctatgttatatgattgtcataaggataactgagttgatataagtaaaatgcttaaaataagtgtaccattcaaagtaagactgcatgcgttttaaccattattattatattctgtttcccacaattggtgtattaaatcaagatcctctcaggcaaatatctgcctcagaaaatggggctgtgactaccgacagtagtggctatagtttagagtaagggctaggaagtttgggggaaatagagatttgaaggtggatccaagcagaatttaggggctgaaattagtcctggcaaatcaaaatttctatgatctcaggaacagacttctctgacacctcactacccatctttaaagttctgttttattttaaaccaacttagagttctatgagtctttgaaaatatgttctgtctatccacatgtcttttagggttgcaaagaagacaaatccagattccttaccatcgtggaatttacaatctaaatagggcaagagggtttgacatgagctatccatatgaagtagtgactcatgaatggctctttgtgctggggatggcaagtgttgcatggtgtggcttgactggatctcatgcactcattctactaggccttgttgtaaaaagagcacaattggacaggtggtgagaggaacatattcctggttggtcaaatgtcagccagaagctaagttgttaaaagcagagattataatctctgggagagatagccaagtccaagtagaacagagaatgcataagagggagtttgtgagtagcaaggggtccagaatcaaaatcttggcctgaaactttgccaagtgggagagggcccagaggggtaaactgaattgggttccctgtgtaccttactaccaggaatgccccaataattgcacaaacacttcctctacaactgactccaatattggtgggtaattattatggtgctgataggtcagcttctaaaatagaaaagttcaactcagtctacactcaaattcgttggtcttccttcaggatagaaggaaaaagtgagaaacaagtcttttaccttatgtctccatcctgagttatcagcagaaaaaaaaaaaagctcagtgtgttctgtgcaaatcaccatttggaatcatttataaactatttgcaggatactgatcatgacatactttttctgtgttgggcattggtaaagtcaccttgacattggcaactgctgcctgaaaattgccagaaaatcacaatgctcagcatggattggaactatccttataactagtcaaaatgaaagacttaagaggtttgtgagatttcattctcaagcttcacaaacttggtggttgaatgtgaaccacttttgcaaattccagaaggaagccacaatttctcatgttttgtaaaaattcttataggcaaagtactcttagcttttcagtgtcagactggagacagtaagaagcatgcttcagccttgatactgatgattacaaaacaaagaaaaaactttggattaaaatgttcatcctgcgcaacgtctgttctgggtagagtctcagtgtgttgaagagcgtgggcttttgcgtcagagtttctgagttggactccaggtttttccagttgcttagctgtatgtataagtctgttctcacactgctataaaaaactacccgagactaagtaatttataaagaaaagaggtttaattgactcacagttccgtatgcctggagaggcctcaggaaacttacaatcatgatggccggagagagaaaggagagtggggaaactgcccccctgatcccccctcccaccaggtccctccctctacatgtgcggattataatttgagatgagatttgcctagggacacagagccaaaccatattgctgtatatctctgggcaggtgattagcctctctaagcctcagttttactgtctgtaaaagtggccttacagtacctttcccgtaggctccttgtaaatagtaaagtgcaatcatgtgtgaaaagcaccccataacttttcagtaaaaattttcacataaggaaaccacttcaacctaagggactctcccagaactcacagatctccctagagcttagccttcctgtggggctggataagcccaggaacaattttgtttatactcatacaaactcacaagggcctggattgtgagttcttctaagggccccagattgaatcagagccccaagctcatcaatcaggagagattgctacggcaggctctttcatattctggagtgggaattggctttgctgaacagttacaacacatagactattctattaggttgaagtgtatgaaaccactatttttgtagatcaaaatggttaaatattagcaatatcacatggttctacgatgacacacagatttacagcatgttgttatcaatggcacttcgaggcccagactagaacctcagatattctccaggtcttcaaataatcaaactgccttgcactgggagacaagatagatccaccttatccccaaatactgtgctatagcaggatgtagatcacactgtatcaaaactggttatatttacccaaagaattatcccctctgggtccttccaccttttccctgctgccaccagcttgagagaaatgagataaggaatctacacagttttcatctccttgcttttaccactagacaacagagcctccgggggaagtttatttttaggatcagggctcaactaatattgattaacagccttacataatgtgaggctccagggtttgttcttttcctgccaagcctcataactggagaaggcgctgaagatttgtcagtctaatcagactttagctgccagccaagaaatatcttctgtcttctccttacccttacgcaggtactttctttttccctcttagagaataatttggggggagagaaattgcactctaatttacttgttgcctggtaagattctctggtgacatttactctctggaactgcacagttctaacaacaacagaaaagggagcttgatgggtttaccttcctcttaaagacttagatgttggcagtacaaataggcaagtgaaaagagtgcagtgtagtttgttttcatccttcctttaatacgtaattttggtggatggaacaggtgctttccaaaactaggtctagtcgatgaaagggtcctgagggcagacgaagtgtgaaagctcccaggagaattcatagagatgcccttccaattaggatgtaatatttacaggatggaatttccaccagaactactaataaagtgctggctcttatttctaggcatctgaacagctgggagggaagtggggtcagttcttggctacccacgggtggaggtccctgagtgtttttaaacctcagggtggtttttctaattacctaacagactctttagccgaatctaaagccaaaatccttgctgcgtggcatatggttctcctccttcctattgctctgaccatattttccaccacgttgctccaatcacacaggtcttcttgatccttcttgaacacagagcaagaagaagggtgaaaccggtgaggcaggattatgcaattgcaagcttagattttcatcttaaaattgatatttgactttttgcttttgcagatttttttcctgcattaatattgattttaaaatatttcagcaaatgaaaacaaagttttagcaaacccccgttaaatcttacaccttaagcgagtgtctcattcaatcttctcagccctgcctgaatgtgccaagcgtgcctgtgccttttcacctgccatttcctctgcctgcagcagcccttccctgctattcacagtactcactccctcacttcacccaggtttccgcttatattgcaccttccagaaaggaccttcttgaccgtctgtaaaatacaacactctatcgccttttcctgttttgttacctctcatagcacttatcactgcctgacattatagctcacatttatttgtttattgtccctatttagtagattgtgagttctaggatggcaagatctttattttaggcactaaaatagcacagtgcctagaacagtagcgagcacagagtaatacgcagtcaatgttggttgaaaggtataaatagtcaaccatccaccagtaccttctcagggagtccacaggccacacaatatttacaggctgaatccaagcccctgtttcccaggacccactccctcatgaggctcaccagtgagggtgggcaccactgggtttgctgctcttggatctttgctctaggaataaggagtcccagagatatctccttgtctctggtatgtaagattatttttgttagcttccagtcttgttgctcagccaaaagcaagggctaattctagcacgtatagttttcaaatcacttttggaaatgtaatatcacccacctttccctttccagtttcttcttcttcctttccaaataacttaatccttaattctcctaaaacccactttcaaatatatgcaaataaaaattacttggtaaggatggaaaattaacttgaggcttttttacttttttttttttttttttttggtctgttgagaaaagggcttgtagggtggtgcctgcataaactggccataaaaatatgggacaataagttgttgaaagccacaagaggcctctgaggaggaaagcctcctaaatgccatcatgttcccaggctcagagcgagatctgctctcttatctgtaaacactgtgttcaaaggagaaagactctgctttgaagcattgaaatgtggccagatatgctggctcctagtgaggcccactccccccagctgctctccgataaattaaagaataaatcagtagttaattttatgctgcttcagcacaaagaaaatttacctaaactgccattgctatagattaggtgtatgacacaccgcccccctttcaccgtttcacccctgaacatctgcttcttagagctaagtgattgtactcaacaaatagtgtggagaccagagcttggcgcctttgcagcctccattttacacttggccccctggcactccactctttatgcactcttaacctgtctattctcattcgtttgtcgccaccggacttcgggtaccctacgggtggtgctgaggctggtccccaacattggtctaatggctgagtatattgtgtgagcaccatttattcatgtctgaaaccctataatttgactagccccatatttacccatttttagtgataatttgaaaaaacattgatgattgagagaaggaacaatagctatgttgctcatcattggacatttagagcctagaatggtgcctgccacaaagcagggctcaaaaatatcagttgaagaaaaataaatgtgttaaacgaatgaaagtaagttaagcaaatgcttatcatcagagtgaagaggcagtgggggccaatataatttatttacaaagtaggcaaagggagttaggaggaagcagcctggtacggaggaaagtgcattgaagcaggcatcaggagacttagctcatgactggagaagttcttaaaaccatgactctaggcagaccttcatttctagctgtagaattttggccagggtcctttgtggagctatgtttttttattatctgaaatatggggatgatttccaacttcaagggtaggttaagataatataagtcaagggcttaaatgggtgcggctcaaagattattattgctgctgtcttaaatgggattataatctggtctcagctgataaaccagtattgcaactatattttcttttttattctgttgctagtttgtggtctctgatatggcaattagcttccttgggcctatgctctttcctcagaaaagaaagttttattttaacattatctagcatagtgtcttgggcacacacacacagggacagttaaatgtaggaaacaatgaattagaagaagtaaaagaaaggagaagaagtaaaagaaaggaaaaattgagaaggagagaaagacagcagcgatgctctgtaattattgctataagaattacgtgcccatttcatggatttgtatggcttaggttgagagagatgaataaaatatctttgatataattaaaatcataatataaataatattttttctatatctcccctctttgctgaaagctgttgggtgagacatcacaatgaccacttctatgtaaaaggtagattatagatggccctctgcatatgtgggattgcatctgcattcaaccaactaactgtgaatcaaaaatatttttaaaaaattgtgtctgtactgaacatgtacagacttttttcttactattattccctaaacaatacagtataacaactatttacctagcacttacattgtactagacattgtaagtaacctagagatgatttaaaatgcacaggaagatgtgtataggttacatgcaaatactatgccattttatattgaggacttgaggattttgccatccatgggaggtcctggaaccaatcaatcccccacagatgctgaggaatgactgtacttgataaatgtctcttgaatcatccaaaaaaaagaaaaagccaatggtttcaatttaaactgaggtaagaattgttttttttttttctgaaaatatatgatgttctatttatatataataggaaaacgacttcaagcagcaatcgtcacttgccaggcatcaaggcggatatttccattatgtctatgacaaggtggtgggaggggtgggatgtggtttcatacctttctggtgcatgtttgaatgattgtaaaaattagaaacacactgaggctgttatgacagccttgccttttgaaaccttctaattaatgccttgggttgtctagagagcttgttctgttagctaaatggtgatttgtaaggttctccttgatttcctcatcattcatggatgaaataattggggaaataaaatgattggggaaataaatgcacaccacgtctgtggtggctagcagtcactgagagaattacttgatgggaatttgattgacttgtgtgtataatgcaacctcttatatctctggccccatcttattatgtgtgtgtgtgtgtgagagagagagagagagacagggagagagggaggatgctcgtgtttgcttgcactatggagaacagtgcttcttaaactttaatgtgtgtatacagatcacctgggtaatcttattaagcacagattttaatgcacgtccggggtggtatctcagatcgtgcacttctaacaagctcccagatgatctcatgctgcagatatgtgtacctcactatagagtatagagcaaggctctaggaaatatttacggttccttgctgagtaatcatggtatctgtttacctatctcttccaaatggtcttcccaaacttagctcagttctcttcaagacaggaaattttgttaacccaaagtattaatgtaagtgaaagggtggataccccaactaaggattagaagagaaaactgtatcccatcagacaatgctgctccgggtttcagatgccccttcttcctgtcccttactttactgcatacccccaaggcagatggaaaaaaacataggtaaaatttaacttgtcataatatttatccccctttctgagaggtgacctccaatggaagcagaaggatgtgaatgattttaatccacggtaacaatggggagccagtcctgaccatcttaagcagtataaatgtataaaatgacagatttttctgctctgcctctccactttctcctcccggatactgagagagacacatattcatgcacccacaactcacactataatgcacaatgaaatttcacccagcctttatctcggggctgctgttctcatgattaatgccctactggctgggaagctattccactgaagacagacaaggagagaggaagatgcatgaaatatatctctgaggccatttctcattattattattatcattattagttccttactaccctatctatctatcctgttagaggatgcttgatctattggcaagggggaggggatgacatttgaaagcaggttttatgagggagaaatgaacaaggacaaagagagaaatagacagtttttatgaaagagaattaacctggatggggtttttgttatgattgttgtcctttatttgggggtttgtttgttttattgttgctgttgttttccatttaaagtcaaaaataatagatgcctccatctgcggcttctgatttttttccctagggatttatttttgcatgtgttcttttgtctttattgagtctctgtctgctagaatcaatatgatataacttatgcaaattatatccctgaccacttatgcaaaaaacagaataatttcgttgctctgtaacactcttaatataattacctccatatcctggttgatttcaagcttttgaaagggctactttaaaaaaaaataataaaaatctatttatgtgttgtataaaccacagtgtctgattctctcctgtttctcattcaaagaaagggtgactgctaaatgatttctggctctgtcatttaagaagactgcacagcagtggtcttagttgggaagttgggaccacaataagagtgctattgtaacacgtgtctactgataaaatggcaaattcattagcctagacaaggagtactatgatctggtttcaaaaatgctgtatacttccacagtccagtttatgagggcatgagatatataactgaggtgcccccatgttacttcaattttagtttgactttgaatttcattaaaaaatatttgagttatttgagtgcctagtatgggctaagtactgtcctgggcacttgaacaacatcagtaaacagacaaaaaccctcttttcttatggagaacattttctattccacaaacattgggtgtctcataagtgcaagactttggagaaataaagaatgaaatagaaatttttctgctttagaggaacacacagtctggtactgttcttaaatattttcagactacaagcggactcacttgcagcccagttttttacaaaaactttagcatgctgattggctagtacagttgcaaaggcagcagccatctatatttacagaggtctattccaagaatagggtctttaatttctattcaaaaaagaccaaatttcaaatgtaaacaatatatgttttgactaaaaaagacagaaaccgtaaagcaagttacaataaagtgattgaaacatatttcggtcctggagactaaatttgcaatgtttatggcaaatatcttcttgtgttggtttgagattatagttttatggaatgtttatattggaagaatctcagagattgagccccacacaaccagatgagcttcagagatgggccattctggtttcaagtactagtttcattgctcaaagctctacgtccaggggcaaattgctcaaccactttataaaaaatgtaaacaacaggtaatttcacattttaatttatttttatctaaacaatatattcacatagtttatttttagtgtatatatgtatatatatttatttcttatttatttcttatttatatatttatttatagagatgaggtcttactttatttcccaggttggtctcaaactcctgggctcaagtgatcctcctgcgttggagtgctgggattagaggtgtgagccactgtggttggcctaagtaatacagccacacaatttaaaaccttgaactgtgcctagatatcccctttggggaaaaggcatcaccttagttgctagagtgctggctgatggctgttggctaaatccttcacgaagaactgcctttgactattgaagccaccttgcccaaccaaggtcaagccccttcctgaagggtggcccatatccaattaatgatggtgaagggtggcccatatccaattaatgatggatgatggagctggggggatctatcaagactcagcccattgtctcaagactggataactgggaagggccttttagctagagagtttcctaaggccagctgaggtctctattgcatgaatgttcacctcccccttctgcccagactctgatgtcactctccccaaacttcccaaacacgataccgggcctcagactttgttttctgaaaacgcagctgaagatagatagatagcatcgtgagacttaaaataagaaaacaacaataacaaaagaaaaacagtagtatctttctaaccttgccctaaagtcctgctctatactggtaacccttttatatccttttcagacatttcccttcatagttctagcaatatgcttgcatttctatttcttgactttttcagtttgacatattaactaatgacttctgcttctggaagtaaaagttgagctttctcatgctctccctgccctacaacccacacacacttttttaccttccagtttcccagtaaaattctatcgcatttcgattaaataaatgttcagagtttgttattatgactttgtaatatcgcctattgaaaacaatgtaagatcatacatgaactgacttgttccacaactattcaccagctgcatagaatgtgccagacactgttctagagactgaggatacagcagtgaaaaacaacagactatatttctacctctgacaaaacattatactgttatgacaatttctgttttcctgtaactctttgtttgttaatgaataccctcgttatctcgttagcttatttttctagccacccatcagtgccacagccaacagctacaaaagacctcacaagataaaccgacaggactccattatttctttttctgtcttggaggtctcccttctggagtcgtctgacctcctgctttagtctgggctgggcgctcgctgagcctgcctcacagctatcatcctgcgtcttccttgctcgtcatgctggaaaatccctgggccctgctcctgtattaaatcctagtttcagctctatttatttcctcattttcaaggtgcacattgtcctgtagcctcctgagaaaggatagctaaaaagtaaaatcattgagacattgctcatctgaagaatgttttattccattctcacccttgacgataatttgcctgggaaggacttgtatcttggaaattatcttcactaataaatttaaaagcatccgtccaatgtttttgggcatccaatgttgcagctgttgacatcacagtttggtgtctaattccttgactgcactgatttttacttttttttttttttttttttttttttaccctctctctgaaatatccttatcagtggacctcaaagtagcacttacaactcaggtctcttgaaccacatgctgctgccccctatagttcttgcttttgtaaagttgtggttatttgccgattagctgccctgtgttggcatcctgactttggtatgatttgatgagctaagctattactaaactataacacacacacatacacacaaaaaatgaatagctataattaattagcataaagttttgagggtaaccaactttagtagagatctgagatatatataatgtatatatatatatatatatttgaacattttgccttgggttagagagggaattggtggtacagtaattcttactggaattgtgtagtgatagctagtttatatatacatatatatatacatacatatacatatacatatgtatgtatatataaactagctatcactacacaattccactaagaattactgtaccaccaattccctctctaacccaaggcaaaatgttcaactcttttttgtattcccttaagagcccttattttttttttcagtttcaccaatcatgttcatttcttagccacctcagaaagaatgagaattaaataatatgtataaaccctttgaattttttacatccagaaatgagcataagctcattcctctgcttcacaccagatgcttatatttttgagaggagcaaggattagaattgtcactctggaatttttatgctacaaaatgtcaatcaatatgtttgcatgtcactgggttccatcctacagtgtttggtgataaagtcttttcatttggctcccagctttatcaccataatatatttatttactttaccttacatgtgctagttggtagaagctgtagaaaaagaattactcccacatatttctttcccctaaagagaaacaatatattgtaagaacacagatggggctccacacaaaaagaatgccgaattaatgttggatggatgtacatatacaagaacttgctatcagtacacaattccaataggaattatatatacacacactgaaaatagaatttgattaaataattacactaggtacaagctacattttacttccattgaaggagagctaagtggaaactagtgtgagacaatcatgaatagaaaagtgcagaaggaatttgatgaggatgttcccagggctatttctagccagaaaacgaagctggaggctttgaagtaaatcaaaatatttgaagaagtaagaggataaatagcaaaactcacttccaacatcatactaaaagcaccatgcaaccatatagaaaacatgcataatttattttgactcaaataactatagggagattcttgttttttttaattaggagatttgaggtaactgtctagactacctatttttatgttgcattcagcaatatgtctgctaataattagagggaaataaattacataaaacaatgccagtcatgtcattgataaaaaggaaattaaagtgtgattgtgtttctctttctctctctccctcattttcagtgagctacatcctcttgttgtcctcctcacctgattaggcatttttgtaagggagtttgcctccgtcctctgttgtaaacattttccttacctcagcatcctttttaaattcaaaagacactttcctttgcaatgcactatgaaaggcgattgtgttagagaatatcagagatggctttgtcatgtctggtgctcttaaatccttttcttttttttcttttcttttcttgagacggtgtctcactccgtcacccaggctggagggcagtggcgtgatcggggctcactgcaacctctgcctcccaggttcacgccattctcctgcctcagcctcctgagtagctgggactacaggtgcccaccaccgcacctggccaattttttgtatttttagtagagatggggtttcaccgtgttagccaggatggtctcgatctcctgacctcgtgatccacccacctcagcctcccaaagagctgggattacaggcgtgagccactgtgcccagcctcttaaatcctgttgtgtcctaaagagtccactaaacgaggttgagggtatgatttgacaattgaacaaggcctcagccagctctcctagactgccccaaaactccctgagcagagagacccaggtggtgatggaagtatttttcctctaaaagactgtggagattctggcaaacctatattttgggtttagctttcaaggaagaggtggcatttgaaaagccaggggcctttgtagccattttattcactacctaatgtgaaggtggtggcagggaatggaaaagggaagattatttagtcgataaacacttaatggccactgcctgctgtgtggacagatctggatagagttaaaaagataataaagcaagtgtaggatgcctgtcttcatggtacttatatcatgggaagaaggcatgaacaaaccaattttacacataattattcaatcacaatcatgacacagtgtgataaaggaggacaggcttctaagacagcagaaaaggacctgaggtagtgttgtcatctggggaagctttcttgtagaagcagtatagaagctgtcctgtgcaggatgagatattagattgcaaaagaggacaagggccagtgttcccgccaaaggaaatagcctatgctgaggccctgctgtagggatcatactgtatcgcgttcctctggctttggactacgcattgatgctaaagtctggaagcataccatattcgaccaagtaaagtgaccagttaaggtccccacttaatgggctaaagataggtcattccaagagtgagcctcccattattatgactcatgacaaaggggtgtgggactggttggaaaagagtttccaaagctggactgcatcacatggtcatgtggaatgggctgcctgctctcccagtctgaaccctacctctgtgctatgccaaaggtgcagatccccttagtgaaaattggagacatgaatcatttaaggcaatgcctcacagacccatgtgcaaggttccatggaatgtgttaatatatcacactcatctcaattttgcacggtacatgaaactatgcttgctgatgagggaccatacacattgaacagatcatataatggttatggatgtaatgtcaataatgtcatggaacctatcatatgttgtaatatcaagaaaccttttagcatgtacatttgtctaggtttctggactttacagccttctggtatttcacttgcttgtgtctttcattgaacactaataaccagaaatcagcaacgtgaaaatttgattcttcttcctatttttctcatgccttactttggtctttctttctgcttggtggaaactgcggagttcagtggaagttttcctgcagtctaattagcccctctgtttaattttgtaataaaaacgctgaaccagaagctggagataatgtgcccaattcaattcacagatgtcaatttctttttaattgtaatccttttcttgagttcttcccactcttacttccctggcacagctgaggcttgggtgattacaaaactttcatgcctacgctggagattatgcctcctgctttaggattaaattcattcgttatcattgttgtaattattagtagtaacaatgggcatttccacccaaacctgatgaatagtagttttcacagtctttgcctccaaacttagcttatttcagttctttgcccagataagttcttcactctttaatggcagggagcattccgttttctgttgcatttaaatgctattttgagatcattcagaagacaaggctctttttcctttttagcaggttctcctgggtgtggagagatggcttctttccccagagtaggagtcaccacttagtgaatgctaatggggtcttttcttcgtgatgcgactgctgctttgaagatgcatttgaactggcaaggggcacctcttagctgcaatctcttccttagaagggtgccagctccaggccctaaaaagcacacatagctttgacttccatgctgactccaaaagaaccttttctctgcctttttgatggagtagtccctaccactaacagaacagcagtgtggcccaaccaacttgaaaatggaactggctcctcagcaacatgctaattctttcaaacttccttgtcagactcaaacctcgatgtgtcttttgttcttaaactgcatttgtagtaagatcttcaggaaaagcaatcagtgagagactgggtcaggcttttatttaattactttgcactttttttccccctctgaaccttctccaaatcaaaagaaagcaatgcagtttaattctgaatatatgaaatgtttgcactttaaattataaatgtctctcaacgataacaccttctgaaaataatgctccgtgggctctttagaagaatatttaggacagttcatctcaggtttaaggtgcccaagctactatagtgccctttcttatcttggttttatgtttttccactatggcttactgatataatttcctaatccttcttatctcaaatgtctcttagaccgttaaacctttgcctataaaatgaaggggtttgactttgaatctaaaggagtggaccatccctcaagcaccctagtctctcagcgcattcattccacaaacatttttttgggagagcagggtgattcctgctatggacccatcacccttgtagactctgaggctgcaatgaaaatacaataaaatcagtaattctagttcttatggaacatacattctgggagtgggggcagagactaccgataaataaattagcaagagaatataatatgcagggacaagtgctatcaagaaaataaacctgcgcaatgtcacacagaatgcctgatgggtgggtaggtagtttaggggaagttactctaaggaagaaacatttaacctgagattggaatgataaaacatgtcaggtctgtgaagtctgggggaagaacatttacagcagagggaacggttagtgtaaaggcctttaggctggaacatgttgagcagtgtttgaaagatgatgaatatggctgtagcagaagaaatctggtgtgaggtaagatctgagaagtggcagggactgaaacagacagggcctgtttggctgtggaaagcagtttaggttttataaaagtgcaatggcaaactattagaacgtactaagtaaaggagtgacatgatgtgacttatgttttttaaagattactctgccatgttgagaaaatattgtaaagcagcaagagaggaggcagagagacctaatacatggctattgctttaattctgatgaagtttgattgtggtttgaactagtatagcagccaggcccccactacaggcccacccagcttgatggcctcaccctgcatcttgtcctgtctctgaactgctaaatctcaaaactttaaagccctaatatcttgctgattaaccataatttccaaatcttatgcttaagtccaggcagtttttaatttttttttattttttggcttcagcaaatttttcatttgtctatatctataaagtacttctcatcatcaacccagattcctttttctctctgttgtgttcattctagatcattccaaatggtctctgttccttctgccttcaacctggtcttagaagacttctctgttttttatctctcccccattccacctccaactcttgatcagcacctatttcaaactctcaacttggtctcctttttcactttttacacacttggattttaaatgttaccttcttttagaaaacaatgctgaccagtcatgagtttctttgaattcctccatgcttatccacatcagtccttactttaggggaatcccttcgtccctttgtttgaaatcttatgctaattatctcttcactcgggtctcttcccaaggtttggacatcatttagtgttctcattttccactggtgccattaatatcatcccgtcatcatagacatatatgtgtgtgtgtgtgtgtgtgtgtgtacatatatatgtatgtatgtgtatatgtatgtgtatgtatacacgcgtgtgtatatatatgtatatatacacatatatgtgtattgtgtgtatgtgtatatatatgtgtgtgtatatatatgtgtgtatatatatatatatatacctttcccatttcaaaaacaaaatcaaaacaaaaaaggcaattatctatgaacctgatttctgtcccttctattagcacttactgtccccagatgaggacactctttcacttccccatatgctcaaatatcctgaattttatactctcactgattttactttctaaacaaggaatatatacgtattgtagaaaaaaatcactgtgaagtaaattccacccgtgatccaaccctccagagaaaatcgtgcataaaaggtcccgcagattcccacctgtctttctttccttccttatctaccaatattttttcacatgcatgcaacattctagtcataccttgttatactttcagacatgttctttctacttgagcacatacaacatacaacttgagcatgcttgtttatctataaaatgaagataatatgatcatttctgtaggagttttgagtcaaaaataaatttatgtatttcaaatgcttagaatagtgtctgttgcatagtgacctttcaataaaaattattattattattgctcttttgtccactttatctacctggaaaagtaataatccctcaagactaagttgaaatataacatccctggggagtgtattagtctgttctcacactgctaataaagacatacctgagactgggtaatttataaaggaaagaggtttaatagactcagagttccacatggctagggaggcctcacaatcatggtggaaggcaaaggggaagaaagacacgttttacatgtcagcaggcaagagtgtgtgtgcaggcgagctcccatttataaaaccatcagatctcttgagacttattcactactgtaagaacaatatgggggaaactgtccccatgattcagttatctcctccttaataatccccttgatgcatggggattattacaattccaggtgagatttgggcggggacacaaccaaaccatatcagggagttatccttctcctctgccatcctgtttcactctgccaggctccttttctcagtgcctccacaagtggtttacttgttgtgatgaacactatgcacagcagagagtttaaggaccttagtcatgtttcctaccaatcagcggttggcttcctattaaacctttctcgatgttctggacctctagagagccattctgtgctgctatgcaatctataatgactcttcaactaggtttctattcatttccaagtcttccctaccactgagatacttcaaggagatatgagtggatcatgaataaatatcctaaaactaaagacagttaagtcaattgcactctcaatattatcagactattttaactaatatgctatagacaaataattcttcagaatggtgtttgctttgtgtgtgtcataagagattcttgtctttagagaattagggaataatattaaaatgaataaatagtaaaggtgggaatatttttaatattattaaaataaataaatgattaaagtagggagcatgtttgaaggtccattttaaaaaatatatgtagacagaggaaacctaagagttaaaatactgagtgagttttgctctgcatcagtggaggctataaaatgcagtatttatctgtatatgagttctataccaatgtgatctatctctctaattagatagtcaactatttttaaagagctgcaaataagccttacaagaatgtcataaatgcattccatttagaaacatcttgcagataaattgtatttttattcttcctgcagcctcctgtagccttaaaagaataacaaaaaataaattcttactacctaattccagacacagatcattactaccagtagtatgttaatcatgcttgccattccttctccttcgatatcattatgctttaggatagaaaaggtgggtggtatgtgagcctccttggataaacaaaacgttggagtgcacaggcttctcaagaggtacaatgttattttcatgcaaaaaaatcccaagtattacaaaggggcttgaaaatgttgaaaacacattgtgaataagtagaattactaacaagagcactgtatcttttgcttcgataggctctttcaagatgtagacaaattggaggtaggccagacagaatctacgggaatgattaggggaattgaaggaatgacttcggaaaaaagattaaaagagctaaatacgtataggttggctaagtgccaactcagagaaaatgacattatgggctatagatatttgaaagtggctggctataagcaaagcaagggattacttaggtaattggattaaatcaagggggtaaacattttaaactcaatatctggatttattttgttgactataagaattattagattttagaactatcccataacctactgcttggattaaagcaagaggtagggtgtggtagcatgaagtctctaatagtttacccagttctgagcatcttgttgccaggaagcagatcttactcacttttaatccctaggatttagcacattaaaagaactccatagagagctaagtcatgtttagttcagcgagaagaaaatggtctgtggagtcagacattacagattttatatctctgctgttttattgttctataacagtcagcaagttacttaacctaagccttatccataaggtgcgtattaatatcaactttataggattgatgtgaagtttacatgagttgtcttgatctcttcttttacctatttaacagcggttaaatacacccctcctctccatcatcactgccattgtgttccttctgactttagtaatgtcttcaatggtttcctggattccaattttgcctatcttcaagtttccacaatatagtcaggaataactttttgcagcgcatgtatgagtaagcaagccctagcttaaaaactccaatggatcccattgcctgcaggataaaatcgaatatccttaggatgacaaacttcatgccatcatgcctgtctttctaattccaactcatattaccctacccttctcacataatgctctaactacattcacttgcttgagtttttcttttgtaccttgtacaaatgtataaacatgctggttcctctgctgagaacccactttccactccaatttgccatttctttgccactctttgtcttctgccttgcttcacactctttctaaaatgccaatctcagattttacctcttttgagattccaggtgcctctcccatgtgtttccacagtaaatggagcttatcattatcctgctattaattctactgtgttctaagtgtcttttcactctgcctctcctaatagatgttaggattcatttgggcagatacttagattagtgcctaccatttagtaggcattcaacatatttttagattcaaagaatgataaatggtagatggatagatggatggatgggtaggtaaaaagatatatggagtgtaacaaagtacctacaacataagaaattatcaattaatttcagttttctttccttggagttttgagattaagaaatgcacttcgttgtcccgaataagcatagtcttgagtgggctttagtcagagttatttgtgtgcatttatgtcgatactacccactccattctatcatattgggaaaataatgcaatctcgaaggaataggagtctaggaaacctaggatataagtgagcacataccggagaaaaatatgccaacatagtagcttggaggaaatacttggaaatatcttgcctttatagctagatatagaacttcattttttacaactagaagctttgtgacttctgagaccatgactgaagaaaaatggaaatgaagacaaaggggactgaaatgggagtggaagtaggaaaaggggatccatagacacaaaacaaacttttccttttacacactccatttccctctctggtgcttgcccatggcccagctatttaaccttaagacacatggccagcccccttgtctagagtttgccctaattgttgggcgcattgtagcgtcttagatgatcaattgctcatgccaaaagcagagtgttaagattcatgaaattcgagtctgtgctattaataacctgagcagggttttcatgcctccttcccctttgttttctcctttgccaagtctccattctcactcttttgtggatgtgtgtgttatggagacgaatgaaatttcagacacagcaatgaattgccacctaaaaggatacaccccagggtcttctgtgttcctttgcagctgtgtgataaattgccatctccaaaattaattgttaccttttcaggaagtgtttactcattttcatctcctcactggcatcagtgaacctctgagctagaaaaaccaactttcctttcccttctcaagcccttgatatgcagctagaacggcaatcagtggagctgacaagggcgagcagtggtacctccgtgttgttctctagcccatgaattcaatgaacatccaggctatgcctttcatctcaactgccttttaatagactaacccatttctctttacttttggctccacattaaaatgtctataaaattttactccaagctaggtcttccaggtttacggaagaaggaacatacattcagcaaaacagttttctctttttgttagatttctgctgttctcaagagctgaaaaaaagtgtgatacttcacatgtactctttaaaaaacttactaagcctgctcagcttttacacagggtacgccggcacacaagtgtgacctggtccttactccatcctcaaagataagttgtccccacagtctgccaaaaagatgtccctgatgcaatgagaatgagctggagtcctgactgtgctacatttttagtggtatcctaactctctattccacagacatcagaaaatgtcacaacatactctttgtaactagtccctttattatgtccatgaatgtaatatatacaatgattttcaaagagggtgatttttcacccctcttctctccctgccccacatacaaaggagactttgcctatgtctggaaacatttttggttgtcacaattgaaaaggaatgtatggaggtgttgctgttatccagtgagcagaggccacagatgctgctatacattttataatgcacatgaactctggaatatataaatcaagtaaatctcagtattctgccatgtactctgggagatacttaaaattataagccatgacttctattttccaagcattttggagaaaaacaaccaattttgtttttgatttctgactatatggtagagttcagctacacagtatatggtactttaacaaagctatacggtagctgcaagacaacaccatggctgggcccttcagagcctcataagtgtattggggacactgagaatctagtaatagactaacacatatgtaccaccattgagtggcatcaaacatgctttcatttagtgctgaaattgatgatataatggaggctagaaagatctaataatgaaaaaaagaggaatttaaccagtcttgaggtgatcaaatgaggaagcagaaaggtaggattgattgtaatgtgtgcacagaggagtgaagcctgattacctgtactactcattgccagaccttcaagaatcgcgtgccaagtgccaggtgcagaagttgcaaaactgtttgggagatcaaagagaaaatatcaacctggctttcaagtcttttcagggtgctttcttagaaaaactgtttttggtcttgaaacatgggcaaacattggctgcgggccaagaaatttatagttcctgaggaactttagattgatacatgtctgacaatttccattttgcaaaacaagagaaggcaaaagtgggcttggaaggcattcaatctttgatgttgtctttgcttcagctgagcagaagtgagaatttagacacactgagccattaccagagtttaagaaaacttaccatcagtgtggtttccccctttctctcagtcaagcacatgggtgtgtgtcattgtaaaaggactataggattggaagtggacacgtgaattccatttcttactctccactaactacctgagtgacattaggcaaacttgcaaatgtggaagttgggccgggctaggttatgttccgctctaaccttaaacactgatttccccattgactttcttgttccattcaaagagattaggaggaaaaaaaagtggtatatcccaggcacgttttgtgatatttcagtgaaatattgaaataagcaatgtcagcagcctcatgttctcgctaatggtctggtatactttatgaataaacaacactagctttatattactggatctcatttccagcagatttataaaattgtaactctacagtgttttctgacagagcttctggaaggggaaaaatgacagtgcagttgtttgctaacatctgggtgtactttttgcaacatggggagaattgttccaaggcagggagctaatctgattcatatctctacctagaagcacttaaagaagctgtcagatgattcccacagtgacaaatttgagtcccaaggagatgatggagtgaaatcagacacattttgggaagaaattcctactatcttttcaaaggataaactcccacagtatttgtgccaatctcttttacagcattcctatctcaaaaaccagagacttaggctaattttttttgtttctgttattctctaatatatttgtttaaaaaggaagttttaatgaaaagtcagtcatgtgacttagagaattaaatgtagggctctagcaaggatttgctttaaaatgtttctctccgatttagttgctgcacctgggtaataactaccttggaagtattagtgttgtttctctgtcataaaattgacatgcttggtgtggataagaatatttgattgtagaactgcttctacctaactgcattctgttatactaacaatttggctagcagaatttttttttaaaatcctccatttgcagctttttgtactctgatcacaatatattaaatcccccagaagaactactaccttgaatacaaagcacatagcggtgctcttttaattgatttgtaaaggttagttgctcagtactagtggaaagtttcatgattacttaattgaattacctgcttcccccagtagagtgcttactgggcaccatacagtaagctgagagttttacatgcctggtactattatttccccagtttacagattaggaaagcaagatgtagcttacaaaatatgctgaaagaccactggcataaaagccttttaattccttgctgaaaaactccctgggttttgaaatatgataaactacatttttgttgttctctgaagattcaggttcatatagtatgacagttttatttttgtgactctcaatcatatatgagataaatgatgggggaaagagaccgctttgaggtcaagcagacctatgtccaattctaacatcaaggagaagccacgtgctttggcaaagtttgtgtatttacactgttgggaaaactaaaagtaatttatataaagtacctagcatagtatctggcagggtaggtgttcagtaaatgttgctggtattatttttgctagtgataacattattcagccatataaacacatagcactaaggttaagcaaaatatgtattgacattacagcatgcctaggtatttattgcctaaaatatatttccgataagcttttcttagcatttgctgctttctactaagagttgagtgaaactacgatgaccacaatttagtctacttatttaaacctttaattggttggcttccggtaaattgcagtttgaatgactagcccaatcatgtatgagtagccgggaatattcgataggtatagaattcttcctgcctaatcaagtcagggataccgatgttaatttctgaaataaatactttctcctctcaagatctacccagtggttcgttgccccttgggatcacttctacttttcaacaaagagcaagggacagtaattgcaacttcagggtagaaggagagtttgcatgcctggcccagaatgaaataaatgtggaggaacagagcccaaatgacttgtatgtttcaggtacagctccatgtatgctgcagatgatttgggttaaaaaaaaaaattggccagcctaaactttgaggcaaagaaattgcatttcccaatgtctcatttctctttccttttactttacttcatctactgtgaatgacccttatttttttgttgttgctttatggcaataaataaacgaacccccattgtgcaaatattatgctcttctcattggcctggagggaaattgctacgagagaaatcctggacttttttcccctttttagaaggaaataccaggttacgaatggcccttctcagtctctagattgagactaggattcttctgtcacctcctcagagccctggatgcagaaagcaattcatttcacatgtgtgcaaatcagacacagaaattctgcaaggcacctcttggcagtaaaagtggactattaactctcaaattgctggcctctactgagaggcaacttctccctgaagccaggtgggagtgtccctttgaagccttacacaacccgacttctgttgctagggtagagtactttagagcaagagtagtcctgcggtatgttaactgagtaggtgtttcccagaaaattaaaagcaaaagtaactacctggaacagtctgatttttaaagcaaagcaggatctttgtacgtttaaaatttagtccagctacttgatagcctatagagcccccaactccttcttccagcccagggagagtctgcagtgagcaaggtaagaggtagctccagcattttcagcatggggttaggttggaagtcccagttgacagggacagtccttcctgctctcacctgccaaaatctctctcctcccaggagatagctcccttttctccctgattgcttcctctcatgaggagaaggtcattggcgctcaccacttccagggcaaccctttatgcaagcagtgggtgcctttgaaaggcaaaccgcagcaggaagactttgaaggcaagaagagactttttcatctttgcaggccccagccagaacattggttctcagtgcagtacaagcagtttcaaagttatctcccttgctgatatggatgtgataacatggagcggagaggtgccataatgatttcctttcaaatggctgcctcaccatttatctttgcacactgtcaaagactgatattgtcgggagttagcagtggcatggaataattaatctcgtacgggggaagtaagttcttcatttgtctcctgagaaattagcactgcattgacagcaaaagtagatgatatcatcggaaagggaaagggaggtgatctttgtaactccagatgccaaattgtaacattgattcagttctgtgaagttttgattgaacacctactatgtgccaggtgctagagatacagatacagattcctgtgctacagtagatcataatcccttgagggtcacagcttatttcaaaatccttgtcaccttgacaaaatgctcaagaccaccatggtgacatgtgtgccaccatcattattattatctaaagagttttaccaagtgtctgtatcattaatatttattgtaaaggctcaacttttataagaaagaatccttgtctcccacaccaccagtgcaaagtagattaacaaagttggcatttatttattttattttttctttaggggaaaatcaagaagttagtgatctagggctaatggggatattgtgttactcccaatatgtggttcccatatttggattcaagtttttcctattttccaatcagtgggaggagaaaaagaaaagcatgcctgcttatatcctattaaggccacacctgtctgcaaaacaggtgggatccatgtgaaccagaagcaagctattaaggatgcaagaaaatgtagtgactagttggatggccatataccttgcttaaaaccagttagggtcttttatttctgaaagaaagaagggaaactagatatttggggatgataagcaatctccccacagagattctgggtgaaatcctttttgcttctctgaatttccaataactcacctcttaaatgagagaattgaaggaggtgtgctgtgtagtccttttcaatttcaaagtcaaaataacaactctaggctcctcctccttcctcagcttctcccaggcagtaggcacagtgatgggctctgtgctgggaattttgttttgagcctgtttcttttatttggaaacatcaggtgctgaacctatcctggattcgagtgagtgcagggcatggctctaagaagcattttgtggaaagagtcaagcttgtcatcctcctcctttgaggcactaattgggctgactgggccaagcaaaacaatggtatgatccatgtgaaccaaaagcaaattattaggcttggagagtggtgggtagtcagagaagcacttctgttgtagacagaaaaacagcatcatgcttctcagaaagaaagggggctgctatctgggtggaaagcttagaatcaagggagaattatacatgtttttaatggaccgaggaagaagccagatttgtgtatgcggagtttgatagggaagggcttctcttctttttcctactaaaggaatagtgtttttgacaaggtgccaaaaatctaggccacagcatcccactttgtgccacagcatcccactttggtgagccataccaggttgcaggaaattaattgctttagactttgggctggctgagtggggcctgaagccaccgtagtccctgggcaagccccctcccactacacaggcctcctccatctccctcattttctctgtgtgctgtgatttggaaaaaattgacaagcacttgatagaggctaccaaccaattagaattggttcacacgagacacttgggaatgaactcagctggtcactatggtgatttaactaaattgtgttatccagacacattagtgaatcaagtctggcatttcaattttctctataagatgaattgtggaaagaagttcattataataattaaggaagatttatgcagtgagtacatttttatctctgtagcctgttataatgctggtattttgtgaccaaaaaaattgagttgtagatattaactatgtaattccacaaactgtgctcccgaacgagttatttatatagttagaatttaataaatggaaactttttgaatgcacctgcttaggaaaatattgaaagaaaacttactgtaagtttttcagcacagtgaacaatcatcccccagtgaacaaaatgctagccttaacccggtcagtaaattatttggccataggcagatatctcatctccctgtaaaggaaagccagtttcctccactgtaaaatgagtcttagtaggaaagggggcattagcaaagtaatccctgtgcctacccaatcgttctaatgtgatgtttcctttggaaaaaacctacaactcagaaatatattgaatgaaaatctccctattacaggaagacactgcgggttgctaaggagtgtggtttctgtggttggagtagagaaaaatagtggtgttttctgagatctcaactcaactgtgcagggtagatcgaatgaacacagcacaagccacagccactgttctgcttctgcctgatttgcttctccagaaatttcccagattacaacaatgccgaagtgcccattggctaccacggagataacttcataaattgttaaacaggcagagctcaggtttaaagaactgcctttattttgagctgtgattttacttgtgtttcagacattccctcagatattttatttaaaagatttcacaggagcatcatgcaaaatggtaaataataaaacattctataaaccacacatcccatctaggactaatcattatattttccaatttaacattcattccttccagatatgttcttactcgttctttaaaactatcataaatggaaagctaccatttaagcacaaataaaactcttaagaaagctaagaaaatctgaactcattaaatatttctaactagtgaactccttggttctccaaatgacctattttttcccttccttcttttttttttttttgtatttttagtagaaacagggtttcaacatgttagccagcctggtcttgaacacctgacctcgtgatccacctgcctcagcctctcaaagtgctgggattacaggcgtgagccactgagcccaccctccttccttccttttttaaattagaattttttattttttatttttttttttaattttttttttggttgcttttagccacctcagttaccttgaccatccgatttcacttactgtagccagatttctaaagtatgtgtttctgtggcttttccatagtttttttccccaatattttggcagtggttgaatagaatccttttattcctccctccctcacccctcccaatcagctccacctatagatatagaaatacaaagtgaacaaatgtgccatgcaacttctatttttgtgcccgttcttcctctttgtctctatttttgcctctagcacatagtatcctggtaaactggatttttttttaagagacatggagaacacagtgcagtgctcattctctctcagcctctctgtttttactgtaatgaatctattctacataccatgttctcaggatcccactgtatgtctgataaactaagtcaagctaaggtcattattaccaataagtaatcaataaactcaatgtttaccctaagtttgatacggtaacttagttattttaagaggaaattttaagttcttgtgtgtgtgagtaagaaggagcatgagaatagggaaagggccgtttcacagaagcggtcctatctggttggcctcaattgtgcctctcaggcttgtatctcatctgcttagctgtaaggccagtcctgttaggcaagaaaaaatttaatttgcaacctagtttatgaaaggataaattaagggaccttgtgggaatttaaatcatctaaggtaatagaacatgaaacttgcctagattaaaaactgggtcttttgtgaggtttcattcattatggccccataataatagctacatgtctatgcacttttgagcttgggtctgtttaaaatacttatttgttatttcacttaattcccacaataactgtacaaatatggttctcttgcctccatcttatatatgagaaaaattaggaacaaaaaaacttaagaaatttctttcactttctatagctgataaactttggagatcagtttgaacccatatactcttaaacactatttatacagtattaatgtgatttgacaaaagtggcataaagagcaatgactctttaagactcaaaagaagatgttcagatttatattttgatattaatattaatatcagcaagataagctgttaaataagcattacatgtaagaatcctgaccttggataaaattaaatctttgtcataaatctactactgtgacaaaactgcaaaatatgcagtgaataattaaatccagatgtctcttccggcaacagcagcagcaaaaactggaggtgggggtgaagggaagatggaagtgacagactccatattcataaaagctctgatgataaatttttttaaaaaaatgtgtttgttttaaataccagtcttccatgaatcctaagaattgcacagtaaaaaataaaatctgcctaccatttaacagcccgcaatacaaaaatcttactgtgtcaaatgtaatatgcatacctggcttcccaatttggttttcttaaggaggagtaatttagttgtcattaaactctttgggaaaccgttttaataatgttctttggttatcaggggtatcctttttttccttaaggcaaagaagagaaaacgtgccgctaaaacctttactgtgtgtggtaatgaagttggtccatttctgtgcaggattgcaacaattctttatcacttaacacgatcggaggtgtgagagcagacagtttctcaaactgcaggaaaatgctgaattcaccgattgctatcttgacacaatgaagggaccatacattatatgaagcccacatttggtttgctgttgttgttttttttttttttataactgtgattattttttgatggaataataatcacagaaaaaagaaaaacctgtaagagaagacaccactgtatcatctttttatggcaatatgcaagagggtagaaaaaatgagagtgtctaaatttatcttattttcctgtgggattttcagcacagacatattcctaccactacaaggaccaaggacattcacttgcctgcttgctctgataatggccagtagctggtcccaatgttgatacaattaattaaaatgataaacatgactctagctagcttcagcacagtaagagtaccacagcattttctggatcatttattcaagattcactgacttggagtcactgatggtaccaatcattttatgaaataccttccactagagacagaaaaacgttgttttgacaaattcatggtctgcacctcccccaaaccagtgcatttctaaacagacttgtttttcctctaaatagctttgccaatccggccaacaccccaatatttctttatattttgaaaagtaggtctttcacctgctgataatggaggatccaattctgtgtaaactctggaattctatttaaaattgcagattttaaatgtagggaccaagacaggatgtaggttgtgtcaacttgggaatgctgaatgactgaactgtcatgacatttacaatccagatgtcatggcaagctgggagacaagacagcttggttgataattagatggcagatgtccatgcagtctcacgtgatacacgttactttttgtatattcaagatttgggactttagccctgaaagataggtgatacatcatcttctctatacaataaaaaatagtttcaataattgtatattattttgttttgctttttttctcatttatttggaagtagcaaatacaagaaacaaaaattactcataacccctatttttggtgtatctctatgcaggcaaatatactgatgatgattattttcattttttgaaaatttagattctcacactcaattaaaaaaagaaagcctgaggaaattaaatgatttctaaaatcacccagctaattagtggcagaaatgagaccagattccagtctcttgctttcccgaataccttattctggaattcaattataagtacaaggcatcccactcttggcttcctttctgaataaatgcttgcaccaaatccccagtggcttcttgagaaagctggctacaaatcttcaaagcctcagttgaagaattcttattaagcctactaggtaccaaagcaatagcctgaagtttggaaaaattctagttggtgaagctagaattttattcaatttaaagaatacttggtaggggggaatgtaatgaattcactccctagcctttcttgaactctacctatttaacaccctatttctaatacagcagcttctcactatagaatgttaggtttatcaaatctctcttccaccctgttatacggcattttccatcccttggatgtttcaagtccaggaccttgggcttaaaggcaaaagtaaaatctattacacatttgtagctttgtacaccaatcagggaaaagtagtaaagtgggctattatgtacattattttacaatgcagtatgttagttgtcaattgttacgcaagactaattttttccacagcaaaaaataaagctattttaaaatattttggaagcaagtcatggttgaagagaagcatcccttgaaaaattagacttaaagctgcaaacttcccggggttgacattagcttgaacttgatgaaaaaggaaaaattttaggaggatttgttcagctgtcttctgagttatgaaagcaggaagaaatgagttttacatattgcctggaggtaatttgtgtacatataagtcaaaaacaattaaacttcaaacttcacacacagccactgtcctgtaaagggtggtagtgtataagcagaagaaaaatgactagaagagaacagggttataaagcatccagacatttcccatgtgaggatcttgaaaaacttctgcagccctgtgactggattctttctcctgatctaatagggctgtttggaggaagtatttctactgctcttgagttgttgctagttttcctttgaatatcctgctcagttccctgccccagttcaagcttccttccaaaatgtgtttaaaataattagctcttcctgttggtataggaaaaaattagtcacacataattggtaattcacatattgtattataaaataatgtacaaaattaccacccttacttctttttggagggcctgtggcttgtaccaatggatttatcttgttccagggcattgagaaattttgccttactgatggcatcaccacttacatttctcaacatctttgcctcccatcagaccaggatttcagttactaggtatcctaccttgttccattgatctgagaccctcattaataccctagctgacagtcttaactcagcactgtcttctattttctaccaaatagaatacaataatcagatacattttactctctcttctgaataaagatattaacaaaatttccatgagtacttataagggtgagtttccagaccaacctagatgagttaccaggatatatagtttgaaatattaactttaaacatttcttgatttttctgaccccatcaggtattttttggaaactggtattaggcttgtagaaatggacaaggagctctaccatgcttgaagatggtttaagccttcagcaaaataattgagagcttcctcttctgaatattccgaatacacaggtctatcagttagtgtatcatgttatgtgtagatgtgtgttggggtgatcagatccaacaccaggtcgtgggggtgacaaaggccggcaattcaaaggaatgagaaaaagacagtttgagagagaaagtgggaccagggggccatcgcgagtgtggaggctgtgaaggccccaagttctgggagcccatgttatttatgggtgctcaaacaggtggtgaggatgtcgagtgaatgagaaacatatggctgtttgacataatgggagtactagaagcaagaagccagcaagtctagcagacatgcaagccctgcctcagcttctctcccaacactcagcttttctccaacagatgtgtatgaataaggcttattaataacaaagcctggctccacaggtgagagggaagatgtaacttaatctactggaagtcaccaacatagccctctaaaatgagtcattattttgactcaaaaatgaacagattaaaaaatgtttcagctaatcctcttagctatttgatgtacatcaagcatccagatgttcacaacatccaagctgcaattttttgtgtgttatttaaaagttttacacttgcatatattattcctttcctcaaagacaaagtatagaacccaaactggactttttaaattcactccttaaaagtgtggtaacttaccattccagagctggtgggtccccgattattggcccatgggttgtccactttgtggttttgctgttaggaaatgttggctgatggcttccttaaccactcagcagttaaccaacaataacttggaatgtgtctaataagtgcagcctaatcttaattttattgggagttatctcagctaaataatggaaaatttgacaaacctaattaatgaattatccactgttaaatcttctgtgccactgagtcctctttttagtaaaatgattaaaaacattaactatagtggtatataattactattaacaactattatgccaatatatattgttattcctgcctaagatactatgtctcagcacggagtttatattaggtattttattttaacagttttctaattgctgccactttttcgtcagattgcatattttgacccacaacattgatttcaccttaatgtcaccagtgggaattaattatctgaagcttggcataatattaattaaatccatatgtcacatcatggtgtggcattcttttctttctttcttttttttttttaagtcagggtctccctatattgccatgctggtctcaaactcctgagctcaagcagtcctccctggttggcctctcaaagtgctgggattacaggtgtgagccaccatgcccagcccattgtgcagtgttcttacaaaagtattctaacaatccaaaatcaagactacttccaaaagtggcaggcttcatatagaatccaacattctgttgcaatgagattgggatgagtgggtttagaccaacattgatatcaaaggccagtttccctttaaatcaaaatcacctgtaaactagcatcttgacattcaagatcccaccagggggatctagctgggaatgtcaccatgcatgtcttgagagagtgcattagcccacctgcagtaggttgaaaaatatcttccaaggataatttcttaagctgtatattttaccttatttagaaaaagggtctttgtgagtgtgattaagttaaggaccttgagatgaggaaataatcctggattatctgagtgggccctaaatatcctcaaaagtgtccttataagagtgaggcagagggggcatttcccccgccacacacacacacacacacacacacacacacacacacacagaggagaaggtgatggaggcagatactggagtgaagcagccacaagccaaggaatgctgacagctgccagaacagtcaagaaacagattctcttttagggtcttcagagagaatgtggccctgctgatgtcttggtttcagctcaatgatactaatttcaaatttctggcctccagaactatgagaaaataaatgtgtttttgttttgttttgtttttttgagacagagtttcactcttgtcacccaggctggagtgcagtggtgcgatcttggctcactgcaacctccgcctcccgtcttcaagtgtttctcctgcctcagcctcccaagtagctgggattacaggtgctcaccaccacgcccagctaatttttgtatttttaatagagacagggtttcaccatgttggtcaggctgatctagaactcctgaccccaagtgatccatctgcctcggcctccccaagtgctgggattacagacatgagccactgcgcccagccaaatgtgttcattttaagtcactcactttgtgccaatttgttatagcagccacaggaaactaatacaatacttgtgccaacttaagtaacagcaccagccaaagtacataaagtggaaataaaggtatttttagaaagtctcattactataaaatatggtgtaaataaaaacagatctgaatatgcaaattgaagtttcaaaataagtctcctgccatcccatttcaaagacactggaaatcttaagctcttttctttacaaattctgaaactatcattgcctgtgggttgggttgaaatgaaggcacgtgggtgtttcaagggtatgttctgtgacaaagagacagaatagaaaaatccaaagtcatagcctggagctaatacagtaatatgaatacataaaacaggaaggacaagaatataaaagtgaatttggggacctgagaaagtcaagaaaatgattggagaaatacaatttgggagaccactttagaacccagccctcactgggcatggtggctcacgcctgtaatctcagcattttgggaggctgaggcaggtggatcacctgaggtcaggagtttgagaccagcctggccaacatggtgaaacccgtctctactaaaagtacaaaaattagccaggcatggtggtgggcatctgtaacgccagctactcaggaggctgaggcaggagaatcactggaacccaggaggcggaggttgcagtgagctgagatcatgccactgcactgcactgcagcctgggtgacagaacgagactctgcctcaaaaaaaaaaaaaaaaaaaaaaaaaaaaagaacccaggcctccaatggtgcgatcaggtgccaggtactcttgtctactgtgctgaccatatgctgttgaggtcatcaccagctacgggaaagggcattctcataggggcaagcccaactctatgtatcttacgttatttaccactatttcccaaataaacctgtttcaaagaataccatctttaatgtctttcacaggtacctatcctccactctgcatccttttccatgctatcacttgcagtgaaggtctgttcaccccttttttaacctgtcttccatcttgagttccaatttccagctgccctctgaatatgtccagaggatgctggctgctgcctcagactcactggatgaaacagtttcctgttttctttactaaaactgccaaccttccttttccttgtttgagttagtgtatcactgtcctctagcccctgagctgaaaccttggaatcatctttcactcctccctccccctttatattcagtcaactgacagtaccaatatttcttctcttctccttttatttcttttgccactgtcctactttgggcactaatctctcttctgaagtataacaatagcctcccaactggccactctgctttagctgctccatggtccaatctcccttgtcacatgtgttatctttcccaaacactgtcacaacttgtcagtctactgcaaaactttccgtgactcctggggggcctgcaggagagagtttcagatttctgagtctgccttcctggctcttcacaatgcagcctgagtccatcttttcaaccgtctctctggatacataccaacacttgccctttgtctcaatgaatgtgcctgccacttttgtatctccttacctttactcatattgtggtttaactatgtggttgtcttctccaccctgacaatagatacatctattgtccatcagcccaatttacaacttttgcatctcttctgatttctatcctctgctaatgacacttattaactactgcctttccactggactttgcatttagttttttatatatatatatatatatatatatatatatatatatatatatatatatatatataaccttacttctgcttttaaacatagatcattatttccatgtctaccttccactttctccaacactagattgcaaatttctacagggtgaagcttatgttttcatcccttaacacccagcttaaatgtcacctcacatactgactaatgctttttatctcagttctaaaacattattaatgtacatcacataatttaactccattttgaaaattagttcttgttccagtatcttatctcttaaaatagactggaaccatctcaaggttagagaggatccactatattaaattcttatatatccctcagtagatggcactttgttggatgatttaattgacgtatcttcttaaaaaataaaaatatctggctcttcaaataattagctttgtgacctgaggcaaatcatttatcctctaggacatttagtttactacatggtgaaataaatgataccttcattccttaaatatatagatccagtgacatgttgctttgaatcacagaatttggtttcgtgctaaatctaagaccaaaaacagagcacaaacaattcagaatcaacagcatgctttctggaagcaatatgaaaggtgttattaatagaattcagcattattctaatttcctcttaaaatttcaagaaatatatctgacatttgtcctgtcattgtaagttgaaatatgtgtgtgtgtgtgtgtgtgtgcatgtatatataattttttgttgttgtttttgagacagtcttgctctgtcacccaggctggagtgcagtggcatgatcttggcttactgcaacctccgtcccccaggttcaagtgactctcatgcctcagcttcccgagtagctgggattacaggtgtgcatcaccacactcagctaagtttttgtatttttagtagagatggggttttgctatgttggccaggctggtctcaaactcctggcctcaagtgatctgcccacctcagcctcccacagtgctggtattacaggtgtgagccaccatacctggccaaaatgtgtatacattacacacacacacacacacacacacacacagagtatgtatacgtatatatctgtatataggtaagtgtgcttatatgtatatacacagacatatacacacacaacatatacatatagatttgttgtctagatattataagagtattgcactaatgtttctataaaacaccagttcacaggcttctgtcttctaacaatatccttatacatatttgtcagccactatttaccttaaaatgaaacagaggggagcctgatatataattacggtcactgtgctttgttctattttgtttatccctttgcaatatagtgtggcagacagaaaaatgtatgaaattaattcttttggtttagaatgacattcctatcattgttagaacaagggattacattatacactacctctaaactcaaattttctgagcactttaactattaaatagcaataacagaaagcattgtaaatcttttggagttttgcatgataatgtacctcttgttaattgaattgagagatgattgccctatgattacctcgattcatttgctgcataatttaccataatgataattaactccttgtactgaatgaggtaagatgtgtgttagttagacaccccctccctcccttcttgcctttccttctttccctccctattttagtgtttaaccattttacacacaatttgagacttgtttcagaatctctccacctatattatcatgtcaatccaagtatttctaaataaaagtagaagttgggccatgtttttaaaatttctagctaattgcctgctacttggcttattgttgtgatctaattatgttctggtttttgaaaaaaggactattgcctggcccactgtatgacatttgatttatgtagtctcacctctccctaaatagcccatagttcacaatgcagcagagcctatattaccgcaatttcttctgcactgaaattagacaattatgaagttagtagattattaaactaacgtatgctttataaatacttcttcattctaggataagggagaaggaagtatactgtaattcccaatatgtaaatgccctcacacatttgatagttgatggttccattttttagatgaaaaaactaaagcacaaagaagataaacaatattttgttctgccctataataaaataagcaggcaaatatttatggatatgattctgggttgcctcaaaactttcagggtcagggtaggcaggcagttggagatatgagataatgttagccatgaattgtggctatttttgtggcacctgggtgatgagtccacggaggttcatcacatgattttatttacttttgtatgtttcatattttctataataaaggtattttaaaggaatatatttaggtatccacagtgtgtgacacctgtcaaggagcacatgctagaggcctggctctgccagtgacataggctacgtgactgtcggtgggtcacaacttcctagacttcatttttccctcattaaaatcaaagtattagaagagatcagtggttcccaaggaggtggagttgcttagggaactgtctaaaatttcactgacaactcagaaatctatttggatttagaagctggaggggaatgtatatttcaaaataacttctcaagtgactgtactgtgaccattccttacacacaaacttgggctaacaatgagaatgacttaaccccccaccccacaacactttaataggtttaggatgggttctgagaaataaagatttttaaaacattccccaagtgattctaataggtggtcgacatgccatactttgagaaacacttttttagctcatctcagggtcccttccaactctgacacctcatgatattacttgagcattcttggttctctgcttctatgatgtactattccatgagcaactggagatttagttacaggtgtatacaagtgtacaggagtcaagaaaatgatgctaagtttcttgcactgactgaggaagcaaggtagaagcagactctggcttaattggaattcatgtttgaggcctctgggccctcactaggaaaaatattcaatttatatgtaagcatatgtataatacacatatctcaccagcattctttttgggaaaagagaatttccaaattaaatttaacctatcaattttatactgactaagatgaacacattattttaatatattgtttcctcttgcttcctaatacttacattgtatagagtttcattctttatgctaatcctaatgcatagattggtaaattgagattaatgagattcttcctttactaccacctgtttttaaccaaatgcctacatgctgcatgagcaggaaatgaggtgactactgttgttggccacagagcttcaatatgtcgtgaacaagggttagatgtgaatgtcagaaaaaatgttatgatcaatttctgcctccaacaaggaactacaaatatgggtcacaaaagttctactagtagccccaaatacattttttgaaaggagacaatataaataaagctgaaaagcagtcacaacgctttaatgtgtcattctcttcttcacctttctatccacttagatgtttcctaccccccaaaaatgaacttatgtcacatcacacttgtgactcccactgacatctaaagtagtgtgagccacacagatagaagcacaggtaaatgcctcaaaacctagttattatatttgaaggaatttctgattcagtagtgtttctgtaattgttactaacatcaacgcttcgcttgcttctaggaagacaggatggtaaattcctaacaatggaattgcaaagttcacagtgtgctttaaggagtccctttctccataaacacagctcttgtgatggctttgcagattttgtttctgcatttagtgtagataagttgaacaatcctaattcctgagttctaactagtgatagagcacattatattgttaagaataatggatgttggagaaagtcaggacaaaagtaggtatgaggtgtccctggtatgtggccaataggaaccacggtcctgaagtatccggagcagtccggacatcctcaagtagacccaaatcagccctatcaggagccaacagaaaagcttgctagggcaaggtcagaagataaatttattagccaggaccagtttaagtcaaaagttgaatataagtcatatctttagaaaaaaaaaaaaaaagcaggtagaaaggcacattgtttttagctaactctacaaaaagttcagagcgaaaagaaaaacagtgatgcagaactaggggagaaattaaggagcaaacattccaaaaatagaatgagttgtacacttggttaatttcattgctcagtgatgcctccatagaccagattcttctctctgccatcctcagaaataggctctagggatgctcttagataggctattctgtatgcaagaccttctgtagctgttctagatgccagatcctgaaatgacaacattcagtgaacaataatagctcttcttctacgtcatttccttagatgtgaagaaaccatttccagcaaactcccctcatgtccacaacacctcattaatcaggattaaatcatatgttcatttctaaaccaataagagaaaaagaagtatcgtggctatattatactgaaatgcaattgattttggagagttaaaaacaaatccaaaccagcagcagagcctggggagaatccacgtctccttctcaatccacaagacatgatgggtctgctgcagtgtggtactaaatttggggttacaagaaatttttggcttattagtttcctagggcttctgtaattaagtaccacacactgagtgccttaaaacaactgaaatgtattatctcatagttacaaagtctagaagtctcaaaacaaggtgtcagcagagccatgctcccccctgcaatctgcaggggaataatttcctcttcctagtgtctggtggtttgcccagcaatctttggccttttttggcttgtagttgcttaactccaacctctttcttcctcatcacatggtgttctccctgtgtgcccctttcttcatatggctatcttcttgtaagacactagttatattggcttagggtctcactcaactccagtatgatctcatctaacttaacaaattacatctgcaaccttcctatattcaaataacttcacattctgaggtagcggggattagaacttcaacatatgtatttttgggtggaacaaaattcaagccataacaggcttctatagacctctctagttttactcagtctagatcccaatccatggagtttgaccaaatgagttagggtgctattccctaaacttgctgaaacataataattgctagaggcccttagtaaaatacagattcctggccctcacaacagatgtactgaatcagtctctctaggggacatgcctagaaatctgctttttgacaactgcccagttcaattttatgatgaagcaagtttggaaagcatagagtcagggtgctgagcactttttgagcatctttgagcactttttgaccatgttattcctggctgtgaaagaattctttttgtatgaaatctcatctacccataacaagtcttggaagctgctcttgtcatcctcatcacagacctgcagaaatggaggttaggtaagagtggggctggaaatggagctaggtccaatctcaaaatacatactttttcaatcatactaactcatcatgttagtagtaagttaaagaatcttgaatcatatggtccactgtagtttacttttcttgccttattcccaggagttttgtttttatttgttcttgtccttggagggaacaaaagacagctggtagctgttccctgtttggttttgcatgtattcaaaaggcatcatcttctactgctctcttactcctttactttgtggtcatttgttttgcagctatttagacagttacttcttaaagaacccctaaaactatttagacagttacttcttaaagaacccctaaaactatttagacagttacttcttaaagaactcctaaaactaccatttgttcctctagaaaggattaaagatttgctgaagcaaagttctcctgacactttacctagagcaaggctgaaacaaaagctacctacacctgtattttccttctcttatccctcaagtacacaatagggcatttggctctcagcagttgatgccaagttctgctagggaagaaatgagacttcagagctccctacaagttgaaatggagtcagaaaagctacatatataaatgtcagaaaagctacatatataagctacatacataagctacttataaagtttctgcaaaactacctcaaagggcaggtagttttgcagaaactggagggacactgttttctggagcactctgccactaggattttacttttagtgtaatgaaggatcactgaagacttttaaaccagacggtgacatgataaaatttcatttcagaaatttcatttctgaaaattatgatggctgttggaaaaaagtagattggaagaagcaagaaaatgctaggttacttcacaacttctccaggaaaatagtgcagtgggagaaccctgaactcaggaaatatggcccatttcctgcactatgtttcccaattcaaaatatcctattgtggaattctacagctcaagtcaagagccccttctgaactacaaaggacaaggactgatctactaaagccgtgtagtaaatgtgaggaatttgcctaactcagccaattgatgtgtcaaaatctaaccaatgtgtctaataatctaacatatattgttattgatttcaggttttaagaaccagttttctaaaaatgaaaaacaaaatcaaagcactctagaggaagtaatcatatgtttaatgtcataagtcactgattgtatacttaatagtaaatggtggatatgaacttgggccctggagtcaaacttaggtggctcggtcatgcccttgatgtgtgtctttgggtgggctactgaaactctgtcttagtttcatctataaaatagaatgctaacatcgactttatagggttattgtgaactctaaataagacaacaaatggaaacccaacacatgttctcactcaaaagtgggagctgaacacgtagacatggggaggggaataacacacattggggcctgtcggggagggggagggagagcatcaggataaacagctaatgcatgtggggcttaatacctaggtgatgggttgatagctgcaacaaatcaccatggcacttgtttacctacgtaacaaaccttcacgtcctgcacatgtagcctggaacttaaaattaaattaagtcaaaaaaagctaaaagcaagctttatgccaaaaaaaattttaaaaacttaaaaaaaagcgcctcttaaagttataagggagggtacacagtaagcacttagtgagtgagtgttgtggttgctgtttttcttaataaacatatttttatccaaattattaagcagaaatattggactggaaaagggtaaagtgtggattattaacggttgacattggaagagcaaagagatagagatgttccatgtggttcctttgccaagccatccagatactcacctccatccttttggtcatttcccctaatacacagtatatttatgatccccttctgacaaccccttgaagagttgcttgcctcctgcacagtgctgagttatggacgatgcatttgaagccatatattcactctgtcttccccacatgtgcctagtaactatggcagagctcaataaagaagaggccagtggcgggtttactcatttttaaaaaaatttccttgttgttcttttctgtgattgtaatggctagcactggtactctttccctctctctccccttcttttgccatagagctattgtcaaatgtacaaatacatagtgaattgcgatggtttctgggactgacagagagaaggaacctgttttccccataaatgctgtagaatgaagggtttgcaaacattgtgattgtggcagattaaaaaaaaaaagtcaagcaggctaaattgaaagggaggcatgagaaaagctggtgcaacctgtcagctcctggtccgaaagaagctgatggtattttttttaatattgtgaagagaaggaaaattttttatagtaagtctatggatctgctttaggaggcttttctcttgatctaattgagctgtttgaagtgtgcttgaaagttctcacccagcctgtgtcagccacctgcctgctacaagctgtgagaagttaatcgtcttgggcattgttaggaggagactgtctggtatctgatggctttccattctgaacaagggtgtacggatatggaaaatgtgtgtgctcacatttgtctttggggtgtggggctgcttcactatgcatgagagcacatccacacctccatccagatggtgcctgctcatagtggcagtgctagataaattcatgtcaaacaggcagataatccaaaaaagcaactgtaagtatccacattgctgttttctgcttccaagcttcagtgttgtttttttttttgtagtgacagggtattactatgttgcccaggcttgtctcaaactcctgggttcaagtgatcctccagccttggcctcccaaaaatctgggattataggagtgagccaccgtgcagtgcctggttttttaacatgctattcccttgcctgaaacaaccttgccatttgccatcaacactggcttcatcttccaatctctttgcctgttgcctcacattggatgtcaccaatctgggaagcctttgtcacccctcaccacattgaggtgaggggtacctcatattctctccctgttccttgatttcccattcaaagcacttaatgcaccaaacatttttttttattgcatgtctgaatacattccttagtagttcaacattctttgaggttatatcatgttcatcacagaatttaaagcaatctcctgtgtatagcagattgacaataaattagctatgaaaacaaatgaataactatggtttgggaagaaagacattgtctgagcacacagaattctaactcatgacttgtgcactgtcaagaatcacttgctttcagataattttgatgagtctgattttacgcttttcagtttgtatgtctcatgatttgtccttaatagactgaagaagtcctagcccttataattgaccagtgcctggtaggggaagggcagcagagaaggactggattagaaccatctcaaatgcttctattctgattagtacttagggttggttggagagtaagaatagggactcagcctagttgaaggaaagcctgtatagtggtgagtctgagtgacaaaccagggagaagtaataagacaatttatttctatttttttatcctacacctgaaatgtaaacaaggacacattaaatttttactggttagcattttttaagtaattatgtgctcaactatgtccttatatttgcattcttaccaatgtagactctgttatggaagtaacccatgctgctgctgcctttggacctgaatctctttttgcccttgtcccatttgtgaatttagactttcagcaagttgtctttatgattctctattctatgacatactttgtgaattcatctgtaatcaaatctgtttgatgaaggtcacaaaagctaagtcaacatgagacctgaaagtagaacctgggggtactgattttcctacccattaggaaacagcctccccacccaatcagggcaggttatagtattcaatgccatcttgtcttattgactgagtcatacatctctcattccgcaaagtcagggtcctaaaatacttctgtggagtcgcaaggactcttcctcattagccatctttgactttgtcattgatactattttctacctgtttctgataattaaaaccccccaaaaagtaaaatgtcagggtgaccagagagaaccttagataggacagctaatctcttgcttctagagaaaggtatgaaaatatactgtgcttattatggggatgatggtatgctctctgaattgaaccttaccttttaacatgaaatttctaattgaaacaaagctgtgatgcctccagctttgttcttttggcttaggattgacttggcgatgcaggctcttttttggttccatatgaactttaaagtagttttttccaattctgtgaagaaagtcattggtagcttgatggggatggcattgaatctgtaaattaccttgggcagtgtggccattttcacgatattgattcttcctacccatgagcatggaatgttcttccatttgtttgtatcctcttttatttcattgagcagtggtttgtagttctccttgaagaggtccttcacatcccttgtaagttggattcctaagtattttattctctttgaagcaattgtgactgggagttcactcatgatttggctctctgtttgtctgttgttggtgtataagaatgcttgtgatttttgtacattgattttgtatcctgagactttgctgaagttgcttatcagctgaaggagattttgggctgagacaatggggttttctagatatacaatcatgtcatctgcaaacagggacaatttgacttcctcttttcctaattgaataccctttatttccttctcctgcctaattgccctggctagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgctggattacattgattgatttgcatatattgaaccagccttgcatcccagggatgaagcccactcgatcatggtggataagctttttgatgcgctgctggattcggtttgccagtattttattgaggatttttgcatcaatgttcatcaaggatattggtctaaaattctcttttttggttgtgtctctgtccagctttggtatcaggatgatgctggcctcataaaacgagttagggaggatttcctctttttctattgattggaatagtttcagaaggaatggtaccagttccgccttgtacctctggtagaattcggctgtgaatccatctggtcctggactctttttgcttggtaagctattgattattgccacaatttcagatcctgttattggtctattcagagattcaaattcttcctggtttagtctgttttggttactgcagcctatactacaaggctacagtaaccaaaacagcatggtactggtaccaaaacagagatatagatcaatggaacagaacagagccctcagaaataacgctgcatatctacaactatctgatctttgacaaacctgagaaagacaagcaatggggaaaggattccctatttaataaatggtgctgggaaaactggctagccatatgcagaaagcagaaactggatcccttccttacaccttatacaaaaattaattcaagatggattaaagacttaaatgttagacctaaaaccataaaaaccctagaagaaaaccaaggcattaccattcaggacataggcatgggcaaggacttcatgtctaaaacaccaaaagcaatggcaacaaaagccaaaattgacaaatgggatctaattaaactaaagagcttctgcacagcagaagaaactaccatcagagtgaacaggcaacctacaaaatgggagaaaattttcacaacctactcatctgacaaagggctaatatccagaatctacaatgaactcaaacaaatttacaggaaaaaaaacaaacaaccccatggaaaagtgggcaaaggatatgaacagacacttctcaaaagaagacatttatgcaaccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggaccaagaactagaaataccatttgacccagccatcccattactgggtatatacccaaaggactataaatcatgctgctataaagacacatgcacacgtatgtttattgcggcactattcacaatagcaaagacttggaactaacccaaatgtccaacaatgatagacaggattaagaaaatgtggcacatatataccatggaatactatgcagccataaaaaatgatgagttcatgtcctttgtagggacatggatgaaattggaaatcatctttctcagcaaactatcgcaaggacaaaaaacaaaacaccgcatgttctcactcatagatgggaattgaacaatgaaaacacatggacacaggaaggggaacatcacactctggggactgttgtggggtggggggaggggggagggatagcattaggaaatataactaatgctaaatgacgagttaatgggtgcagcacaccagcatggcacatgtatacatatataactaacctgcacattgtgcatatgtaccctaaaacttaaagtataataataataataataataaaaagaaatttctaattgagttgcctaagcctgcccacctgtcattctcatatgcctaacacgatgtgagattttatatatacagtcctctgtatatatattcacaggttccccatccacagattcaaccacccatggattcaaaaagcaaagcaaacaaacaaaataacaacaacaaaaatacaaattttaaaacacagtataacagccatttacacagcagttatattgttttaggtattatacctaatttagagatgatttaaagtacatgggagagtactttaaaaaaaaagtacacaggcatgggggcagtggctcatgcctgtaatcccagcactttgggaggccgaggcaggtggatcacgtaaggttgggagttcaagaccagcctggccaacatggtgaaacccctgtctctactaaaagaagaaaaaacaaaaacaaaaacaaaaattattcaggtgtggtggcacatggctgtaatcccagctgctcgggaggctgaggcataagaatcacttaaaccagggagaggcagaatttgcagtgagttgagattgcatcacttcactctggcctggacgacagagcgagactccatctcaaaaacataaataaataaagtacagggaggatgtgtatagattatatgcaaatactgtgccattagggacttgaacatctccagattttgtatccacaggggtcctggaatcaatccccttgatggatacagagggaagactcactctcactctctcttgatatatatatatatatatatatatatatatatatatatatatatatatatatatatatatgcacacatacacacacacacacacacatatatatacacacacatacacacacacgtatgtatatttacatgtatttataaactgatattttattcaaatgtttcaactggcccctaggaagaaagatccactctgatgtgttctggctctgtgtgcccacccaaatctcatcttgaattatcatctgaattgtaatccctgtttgttgtgggagggacctctcgggaggtgattggattatggaacggtttccgcatgctgttcttgtggtagtgggtgagttctcacaagatctgatggtttcataagaggctcttcccccttcgctctgctcttcccttctttaagctgccatgcgaagaaggtctttgctttcccttcatcttctgccataattgtaagtttcctgaggccttcccagccatgcagaactgtgagtcaattatgcctttttcctttataaattactcagtctcaggtatatctttatagaagtgtgagaatggtttaatacactctgtaaaagcaaaataatcactcttcagaagcagaaaaaaactttttataagtgactcaaagtcaagatgacccatttctcatttatatgatataaacctatacatatcctctcacgtactttaaatcatctctagattagttataatacctaaaacaatgtaaatgctatgtaaatgcctgttatactatgttttaaaatttgtatattttgttgtattatttatatttttgttttttgaatctacggtttatatgaatatcattctctctccctctgcatctatctgtatctacatatgtatatttgtttttttcttagaacataacctagattcctctacagtgtaaatcccttgctttctggttttctgcctaataaaaggctctcatttctatcttggtctggaaatacccccacttccattttttatgaagtaaaaataccgaagatttttttttttttttgctagaagtagtttactgtctttctctacaactcattctaatatttttcttttcaactccctaccattcttattgtcttccagcaatgtctctatgatcatagagagacaaactgcagccacacttagccaggatcatttacatttacttgcatggctctgtgtagcttgctttttatgctaggcaggttcctgaatagtcagataggaattgaattcttggaaatcatgccattgtttaaggatgaggaagaacttactattttaatgaactttattataaaccttttttctaagcaaataatcaccccttactttatcttatctcctatgcaaatcctgattttcacatttaagctttacttaacagtgtcaatttgtatagttatctttaaacaatggtcagtccccactcttataattgaaaagtaagtaattttcatttactttctggcttctacctccagaaaatctcttacctctatctttattttggtaattctcttgtagggactttaatagcccctggaaaatcatcatagctctgcttcaatctgaaaacataactggcaggcatgagtctggaacacatacgagggaacgaagtacccagagccaagttaaatgaactgttgatgacttttctgaaaatcatagtaaaccatgatttcctcacaaaatatagaagtgtctgatttttggcatttaattctcaaacatactcagatacactttccttcttcctctcccactctgggttcatatcatcatataaatcagaaatgggtcatcttgcctttgagtcatttataaaaagtttttcttttctagctctgaagcgtgattattttgcttttagagaggatctttctttctggggccagttgaaacatctgaacaaaataaaaatcaattgaatatggatatgaaacttaacttgtctttttaccattaaatatatatttgaaaaatgtgctcttcttttatagcttttgtcacatcagcatgtaccaattccaaccagagaacgaaatattaatattctgccccaaagtgctgttttccagcctgtgccaaagcagataatgccagtaacagggagttttccaatctaactttcttataccagtcaaattatccatttcaaaaaagcatccagtcaaagtgctcccaataagtgaatattttgcctagagaattttgggcttgagttatccatccctctgaccaaaatctataagcccactcacccaggagatctgagaatgaaactaaatataaaaactggctttactactgggaacccgaaagttcagctagtgagggaaggaaaacaaagaatagaatgttttccgacaatccttgcttttgtgagtggtcagcagatgttttgtgcctctgctgtattccttagctaagggttcacatgaaatgtaccctctgaaggctgtggccttgttggaacgccaaattagtagttattcctcatgctctgaggtctagcttcaccttcagaaccaggtgagcttggtccccacaaagccctactggtacttaagcttcccatttcaagaggacatttgggttcactacacctctccaagccgtctgattaattgcagctgtgtgcaaattagttttcttcaggggctctctcctgctctcagattagcaacaacgtattcagatggaaagcaaataaagatagttgtaaaatgaggacacaaaagagatgcaacatgtttgctcttgatgggtgcattgatgtcagaacaactagggggaaataagaccaccttggtactgttatcatcgtcctgatgatggtcccgtcttgcagaaaagcccaaacagaagcagggcgttgtctaatcactgatgggtttcctgatattattgagaagaccaagcaaaattaatggtgatattatatctggtgaaattattataaattctccctgcagttttaattagctctgctctttttctcctcctgttttaatccaaagcatatgtgtatgtttgtatcagcaatttcaaaattctgtgaagcatttggtgtcatccatctagtttcaaaataggtacagcatgatgcagtgggaagaatgctagcctagaagttaggactcctgagttcctgcctaggtctgccgctaagctgtagtatgaccttggacatgacctttcaggaccttgatttcttcttatgtgagatgaaggattaaaatccaacagtttgttaaatcactctcaactttttagatactattaagtttaggatcccgtggagaggcctatcatccgagagaccatcctatcatcaaaaggtgaatatcaggtcaaagcaaaagaaaccacattaatttttttctgttgtcagctcacaaagctattttaagcctttggacaataagaaatatactttttttcccctccaataaatatacattatccattaaagtagagtgtgttgtgaactgaccttaagggaatttgctagtttttttgtttatttttgttttttacaggaaactaagtcctgtggaacaaaatagaattaccttcatggagcaagtttaacaaattgtcttcatttttggtcagcaggttgatttctaattccctcttattccctttatatgtatttttggcttcctgtctttgttttgcgttgctataaagaaacatgtgagactgagtaatttacaaagaaaagaggtttattagggctcatagttttgcagcctgtgcaagaagcatggcaccagcatctccttctggtgctgcccctaggaagctttcactcatggcagaaggggaaggagagctatgtgtagagatctcatggagagagagggagagcaagagagaggataggaggttcaggcagtttttaacaatcagatttcatgaaaataaaagaactcactcattacctcgaggaaggcaccaagccattcatgcgggatctgccccatgaccaaacacctcctactaggccctacctccaacattggggatcacatttcaacatgggatctggaggggacaaatatccaaactattaaattcctaaaggacataaaagggtgaactgcacaaggatactatatctccaaacaaatgcccagttaggtccaggacgtgttcaacagtgtccaaaatccaaagagaaccagagatagtgtggcttagtagaaggtaaactgattatacacactcagcattgcaagaaaccttaacgggactgttgtccaaccacacaagcattattcaaaaacctttttacctctcaaggtttggttttctagcatgggttgccaagctacaactgcccagagaagtcatttaaactgcaagagactcagctttctcatccttggaagagagaaattggacaaaattatctttaattttttgtttgccttaatatcctcttattctactaaacattttcagtattacagaaatcagctcttggaggaaaagacattgcagggggtgggagacaaagttggtgataccatgtaataagatttttttagatagtggcaagataaaatgttttgaggtttggcaaaaccatctagtagtttcagttctccctgacagtaagaagttaaggaggccaatttctctttcaagtcagaacttcttgttataactgggtagtaaacatactttttaataagaagtggctaaggcttaagaagaccaactgctgatacccagaaatagccaaagaatacttcattactgacagtgcacactttgatagacctgtcttttactattgacagtattctttctctgctgtttttacaagaaaaaaagcccaatgaaatgtaaaccttgttttcttcagttattggtcctaggagtattcagagtaaataaaaaaaaaataccttacgtatacttctataaaatcttttatttgagcaattaaaaaaagctatcttctttcagtcttatcaaggagagcaaattcctcctagaagtcttatttctacttctaatgacaattgctttattatgtgacattcaaaggaaaaacttgaagtcatatttctagtaaagtatttaatttcagaaataatttaaactgttacttcaaagcaaatatctgctattcctgacataaagtttttacccaagcttggtaataaagttatcataagaataatatggattattctcaggatggaatagaatgtcttgattaggaagaaacacacataagaaattcatttttttggaagaaagaaaatctgtgctgtttatctggcaatggaagtcagatcaaaatatatctatatgacatttgaatggggtcacgtgggaagacaagatctgtctgtatgaatatttttagcttctgaatttgacataagaataggatcaggaaaatgaattctgtgttacatgactaagatgcatattagaactcaggcaagatgattcctgtagttggtctactgggaaattaccctctgcctacagctttcaaatacatatatatactatgtgtgtgcatgtgtgtaaatttccaactgagtacatcagcacataaaatacacttgtccaaggtaaaaaagacaaacagttattaatagggcaaaaataaaatggggttatatccaaccatggcataatacttctcattagaaaaaagtgtggcgagctaattaagacccagtgatagttagaaagtctgagaacatttatctttaaaaatggagtggtaactaactaaaagaaggacccagaacctcctaatacaaatatcagttatattccctgagatttaaaaatataataattcttatttctaattcaaaggcctagagtgtaagtagggataacttaacctttttttttttttttaagcctctgtgagaaataacgcagctgtttggcccgtggtattctctttaaaggaaagaagttacaaagacaagaagaaaaaagtggaagagaaaaataaggagaaaaaatattcaaacagtacataactaaaaaaaaaatttttcacaaacagcaaggggaatcttgaaacaaaatagatttgttttaaaatgcaaagaaagagccttacccgggatgaattgctcagttctcttttgttggttgagttcacttccttccatttctgctaactttgaccagctgctaacaagcaaaagagcttcatagaggccatctacacgtgttctcttctgggttatcgcgatgctgacaaagtgcacctaccgcaaattagaagagcacaaagatttctgtgggtatgcctgcaaaactctggctgcgaggcatcacctcagctcagtagccttggatttacatgtgcctgcccccctgcccatggttactgagggtggcctgaggatggattcacttcataacccttttccataattatgtgaataacaaatgagctctatccaatagagaaaaagaacacattttaatactttgtgaagtgatcatgaggaaggggacagaggagttgagatggccaagagagatcccgccctctggagatgtaatagaacagtgacagataatgcaaaaaaagatttaatatatttttatatatttaatatttgtcttctgttgttgaccttagcttttgagtcaacagtaactaagaagcattttgtcatccgacggctcctcttcctttggccttctgtattgtattatctgataaggaagcagcgaacttaaagctcagttcaacgcaatgatccttcatcatagctgggtgtgaagaatgttgttccctcaaatatgacacaaattgtttggtcaatagagaagagaactgcattctatttttttccaaacatctgttatactccaaaacctttctccttaggccatggctgtctgaccaacagtaggtggatttctttgaaatcttatcttctgtagaactggatctcatcctggccaacatggtgaacccagtatctactaaaaatacaaaaattagctgggcgtggtggcaggcgcctgtagtctcagctactcgggaggctgaggcaggagaatggcgtgaacccgggaggcggagcttgccaagatggcaccactgcactccagcctggcaacaaagcgagactctgtctcaaaaaaaaaaaaaaaaaaaaaaaaatagatctcactagaagtattctcaattcagcagtagtgtccagttttgaatcaaataatttatattttgattatgtgtattaagaagctaaatctactcatatacaaaaggaaaatctttagcttttcatgtgttctggctaaaggccagaattaaaaggaagaggatgtcttatctatcagacatttttgtgcctttgaagccataaacttgagagaaacattagcttgttcctgaccctgcactcagcataagcatttgcttgtagcagtcactcttgggtgactataaattcacaaagtcaagaatttgcatcctgaattgatttgtgtaagatgtctaggggaatgctgattttatattggaaacaaggttagggggaagcctcaaaactgcctttatggagttctgtatctcagcatattataattcttacttctaccatactccagaggaatcagtctgggtgacttcataaaacagtattagaaaaattgctagcactacgaaatcaagcaggttatggcagtatattccttgtaagaaaattagtgcattaactctttccaataagtgattgaattagttttgcacataatctgatttatgaaatgctgcactcgcatgctcaagtagttagaaagtgtgtcgaagcagatgttgaactgaagaaagaaggttgcttgaaatgtaaaggtattataaaatggctaatctgtgggtatgacccaaagctttcagagatttcctggcttcactttttttttttcaatttaataaattttttttcttaaaaggtaaaattgccaatgagttaaatgttgatgctctgatgttagcaagactgagttcatatgtccatcgcttattaactccattttcttatcaatatgtttggcttctgtaagtcttattttcttgtttgtgaaaggaagatctaataatagaactggccttatagaattgttgtgaggattaaatgtggcaacccatggttattggtttcgtgcgatgcctgtcacaaagaaaaaacccaataagttgtagtggctatttttcatcttctcattatcaccattacttaagagagaggcaaagtgatagtatcatacaaacattttcatggagagttaaatgaacatctgttttttcttttcttcaattttttaaaaattatactttaagtcctgggggacatgtgcagaatatgcaggtttgttacataggtatacacgtgccatggtagtttgctgcactcaccaacctgtcatctacattaggtatttttcctaatgctatccctcccctagcctcccaccccctgacaggccctggtatgtgatgttcccccctccctgtgtccatgcgttctcattgttcaactcccacttatgagtgagaacatacggtgtttggttttctgttcctgtgttagtttgctgaaaatgatggtttccagcttcatccatgtccctgcaaaggatatgaactcatccttttttatggttgcatagtattccatggtgtatacgtgccacattttctttatccagtctatcactgattggcatttggattggttccaagtctttgctgttgtgaatagtgctgcaatagacatacatgtgcatgtgtctttatagcagaatgatttatacatacgtgtgcatgtgtctttatagtagaatgatttataatcctttgggtatacacccagtaatgggattgctggatcaattgtttttaaggacaggttgcataaaactgactaatgccattcatgacagtgagtttcaaaggcagatagctatcttagtccatttagggtgctctaacaaaatgccacaaagttaggtacattataaacaacagaaatgtatttgtcacggatctggaggctggggagtctgagatcaagaccctggcagatgtgatgtctggtgagagcttcttcctggttcatagatggcgacttccagttatgtccttacatggtggaaaggacaaggggtctttctgcgaccagtttttcaagagaattaatcccacttatgaggtctctgccatcatgacctaatcacttccccaaaactccacctcctgataccattacactggtgattagctttcaatatataaatttgggtggcggggtggggcacacacattcagatcatagcaatggcagctaggaggaagtaaattttgaatcctcatttccatgtaaagacttcatttgctttaaacaatttatttaacttttattgtgctttttctgaaaatgaaataacatttagctacacacagggagggtatgttgtttctaaagtaaaaattaactcttttgtaaatgtggcattgtttaataatagttcaccctgtccaatgatacttagcttttttatatatgtaaataaattattaggttactggtttttctttttcttttggtgggtggggggggtgttaagatcttattctcagtcctcaaaactctgttgaacagggaacatctgccctcattttcaaccttatttctttagtaccaattgcagccatgttataatctttgttttcatccaggtaaagctgagggaagggaaggagaatccactgagaaaaagattttccccaaagagtgactcagcctttgaaaagaaaatcagctatatgaaaagggaagagtatttaatcattcggagcaataattgcattgtaaatattagctcagctgataaggagtagagaaccaagagaatgagggagccgttacattgttttatcttgtttgatgcctttactcagtgctctagcatgggggccatgtctagggagggaatccactgcagctacatttaaggtcacctaataaaccgtgctgttttctttcttttcttctagactctattccttcattttttttttctgaactttaagcaaggaaactgccagtcatagagcatttccttatacacttccatgttactgttatgcagagaaatctgactggcaggctgatggccaggctgctctggaggaaagtaattagctatgtgactttatctaggccaaaaaaatgggataaaaaacatgcaaaaccattcacctatacagacctgttctcaaggcagtgtttaccctagtgcatctgctaattcctttcaagtctggaaaactgttttgtttgacatttttggaatgctgtgatctgaaccattagactatttttttctcctttaaggtactaatattctgatttttaaacaattaaatatgctctaaatttgtctcgcccacttctacatcttcttccaacatttacatagacatccatgcacattcatgcacaccacacaactacaagtcatttcagacaaatggtcttatctaattctttttagtgtttccattttattatttgtcaaattgaatggaacttccatgttttgccctgctgacatttaggcagacttgcataaaatacaagattatttctagctggataagaagctcagctatcagatagtgttgctgatttatacagtaggaggaaggagaaaagaccaatgggtgagtataataaatagaaacgtcctgaagcaattcacttgtagcctatccaaatcttgcaaactctgcataaaacatcctcccagttctctttcaatggaacaatttttcttttctttttctactcttcactgaacatttcctgtattctacatgcaacagtgcaccttttacattcgtttggcttatgtgctcttgcaataaccctttgctgtgtggtaatatctcatttgtgggaacttctgtgacactattaggggacagatacaatggctatgtgcctagcaatgccttcaccgtgctctatttaaatagattgctcatttatttgctactttgctcatcaccctgtctctcattcactataatatctttagcaaatcacatagtgccaggtaaataaatggtactcattcaatattgaccatatggatgaatctctgcttatgaaatatgagagccccgtgcagggtcattctgtccaggaactcatcttctctggcggtgtgagaccatatgtttaacatgaccagtaaggaagtagaaggaatcttccactactttttacattcttttttctttcaaaaagttttgtaaacttcaagtatgtaaaaaaacagttcttatatgttcatacagtttgctttcaacaataactccacacatgtgcattgacatgtaaagatgtttccagtataaagtagaaaaaaatgggttttaaacatcatatataaaattaatcaattttttaacatatagcatacctgtattcaggaacatgttctttggttattctcatttaaacagtcccctattgttgaatacttgatctgtttctattgtttcattttatatataatatatcctataccaaatatcctaatataacttctctgtgtgcttgtctaattattttgtttagataaaaggtttcatatggtgtccacttcatgccattatgtgatatgatttgcctctcagcctctaggaatgggtttttctctaaggatagtggctgccactctatctagtggctgaagtaatatggcttcatgtcatgtggctaacgattcatgccaaaggttgtccgcatcttatgtatcagtgagttatctgacacccctaatagacgcttatttcttttttcaaaaagcttgttcctgagctgaatttccatgatcagatggtggcaagagccaagtcttctcacataaagagaaatcacattgaatctgctacctacgaccactggccaaggggtcttgtcatcattgcattctggggaattggattcaatttaaaaagttgaagctgcttgctggcttccttcctggtagttttgaatgtgtaatctcacaaagatcttcttagctctggcaaagctgagcctgtctaaaacatttatgttagaatttacatgagttcatttgtgctggcgtcaaacatttcttgagtatttaccatgttattggctgatcttaaagccaagctacaaaggactagtaggggttagcaggcaggcaggaagaagaagggcatggttggcagagattgccacatgcacagaatatagtggtgaacctacatggtgcatttggaattgcaagtagtctggctttgctggaagtgggtttgcaagctgaggagtaacaagaaataaggccgaatagcataccaggaagtggtagatggcagagacccctggatcaccgtgatacttatgacactacttgctcacttgttttttggtttatttcctgataagctttgagccagaacattaatgcaaattcttgttcttgtgtaaaaattactgcaatgacttcccattgctcttggagaagacaaaatccttaatatggcctacaaggtccagtacaatctgtctcctgcctctgtagtcttattcttcactaggtctgccttcttcctcccagccctactggggcccattctctgggcttcaatattacagaccttactttaatttcactaatgggaaatgttgctgccttccaacaaagggcttttgcatgtgctgtttatatgaaatcctcttttcttcctgccactcttgcctattaatgttcttatttctcagcactcacgttatttttttactcagagaaatcttccctgagttccctgaccatgtcagatttttcacttatatgctgtcataacctcatgcatttctcttttacagtgctataaattgtcagtgacacatttgtgtaattaagtgatgaatgttcctttcttcctaataagtaacatcatctataccatcattattaaatcagccagcatcagctggggtacttatcatatgtcctatactgttctaaacacattatatgtattaattcacttaattctcataacagtccctattaaatggataacactgaggaataaaaaaagtaagtcacccaaagttacacagctgataggtgatgaagttagaattagaaatcaggggggaggagccaagatggctgaacaggaacagctctggtctacagctcccagcgggagcaacgcagaagatgggtgatttctgcatttccatctgaggtaccgagttcatctcactagggagtgcaagacagtgggcgcaggtcactgggtgcatgcaccgtgcgcgagccaaagcagggtgaggaattgcctcactcgggaagcgcaaggggtcagggagttccctttcctagtcaaagaaagtggtgacagacggcacctggaaaattgggtcactcccacctgaatactgtgcttttccgacgggcttaaaaaatggcgcaccaggagattatatccctcacctggctcggagggtcctacgcccacggagtctccctgattgctagcacagcagtctgagatcaaactgcaaggcagcagccagactgggggaggggcgcctgccattgcccaggcttgcttaggtaaacaaagcagccaggaagctccaactgggtggagcccaccacagctcaaggaggcctgcctgcctctgtaggctccacctctgggggcagggcacacacaaacaaaaagacagcagtaacctctgcagacttaagtatccctgtctgacagctttgaagagagcagtggttctcccagcacgcagctggagatctgagaacgggcagactgcctcctcaagtgggtccctgacccctgacccccgagcagcctaactgggaggcaccccccagcaggggcagactgacacctcacatggcagggtactccaacggacctgccgctgagggtcctgtctgttagatggaaaactaacaaacagaaaggacatccacaccaaaaacccatctgtacatcaccatcatcaaagaccaaaagtagataaaaccacaaagatggggaaaatacagagcagaaaaactggaaactcttaaaagcagagcgcctctcctcctccaaaggaatgcagttcctcaccagcaacggaacaaagctggacagagaatgactttgacgagctgagagaagaaagcttcagacaatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaacgcagaagcctcaggagccgatgcgatcaactggaagaaagggtatcagcaatggaagatgaaatgaatgaaatgaagtgagaagggaagtttagagaaaaaagaataaaaggaaacgagcaaagcctccaagaaatatgggactatgtgaaaagaccaaatctacgtctgattggtgtacctgaaagtgaccgggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcagatctctcagcagaaactctacaagccagaagagagtgggggccaatattcaacattcttaaagaaaagaactttcaacccagaatctcatatccagccaaactaagcttcataagtgaattagaaataaaatactttacagacaagcaaatgctgagagattttgtcaccaccaggcctgccctataagagctcctgaaggaagcgcttaacatggaaaggaacaaccgataccagccgctgcaaaatcatgccaaaaggtaaagaccatcgagactaggaagaaactgcatcaactaacgagcaaaataaccagctaacatcataacgacaggatcacattcacacataacaatattaactttaaatgtaaatggattaaattctccaattaaaagacacagactggcaaattggttaaagagtcaagacccatcagtgtgctgtattcaggaaacccatctcacatgcagagacacacataggctcaaaataaaaggatggaggaagatctaccaagcaaatggaaaacaaaaaaaggcaagggttgcaatcctagtctctgataaaagagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagattttaacaccccactgttaacattagacagatcaatgagacagaaagtcaacaaggatacccaggaattgaactcagctctgcaccaagcggacctaatagacatctccagaactctccaccccaaatcaacagactatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacatactagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctaccagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagagaaaaagagagaagaatcaaatagatgcaataaaaaatgataaagaagatatcaccaccgatcccacagaaatacaaactaccatcagagaatactacaaacacctctactcaaataaactagaaaatctagaagaaatggataaattccttgaaacatacactctcccaagactaaaccaggaagaaattgagtctctgaatagacgaataagaggagctgaaattgtggcaataatcaatagcttgccaaccaaaaagagtccaggaccagatggattcacagccgaattctaccagaggtacaaggaggaactggtaccattccttctgaaactattccaatcaatagaaaaagagggaatcctccctaactcattatatgaggacagcatcatcctgataccaaagccgggcagagacacaaccaaaaaagagaattttagaccagtatccttgatgaacattgatgcaagaatcctcagtaaaatactggcaaaccgactccagcagcacatcaaaaagcttatccaccatgatcaagtgggcttcatccctgggatgcaaggctggttcaatatacgcaaatcaatcaatgtaatccagcatataaacagaaccaaagacaaaaaccacatgattatctcaatagatgcagaaaaggcctttgacaaaattcaacagcccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttcagctgataagcaacttcagcaaagtctcaggatacaaaatcaatgtacaaaaatcacaagcattcttatacaccaacaacagacaaacagagagccaaatcatgagtgaactcccagtcacaattgcttcaaagagaataaaatacctaggaatccaccttacaagggatgtgaaggacctcttcaaggagaactacaaaccactgctcaagggaataaaagaggatacaaacaaatggaagaacattccatgctcatgggtaggaagaatcaatatcatgaaaatggccatactgcccaaggtaatttacagattcaatgccatccccatcaagttaccaatgactttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaagcaaaacagcatggtactggtaccaaaacagagatatagatcaatggaacagaacagagccctcagaaataatgccgcatatctacaactacctgatctttgacaaacctgagaaaaacaagtaatggggaaaggattccctatttaataaatggtgctgggaaaactggctagccatatgtagaaagctcaaactggatcccttccttacaccttatacaaaaatcaattcaatatggattagagtcttaaacgttagacctaaaaccataaaaaccctggaagaaaacctaggcattaccattcaggacataggcatgggcaaggacttcatgtctaaaacaccaaaagcaatggcaaccaaagccaaaattgacaaatgggatctaattaaactaaagagcttctgcacagcagaagaaactaccatcagagtgaacaggcaacctacaaaatgggagaaaattttcacaacctacttatctgacaaagggctaatatccagaatctacaatgaactcaaacaaatttacaagaaaaaaacatacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagataccatctcataccagttagaatggcaatcattaaaaagtcaggaaacaacaggtgctggagaagatgtggagaaataggaacacttttacactgttggtgggactgtaaactagttcaaccattgtggaagtcagtgtggcgattcctcagggatcaagaactagaaataccatttgacccagccatcccattactgggtatatacccaaaggactataaatcatgctgctataaagacacatgcacacgtatgtttattgcggcattattcacaacagcaaagacttggaaccaacccaaatgtccaccaatgatcgaccagattaagaaaatgtggcacatatacaccatggaatactatgcagccataaaaaaggatgagttcatgtcctttgtaggcacatggatgaaattggaaatcatcattctcagtaaactatcgcaagaacaaacaaccaaacaccgcatattctcactcataggtgggaattgaacaatgagaacacatggacacaggaaggggaacatcacactctggggactgttttggggtggggggaggggggagggatagcattgggatatatacctaatgctagacgatgagttagtgggcacagcacaccagcatggcacatgtatacatacgtaactaacctgcacaatgtgcacatgtaccctaaaacttagagtataataatgataaataaaataaaaataaataaaaataaaaaataaaaataaaaatacaaaaaaaaaaaaagaaatcaggcagactggatctggaatctgttctcttaacctctctctctgctcaccggtaggttatagacctaacataaagtagttgctcaataaatatttgttgaaagtataaatgaataaactaattaataaatactttatatgtgtcccactcttaactggggaaaattgggtgggtagatacaaaagaaccctagtagactgttcgctggcaggaatgtgttctagaggattggggaaagagaaacccccgaataactgtacgtgatttatgatgaaaatctttcaagtagtggaaagttataaaatgctaaccaaaagattagttatttggtttatatgttgatcactgtgatctttcccaatattgactggggtttgttgagtgtctgtaatcccacaggtggatgttcatgatctgaagtgacaatggtatatttgctcagcatttcctgtacctgaaacaacccttgaaaactgaaatagaaagagcaagtcaatggtaatatcatccagcactctgccaggcttatggcgaccttgcttacccgaaagcaaattacttccctctcatttctatataataagtactttacggctttgtgttttcatgcattgagatttccctaggagtctgagaagatgtccaggaataaaagagggaagaacaatgattaaactatttctaggactttagacattggattatattcagaaacccataatcagaccgttaatgaatgtcttcgcattcattatcagactctgaaaaagcatatccagtctctccatggactggccttcacatatgctttgctatctggtagaaatatctgcccaaaagattattttttatggaaataatagtgcacatgcagattctagatattattttctatttatcaactgcattcaggcagtgctaagtagatgactgatgctgaaattttactagatgatctttgctctctattttgttatatgacacatggggcaaatacgtgagatgagcaattagtgaaattctggaagggacagatttatgtcatactattgaaagggacaggaagtggattaagtatgatatatatatagtatgtgtgtgtgtgtaggtgtgtgtgtgtacgtataacaagttagtttccttttcctaccactgaaattgttaaatggaatggtgacgtagacactttacttctctactcctggacttactagtaaagaagaaatatataaaagagcaagatagtattgatctggggtggtactatggtatgtattaataccataccgtaattctatgatctattaatgtcacaaccagctacatttagctggcttttatatacgaatgtgcatagtactgttttgtattaaatatcaccagaagatatttgtcacataaaaacagtgagattaatgtttatatattttggcactcatgctagagttgaatgaggttctgtctgtggggataattctaggtatcctggaaaacctccacatatacaccaaacccagaatcaattcagataggcattactgttcgcagtcatctaatttcaagttagggtagtaggatatggattggggggcgtgattcttagtgccagagaaagattaaattattcatagggaaagatattcagcctaagatggataagactgaaatcaggtgcctggactctagaggattgggctctaaccgaaaaaaaaaaaaaaaaaaaaggagaatccagtaggaattcattgagtaagccaaggttacaatctgctggacttcagaggtagagttctagatgcccattttaccaccctaggtcagaagtggggagcagagagacagaaggctataagtgaggagacagtactgagacactaagtagacattctagccaactctgtagaggattctcatgttatgagctgaagtagaaaggctatgtttgaagattctgtctgattttgggcatcttggttctagatctatcataggtgcagattaaattgtttccaggctgtacttgatagttggtaaggatcaaacaataccctcacataacttgtcctagaactggttgtgctatggcatcattgtagtcccacatcctagcatggagcctaaaaaaaagtaggttcttcataaatagccaaggaatgaattaatgagtgatgggatgagtgtgagtggagaaataagcaaaattcctagaaatatggggtgggagtatggcagacaaacgttggcatcatccttcaaggaccagatcaaaatgccacatttccactacagctttctctgagttaattacttctctccactgttactatggtgatgtatttattctgctttaatagcatttatcaatcattttgtggttatattttatgatttctctcttcctcctagactatgaaatccttgactgtagaattgttggtttgtacctacattactgcagatagtatctggcaagggctgggctctcaataaatattgaccaaattgaggctgtaaagattccaatggaccaatatggcttgtgacccatgcttcatttacctaaatgaggccacaaggctctgtgatcacgtggcagtcaaataacaaaactctccaaaatcaggatttcttcttccattccttcaggttccctcccccatgggcatggttatctcatcctttacctcctggaaattatatattggaggttgtcagtgtgtgctgttctgtattgccctatagttaatgcacttctctgacgtagaggactgagctctctatagaactatgcagtgtcaaggaccctctgccttgacatagatgcttggaccacactgttaggtaactgagaagacaaagaatgtggctagaggctaaaagggacagagcaggaaaagcatgaagggcatgaaggaaggagcttgaatttttttcccaatgtactggggagcccaggagtggcatcactttgtactccagcagtgacattttaatttacaagccaagaatgcactgatcgccaactgcaaaaattgatttggttgttcatctgattcaacccatgtcagagtttgaaagtaattatgatagtggggctgataggcaggcaattacatttttgttctcttgctttctggctccttctccctctctttcccttcccacacctccacctgcaaggttgttcttgtcaggaaggcaatgtaagcaggagacgagagagtaatctttggagatgtggtatatggactcttgtggcagaggctataataaataatagtatggctggttctttatcctaatttttgttagcctcttatgaactctaaccagataaaagatgcaaactattttgtctccttctttaaagtacaaaatagaaaaagcacatgtactgtaaggcagtttctgtttctgatttaaatttgagttgtctttgcaacatctatagattcggtgtctttctaaaaaggtttgctccaaatcataatacaaaaggaacctgggatagggagagatttaggcaaagctaaaatccatctgagttggggagcagattccatgggagactgaaaatgtgtttcaaactgtagtgcaagaaattgaacaaagtattggaatttttctaaaaaaaaaaaaaggttcctttgctgaaagtagtacctggcatgtaaacctaaagtaatatagaagatgaagtggaaaagtatatcacaaggcaaaaattactttttagactgatgaagagatggatggatggatgtgaattttttttatctatttcttattttgaaggttatttatttattcacaaacactggaaaattcagtgtttttcactgagcaaaatagcttgtctggtccaaagccagtaaaataagaattttgtgggtggggtatctactccattagtatagcaaatgttgagatatataaattattttaatatatttattttattgacaatataaaaaaaaatttaacaggctccacaccaaggtcaatagaattcagaagcacatctgtcctcccaggaaacttgtggtttaactatttactatagctacctcaagattttacagaaaaaaaaaaaaatgagaccttctcttgaaaactaccatatcccagatctaggcttttctatgcactgtaacttctctataaacctcctttctactgactgccccacttcaatttggcacatacaccctttaaccagtaagcatgtgcatgtagtcagtgtgtcagacaggtttggctgaattgatataagactggtagcataggctgggcgtggtggctcacgcctgtaatcccaacactttgggaggccgaggcaggtggatcacgaggtcaggagtttgagaccagcccggccagcatggtgaaaccctgtctctactaaaaatacaaaaaattcactgggcatggtggtgcgcgcctgtaatcccaactactcaggaggctgaggcaggagaatcacttgaacccaggaggcggaggttgcagtgagctgagatcatgccactgcactccagcctgggcaatagagtgagactctgtctcaaaacaaaaaaacaaaacaaaacaaaacaaaaaaagatgagcagcatggaacatgatgttggcatgaggccctactacccggcagcagactatcagggaataaactagataaacctggaaaatgttttaacttcagtttattttattcacattaagtaatggagtagcatgttgtttgtttgtttgtttgttttacctctaaacctcctgtatagcccccttttaaaagaagggcaggggaagaggcttaaaatatggtagtattgactcccaggcctgttcagtctatacgaattttcaggctgtatagtttaaaaaaaacattgttcaatttcttatacgtttttactagtgatattactttagaaatgggcctcgaaagactcaggttacttttagatttgttcagggtttaaagcttcttttaggcacttcttgggcttcttctacctttcactgtaatatagtggtgaagagaaagactttggaatctgatagatttgggtcagaattgtagttttgccactcattacctttgggtaaccaagctctgtgaacctcagtctcttctgcaaaacagaaatggtgacatatttcctaagtctcttggcaggattaaatggaatacagtgcacaaaatactcagcacagtgcttggcacatagtaaatgccgaattaatggcaatgaattgttgttgttgttgttttctttttgagacagagttttgcttttgttgcccaggctagagtgcaatggctcaatcttggctcaccgcaacctctacctcctgggttcaagtgattctcctgcctcagcctctcgagtagctgggattacaaacatgggccacccatgcccggcttttttgtatttttagtagagacagggtttctccatgttggtcaggctggtctcgaactcccgacctcaggtgatccgcccacctcggcctcccaaagtgctgggattacaggcgtgagccaccatgcccggccaatcaattgttattgatttattactgagattgctttaaataaattcatccttatttctgttgtagtctttaccttgtctccagatctttggaagtctcaggttcatttgtctggactttgggggttttgtttaaaactgcctagtctctgcagccacatcctccaccactgtagcacatgatcaaaaaacttttctctgaggatactgagtatttcttagacctatgtcactagctccctgggaactctctctacccccatcccatcaactctctgaccacaagttttcaaggaatcttcctcattatactcatctatcattcttgcagttttctgtctcatcttgagctgttggtcaagagtagaccagagtatccatttctcaactcatttcttaataaggcaacaccatgttcaatgggcattcattgggccagttgaggctcctctgtaattttattttattttttgagacagagtcttgctctgttgtccaggctggagtgcagtggtgcaatctcagcttacagcaacttccgcctcctaggctcaagcaattctcctgcctcagcctcccaaagttctgggattacatgtgtgagccaccacgcccacccttctctataatttaaatgttatctctctttataacattttcataagaggatccacaattctattttcccattcacttataaagaacaaaaatatatccctaaggttccacaagtacctctggcctttggggaaaaaaaaaaaattcacagatgcttttttgaggaggtaattatttgtttgttgtgtccttgctattcattttgagatagatactcaagctctacacctcttagcttatataccagtttcaaatttatgtctttattatttattataaaatcttttaccagctgggcatggtggctcatgcctgtaatcccagcactttgagaggccgaggcaggcagatcacaaggtcaggagatcgagaccatcctggctaacacagtgaaacccggtctctactaaaaatacaaaaaaaaaacaaaattagccaggcgtggtggtgggtgcctgtaatcccagctacttaggaggctgaggcaggagaatggtgtgaacccgggaggcggagcttgcagtgagtcgagactgcgccactgcactccagcctgggcgacagagcgagactctgtccctaaataaataaataaataatctttaccttgaatattgagatgggttcaatacaatctcaatttagaatacttaaaagatgaaaagttccataaaataaattttctaatcaacagaaaacattttgttaagatgttgctgatgcaaataattctagcatgtatcactgttagttttctatctttgaaaactatcattcaactaccatcgtagttactagacttccattcaggatcttgcatgcctaagagtcatttcactgccaaaaatgaggaaatatagaaaactgagctgtgtttttatcatctaccatttcaaaaaaccctgtggaaaaaatatttcttttagcaaatctcagacattatcttgacttatatgtaagatgtacctctctctttaaatccaagtgcattgaaacttctggctcataaggtaatttttttttttaaataattaactaaacccttaaaactacatagaagtctactttgttttataaattaaccccattattttaggaattaatatagctttgtcttgtgagatgctgaagttatttttcctggttcttaatattcagtctttccgcttatctatttaattcctgatcactagccaaactatatactacagtttggttcatccaatttaaatagctggcctgtaactaagaaaagaaaaatatattttgtgaagaataggtatgaggtagagaaattagtggtagtatgatacgggaaaagagtaatgtcaaaatgcatggtaatttatgtgatatgccgaggactgcaagaagtcaagaaagaaacataacaagctaacagctgtcaccaacaaatagcaattaatttcagcattcattcccttgctcatgcttcatgaaagtatataggtaaacaggattcgtatcatgttctattttcttctctgggcctcaggcttccagccctctgagctactgtcttataacattctgaggatgtaagaaagaacttgatcctgttttctttttcagtctggagcagagacacggtgaagttcagtaaggtctgacacccattagcattttgtgtgactcaggatacgaatcaaacctactgttgtggaagcagctttccatataaatctaattcccaccaactcctgccaccaccaaagctaatagtcaagtgcttgtattgctgatagcaaaggtccaagattattcttattgttttactggggctacttatcaaaatctatttacttgtctattctatggatggggaggtggtaaagaaaaggcttaagtgtcctacagagattcattctatgctgcctcaaatgctttgaagcagtacaatttctcttttaactgcctcgatgtaggtgaagagtcttgcaggatatgttcactgctgaagagcaagcctgcctcattcataaccactagtagctgacaacctttggattctttccacagcttgaaaattcctccattccttgaaagcaccctgcactaatgctcgaagtattaagtgtgtttttatttcctagaaggatgcattttacacaagtcacttaaaagcttctggaagctttaattacaggttgactaatatttagaagaattgaaatacccctctctctcctctgtggtatgcatgagccagattctggttcattaaccagaagtctattacttttcccctatagtttcatggagtaaaatggtagatgcaaaccaagagaggtcaagggacctgagcttggttctgtctttgtcacaactaagagtctgaccttggatgagtcatggtaagactctgtgtcatatataaagagtattctgagagtaaaacacgcatacaaatgaaaagtatggttattatggtctcttgaatattcttagatcaatttcacccattggatggggctagtatatggttgatggatggtatttgtttcatttatctggcatgcatttaaatcttcaggtgcattaaacgaacaacacaaatttggtatatgattttcatgctctcttgcatgatagatataaaatcttaatcagtgattgtctggaaaccacagtctccaaaatgctgcctaggagtgctaaagagctgtcagatctaacttatatgagttgacaacatagagaagagaaagaagttgaattcagttaaacctggaaggagaaacccatagggtggaattatctgaatttgaatttttctgagttttattcccccctacattatgacacactaataagtggtctaccttgacccagagatacgaattttggcctcatttgtagaatagcacctggattcaggaataactccttgaagtgtcccccttaaatctctatgtggcattcaatgttcacttactcatagaccaaggagataaggacatttatcttctcaggtaaggtccctctgttgaacactgaaacaaaggggttacattaccactgcctatctttcagaaaaatgactgctgtgatagcataaatgtcccgagagctttgctttgatagaagtgtgtttttaatgatatgattttggtgtctggccctctgtggatagcttggcatgtgtcttgttctatttaaacagcactgactgataaagtggacgttaattggcagttagtgacgaggctgcaggtctttgttacccagcctttcagctaactgatcattaactaggaggaaatgtgtgacccagaaggtcattactgttattacgtgggaaaatacatttaaatgttacagattgcttttttatgaatcaggtgagcatttttagaaaagagagagcttgatttacaatggagtctgttttcagtcctgctcttttcctgtccctttgaagactaaacggtatatttctagattcccattgctgtattgcctagaacctcacaatgttgatattgactaaaaaacagaaatttcttcaactccattaagagcttttccaaaatcttaaaatttccaaataaaatcctttcgtctggatgccactcactttaacaagctttgagtaactttttttaatgaaaatgtgatagaaagtaatgtaactgcatatgttttattatgtaaaattctgatagtatcatgtatgtctttagaatttccgttgtcacacattgtctgtgctttgtaggattttgcagattaagccttagcactcattttgtgaggacagtgaatcctaattcctcttcttcattctttctgtgacctttttgattttgcctctttagtaatctcctcactgcccttgtaatgcaaaaaataagaataaaaatggtctgtttgggtgctgtgagtcttggcaattaaaacttcacatgaaatttgtctcctgagagaaaatattattctcccttttaataaaaggatacaattaaatactccctgaaacctctctccttcaaatatattgtcttatgtaaaagatggaaatggagccttgtttagctgaaaaactgaagagccaaaaacatttctaactataaattagtttatgcatattaaatatcccagccttagctctaataaaaacaaaaaaaatgtgaagcatggtgtgctctgtggttattaacctgttgttgaaaccctgacttcagttctaggcccttagcatgattacttctttccttctttgggttgcatgatgcttcaaggtctagaaatgccaatgtctttcccaaggggttttaccttttacctctgaagattgaagaaagcaactgagttgttcagaaatctctttaaattagatttaaaaggtactgggtttatttttgcatgtcttctttattttttcctccaaagattaagattgtattttagaaggctcttttggctcctttaaaaagaaagtttatccttgtatcatataggactgaaggagataggctgcagtttgaaggcaagagcatctgatctccaaagaatcagaaaatctcttcttttgttgcatttgtaggtactttttgttgtgttgcttttttttttttttttttttttttaatacaggtaaagttcaaacgagcacagcatggtccaaatggtgtttaaagctgtctaagtttcctttatgtaactttcacttcaacaagtatgttccagctgggagtctatcgggctgttaaaattaactttattcttcttttgttattctcatgcacacacacatacacacatgcctacatgcacatgtgcacacagacacacaggtgtgaacatgaccatttaatcacatccagcagggctgaatgtcactctgcggggctttattgactgttgtacaggctaaacatttcattcagttgcaagacagaaaaactctgcaggatgaatttcaaaacagagagcagaattgttacccacagataagaattctttgtaaggctttcaccttctcataaaagtgttagttaagaagaggtgaaaacaggtattccattcatctctgaagtgtatgcagtaatggcctcattcggctgagatttcccagcagcaaaaaatgtgcttggcagaacagttgctctaaatacctgggacatacattctttctaggattaaacaaataatacttgctgccctttgtataaaaagatcacttttctggtgcaccattagtgtacatttgatttgatttgtttgttaagcagcaaaggtgggtttccctggagccacttacacctcctctcggtcctctttgcctctggctgtatatgcatgttcattctaccacctgatgacttcatgcttactctgtgttctaactaaatcgaatgagtctcttattcccattccttcctttttactttcctgcctctaggcattaatttgtgccatttacctggactatctgctcccacctttgactattaatatcctatttattattctatcaaagccaaagaccatcatccccatgaattcctctgacatcccactcagaatctatctctctttcctcagagcacagttttttttctttttactatcatttaaggacagttaggccaaacacttacctacttaattataagcttcttgaggatttgggccacttcatatggcttttggttttccccaaagcattagctccaaaaagaaaggttgaatgaatgattggtgagtcatcaaccttggcatagttgggactaccctttgagaccactaaccagaatttttctcaatgaaatgaaatttattccccgacaaattgactgcaccatgttagtctccttaacatcatctgctgaaccatctcttaagaaacactttgatactagatggtaaataaccactgtgtcaagacctccaagtgccctttacctccaggtcacctgtgttcctgcagcaagacacacctctgtccccaccatgaggcagaatgaggcttgggacagataagacttccagaacccagctccagcactgtggccactgtctgattaatcagttcttcttctgcactgataattaaatactcactgttaaattttatattacccttgctagtatcattgttataaccaatgtgacagccacaaaagagaattaaagctatagactgtttatggactgtcttcacttcagcacagcagggaagaaaccagggatctgaataagtactagggatccttgctcattttcccaatttggctacaaaagttaatgaaattggggccaacgcttaaaatgcagatattgttatggatacattttatgatataaatagagatacacttgtttcatggaggggtaactagggacttagatttcatttggacctatgtgtgccgagcaattggaagcatattaaaactgttttatgtgtaagcatttattgcttttgcctataagatgttgcttatgtgggaaattaagagtccagtccaatgtattcctgggtatacagcttatgaaggcatttaaaacctaaagcatatttattctgcatttaaaagtgtttagagactgccttgtgtgttaatgtgtgctgtgcgactagcactatttaaatcctatccccctgcatgcattaatgtgtgcgtcgaagggaagaagagcaagggatgataaactctgttaactgcccaatgttcaactaagatttatgtaagaaagaacagtctagtgcattaatgtgaatattctaagatagatgtttatcttaatggactcagaggtacttacaaacagcataattgctgaagtcattttacagggcatttattcagagtgattacactactcttacttttctttacataaagaattccacttaagggtttaagtgagacaggctagtgtggccaaagaatcataggttcctcctatctgctgctcagcgctaaggctatttgaaaggaggagaagcaaaaccccaaatctccattttggcactttgcaagaaattggtccaaatgttcaatcactccagttttcagatctacatgatatttgacttactttaaacctatagtcctgcaaataagaaatttatctctctggtacatggttgtagaattcaaacattagttgtttatggacttttatggaccactgaggcattttctgtcttgaaagcaaatgtactcttccagagaaactcctgttctttttttaaagttttatttttaactgacaaattaataattgtatatataggtacgacgtgatgtttcaatgtctatattcattgtggaatgatcaacccaggataattaacatactcatcacctcaaattctttgtagcaagaacatttacaatttattcttttacatgaatgaattttaaaatatataattttgaaataggcaattcattattaactctagtcaccatgctgtgtaatagatcagaatctacttctcctgtctgaaactttgtagtcttcaaccaacatctcctcattccccattgacctttcctttctcagcctctgataaccaccactctactctctatttctgtgagtttgactttttagatttctacatacaggtgagatcatacgggatttgtctctctgtgcctggcttatttcacttagcataatgtcctttagctccatccacattgttccaagtagcagaatttcctgctttttaaaggctgaatattattccattgtgtgtgtgtatatatatatcacatttaaaaaattttattcatccattaatggaaaaccttcattcttgaaaaaatagcttataaagctatttatgtccctgatacctccaaagatcagaatgagtaataatctcacaaggatgggaaatacttcctctcttccaccttttgcatgtccatcctttgaacatgactcctggtgtgttagtctagtctgttctcatgctgctaataaagacatacctgagactggctaatttataaaggaaagaggtttaatggacttcacagctccacatgactgggggggcctcacaatcatggtggaagacagaagaagagcaaaggcacatcttacatggtggcaggcaagggagcatgttcaggggaactcccctttataaaaccatccgatctcatgaaacttattcactaccacaagaacagcatgggaaaaacccacccccatgattcaattacttcccaccgggttccctcccatgacacgtggggattatcgcaattcaaggtgagatttgggcaggacacagagccaaaccatatcacccgtcttacccaattctgttgaaataaacagacatttcctgagtacctgctatccattcaagttttttctatgagctaggctctggtccaggagtatagtaaccctacgggtgatttcagaccaataataagtaacactattaagaacacatcacagaagagtaacatctctgactcgctgatatccatttcaaaccacataacaatagcatgaagtagatgtcactgactcaaattaacagaagagaaaactagggtgcagtgtttgtgattaccttggactctcaccataatagactgagctcatgttttctgactcaaaacacaaaacttttcccttgatatagttgcctctagaagaagtcccttgtctccctcaaatagcaatcaagtagaagggaaaatagtgtaagtcaatatatattaagtactttcagtgtgattccaagaaactattgagttgcgatgctaaagggagcattttatttttcagccttgggatcagaaaaacattacataaagaagtgtttgggttggaccttaaaaaaaggtataccatttcagcaggtataaatggaatgaaatgcaaatagagttgggtaaggagcagtataagccaaaacataaagttatgaacttaatacccttgttcagagaattgaaaacatttaatagtcagtatgtggaggcatttatagggacaaatggtaatggaagatgatactacaaaattacactggagtccagaggtggaggatcttgaattttaattttttttaagtctagacttttgatagtgagataaatttgaaccaacagagtgaaacatgaaaactatatttttatcctggaagtactttctagagttcattaacaggaggaggtaagggtagacagggagtctgggtagggaattttaggattcatccacataagcaaccagggaagtaggaatgaaaactggagtaacattttagagatggctttgcaggacttggtgcctggaggtgtgacggggagcaggaaggatttgttacaggaaagaggtcccgacttagaccccaagagagggttcttggatctcacgcaagaaagaattcagggtgagttcacagggtacagtgaaagcaagtttcttaagaaagtaaaggaataaaagattggctacttcatagacagagcatccccaagggctgctagttgctcatttgtatggttcttgatgatatgctaaacaaggggtggattactcatgcctcccctttttagaccttatagggtaactactcttgtcccttgatgatatgctaaacaggccatggcatttgtgaactgttatgtcgctaatgagagtgtagcagtgaggatgaccagaggtcactctcatcgccatcttggttttgatagattttggctagcttctttactgcaacccgctttatcagcagggtctttatgacctgcatcttgtgctgacctcctatctcatcctgtgactcagaataccttaactatctgggaatgcagcccagtaggtctcagcctcattttacccagctcctattcaagatggagttgctctggttcaagcacctctgacagatttaaagatgaccctgagagtttgggcttgttcctagagagtaaggacaccatagacagaggccaggaaggcagcagagggaggagttaatcaattcagtctgggatatgctgactgctcatgtttccaagatatttaatcaaaaatattgtcccttatgtgttagtctatgttctattactataaaataaacttctgagactaaataatttatagagaaaagaggtttatttggctcacagtctgtaggctgtacaagcagtgccagcatctgcttggcttctggtaaggcctcaagaagctttcactcatggtgaatggcaaacagggagcaggcatgtcacatggtgagagagggagagagggagcaagggagacaggaggaggaggcgccacccttttttttattatttaattttttgagagggtggcacgatcatggctcactggagcctcaacctcccatgctcgagcaatcctgctgccttagcttcctgagtggctgggactacgggcctgcaccaccacacctaatgtttaatttttttttaattttttgttgagatgggatttcattattttccccaggctggtctcaaacttctgagttcaagtaatcctccctccttcatccccaaaagttctgtaattacaggcgtgggccactgtgtctggcccaggctctttttttttttttttttttttttgagacagagtctcgctctgtcacctaggctagagtgcagtggtgtgatctcagctcactgcaacctccgcctcccaggttcaagcgattctcctgcctcagccacccgagtatctgggattatagatgcatgccaccacacctggctaatttttgtgtttttagtagaggcagggtttcaccatcttggccaggtgggtcttgaactcctgacctcatgatccacccgccttggcctcccgatcttgtgatccacccgccttgacctcccaaagtgctgggattacaggcatgagccacctcacccggtccagctcagactcttttaaacaaccagatctcatgtgaactcattactatggggagggcaccaagccattcatgagggatccacccctctgagccaaacacctcccaccagccccacctccaacattagggattatatttcaatatgagatttggaggggacacacatccaagctgtggtgggcattgtaatcacggtggagctttcctcatcaggctgatacccaagtcccacccctgggtattgctagaatgtcacctggtgactaatgagtgccaaaggaggagaccaatcccgtggcgcccttgcatcctctctgcttgtggttgctctctctgtattgttctctctgttatgattggctctaacttccattaagagaaaacttgacctgcagtgactgaagacaggatacattttcttaaacaagaattccgaagtttagagaacataaaactgcttaatttggctcctataataggagccaaatttttattttataataaataattataataataattatatattgtaataattataattaattatatattgtaattataattaattatatattataataattataattaattatatataataaattattttattctaatttattttataattgtcaagtttaatatttgacaatatctgagtcagcttcccagttcttttcttggctttccccccaacttgccaccttatgggcacaagctgattgctgcagctccacatgtcccgtgcaaacccaaggaagaagggaaagcagtcagaccagccaagtctttttcgttttatcaagaatagaacaagcatttctagagcctctagaggatttccttgtttagctctttgtccagagctaccacatggccacttttagttgcaaaggaggcttggttaggccggtcacattgccagctctcgcaaggaggaagaggggaatggatattgacaatgtctgcaatagtcatcttccctgctacgctgaaagcactttaaaggcaaggaccaagctccgtcaggccatacttatgtccgtgctatgccacacttctcacctggcactttgctggacatatgaagacctgagatgagaagggtttgaggagacacttcctgcccactgtgctaagcactttcttgtgtcttttgggttctctgagcagctgtaggagtatagaagcctccagatatacgttaaactctttttcagcacctctcaaaacagaaaaaaaaagcaagaaaaagactacaagctgggaggaaatctatgctgctgtaaaaatagaatagggctggagtgcattcttcagtaatgaatgcatgaaaagcagcctcttcaattataaatgtggcttctcttgtttgttgcccagtaattctgttttattgatttctgtttacttccaatcacctcaaatgagactgtgttgcttagagatcttgatccctaaaagtttgtcattaaagctactctgctgtatttagttattttttgctcaaagcatttgaatcaatatgtatacaaacgaaacactttttcctttgctccctagaagactacaagaaaaaagaatctagaaaaactaaataaagatgcttagatttttttaaaaaaagtcccagcaaatgacatattgatttctttcaaagaggcagagtgtaaattaaaaatatttttctgacacagtttttaaagatgccactgactcagcagagtttgtgcttattgactttctcttcctagagggccagggtggaaaggccgcccacttttcctaagatcagctggctttcaaaatcctttgagggaagttagccttaaagccaatgcgagcaaaggttcttgattccctgtgatcaggtctgagttccggttttgtcatctaccacatcacttctgtgtataaaaaggtgttgtaatttttttttccagaaaattatatggtcatcattctttttcaaagtggttgcattaaaacccagaattctcagaggtggaaataaacaaaagctgcgcccttattagagaatactctctggaatgttattaaatgggtctgggcagatagagaggggagttagagtgggagcatgtgcattaaaagagccacaccaatacaggaatactagtgctgtttcctcctggtacctttgagagaataaagctagtttagacccacagtcggccgggcgcggtggctcaagcctgtaatcccagcactttgggaggccgaggcgggcggatcacgaggtcaggagatcgagaccatcctggctaacccggtgaaacaccatctctactaaaaatacaaaaaaaaatcagccgggcgccccagctattcgggagcctgaggcaggagaatggcgtgaacccgggaggcggagcttgcagtgagccgagatcaagccactgctctccagcctgggcgacagagcgagactccgtctcaaaaaaacaaaaacaaaaacaaaaacaaagacccacagtcatgaggctaggagggaagcacgagggacctggtttcaggaacataatctatttgtcataatttgagtttctgaaaccatgtcacactcctttggcctgttcaaaatcatttttcagaactgttctcagggttagctatataatttgtggaaaccaatgcaaaataaaactaagggcccccttgcccaaaaatccagaaaaaaaagtgttaaaagtgctagaatagaatttcttttctctttcttcaatagtctatttgttatgttttttatttgctattgaatgacatttaagtaaataaaaatgtaaattagcatgaatattaccattcgtccttatattgtgtgcaatgccagttttaaatccagatataagagcattcagctcaaatgcagaatcattgaaataacacaatttgtatgtcatagcccatatatgcatgtgtcttttgttcttattggaagagtggaaatgccatccaaaagtaacttactgctttttgtttcacttcttgatgcatgcacattctaccaacgctttttaacttcagcctaccgatgcatcaggtagaaccaaaaacaagaggtctcttgccctgtgcaagccaagcctttctgattagcaatcctagagagaacaggtggctcacgcctgtaatcccagcactttgggaggatgaggcaggtgaattacgaggtcaggagtttgagaccagcctagccaacatggtgaaaccccgtctctacaaaaaatacaaaaaattagcagggcgtggtggcaggcacctgtaatcccagctacttgggaggctgaggcagaagaattgcttgaacctgggaggcggaggttgcagtgagccaagatggtaccgctgcactccagcctgggcgacagagtgagactctgtctcaaaaacaaaaacaaacaaacaaacaaaaaaacaaaaaaaaaacaagaagaggtctccgggttgccctatctttccctttcatgtcatcgtctttactgtaaatggttggttgatacagagacttaagaaaggatgtgataggttctcctgaatgccattgccttctctctgtcttctaagcaacttctggttcaaagggagagcatgagctcctggggatgtcagtgttcctactcagcctgtagatataacatccttacctattatacagaggacacgatatagaatccggagagaggaaaagcaaaggaggccagctttggcctgagaacttaccctagtcactcttgcctagaagacagtaccaacctcccaaggagaaacattgggggataaattcaaataaagctgtttgattcagattactcctatatgtaagtgaatccacaggatcctgtgccattggggcatcaggaacactatatgaggatgagcagcaaggaatggaagtggacacacacattgcatgtatctcctctgcttgctttcatgccgcactgttccactgaacttcacttacaaaacacaagtgcaaagataaatgattaggaatttcaagatggtaagagcagagcatacaacctaacaaagggtctttgtgagcaaaaaaccctgtggatgacctcatggatctcatgcctgtgattacacctgctacatttccaacacccattttgacagcaaatgagtgttgctgtttatgaactggaacggggaaaattattagcctcactgtctatcagaaatgagaaacaattcatctcatctctttccacatagaagttctgttgtgtttgcttttgtaaattattttgaatcaatatctaagatgggtttatctatttactactaattgcagcctgggaataaggatgtgacttctggggttgagtgggcccatctgggtttctgaacttctcaatttaatagcacctgaagacattccctacctagagattttttatataaatcatagagctttatgggaacccatcctcccacatttctctgtgggaggttggtatttccttctaggcatgaatagggataaattctcaatcgaaagctgacctcctctgcatttttcctctactgggacttcataccatgttctcaaattgactctcatttttccttcatagttctgtctcaaacttactggccacagatcacttgtaactccctattttattaagtccagtttcaaataccaaaacttgctttaacttctgctattgctgtaacacctgtctctgacttttctaacattatattacatggctgagtgggatatactttttttttcacagtgtaataaggaaaagatagccttgtatttctagaagttgtattttatattcacttcattgcatttgattgttctggataagttttctgtgccacatactaagttttgggatgtactaacatgcactcttttcttgtgtttacatcttcttgagcttgcatctctttcttagagggaaggcatgagggaggaaaataagaagaaagaaagggaaaaagggagggaaaaaagtagatttggtctttggagcttcagttaaatttcccttataatggttagaccctaaatactcaaaatgagtatttgtggtgaaaacaaaagagctgacagtggaaacacagccaagcctttctaattagcaatcctagagaggacagcaccaataagaaagaagagcagccatcaaagccaggcctttatatgtatgtaatcaacaggcatctgatctagattcttaaagatggtgtggtttgggtgggtgattttatttattttatttttctgtctcctaaataatatgtaatttcttcaggccaagaaataaattgaaaggatttagagggatttgcttatcagtggaacaccacgtagcattacattcctcctgcttttgggaaggtacattgaagtttggttaatcttctgtggttcaatactcctcttccctctgtcagcctgccttgaacaacagattaatcccttttccacccactctcttctccttcctccctcccctctctcttgatctacccttccctttttgagcaaatagaagaaaaatcttaaaagtggggggaaaaaaaaattaaactgctgcactacatttatttatataatcctagaagacctcaagggtagaaataaaggatcccaatcctcggcacaaaatttggccaagcttagcttggtttttctactgttaattaaatcttgagtctgcaaagggatttccttaaagactaattcattagcaaaagttattataagtcacgtcattctttatcctgctctagtatatgcattgtggaaaagaagaaaaagaatatgctggctattgaggatgggtagaggttttagggagtgggtgatacgatttgcttgaattcctatgtagtctgctgtctttagtgacaatgaataattactgttgggtgacgcttatgagcccaacactaattttaagattttatagctaatgatttggcaactaatcagtgttttctggtttgacttggcttaaatctcagtagtctataaagtccatgaggacaaggaccaggtcagcctggtcccaagcacagtgattgactggcacatcataggcaattaataaacacttgtcaaggaaattagtgagtgaatgagtcaatgcaaatgtcagtacaaatgtaaataaaatcatatattcagaatatttttttaattcagttttagagagctctgttccaataacctaattttggtcagacagaatgcaatatctttagctcagggtgattctctttaaagctatctcatttcatggctatatgagcaagtaagttatgcatgtagtcatatcttggcaagtgattatcttcaggagtaggtagagggaagaggggaaagtaatagctggaagaacccatggcataaaccttgtaagacagttttaaaattcacagggtgttgttccaatcgaaatacttaagctcatagacataggatacaagggtcaccttagatagtatcttaacaagactagaattctgtcccttcacctccaacattcaggacctgcttcatgagatgcccccatctttcacacctgagtatgacaagttagagtcatttatgtttcatttgatcataacaatgtcagtggctttcaaaggtaactataaatgggatgtttaatcagaataaaataagagtataggtatgacagtcatacaatcttaccacactgtgaggttgtttctgtattgggcttaaattgagtgagtgagagggatgggggagagagggagataatggcttctaacaagcttgcccaagctctatgttttttctagttttgattacatataaaaatcattggcaagacatagtggctcatgcctgtagtcccagcactttgggagcccaaggtgggtgactcgcttcagcccaggggttagagaccagcctcggcaacatggcaaaaccctgtctctacaaaaaaataaaaataaataaattattcaggtgtggtggcgtgtacctatagtcctagatacctaggaggctgaggcaagaggatcacttaagcccaaggaggtcaaggctgcagtgagccatgattacgcccctgcactccagcctaggtgactgagagagaccctgtctcaaggaaaaaaaaaaaaaatcatccagttgtatgtgtgggtattagcactgatcaaagatgagactgtgatggccacaatttagtaaagaaaatcttaatagatacatttaaaaaaaaggtcaaacttttcaaatctcattaaaggttataggtttacttagagtcaataggtattaggtaattgaaaaactcaggcagcttgtatttaaatagagaatgaacattcataatgaagctagatgggtcctctctcatctgagatattcagagctccaactccatctcagaatgaaggtatagaggggaaagaactaaaacagcaaacatttaaaggaatttaattctttttagcgtggagcagctgcagagatgtatggctgttttctgtggggcttcagaatatttatgggcctttcccttttcctttttcaccggaagaaaggagatcatcattcttgagtgtgttatttataatttcataaagctgttctgtggcaggacttattttatctcatactaaatctcaaataactgtgcttccaaggagatgggtggggaaaattgattatccctcaaaatgattagcctattaccagtgtaagataaagagctgaagggtggaatttgaagttacaaaaggcagttgggcagtaaggaggggacagagtgaaacggtcttgagcagttctgatcacagctcacagcagtagacacttttctcatgcccaataatggattaataacgaagaacagtgtagaaccattgccaagaaagggtaaaacccttctgagtacataattagaagccaatgattatagaagcaataactcactggaggaaaatacgtcagatttgtgaaacttagggaattggaaggtaaatatacccataaatttacttgggtggacagagttctgagctttcttctgtcccagctttattctaaggtaatttcaataaacaatgttaggaggaaaaaaagaacataaatgcaataaaaaatcttccaggaaaggaatacatagggctcctgccagacagatattttattgaaagttattataatacctatctttagttttatgagtcctaacacagaacaaagtaatttcaacacgtggattaaaaatatgaaatacatattttaacatgtagtagtatgaattattgttttaaatataggacttggctaatatataggggcagaggaatatttttctccccttgagaaagcaagttaaggtgcttaatatgcattgtgaaactgcattgcagtcatactcatgcactatgttctataaaccatgtgtagtagcttccaaccaaatgggacagatgacactggtgagatgcagggagtggagaaaggagagaagtctgatagggcaggacatgaaattcatgctcagtatctaagttttcaagaacaacatagctcaagtagtggtcacactgtcattctagtccatcccttccctccagtcatcctctactactagtgggtgtataaataaaccgtgttttagacctctaagcctttgcaaatactatttcacctgaaatgcccttctccttctccagcccacccgtcctcacttccttcccctgtctcaccactgcctgtccctgagggctcatttcccacatgctctctgccttcttgctatttccttccttcacacattaatgcttcctcttgtcagagcattcggtttactacatcaagtttgcctgtttacttgcctgtctcatcagactgtgaattcccagagcagaggaactgtgtcttatctatagctttatcccttataactgttaaagtgcttgacatataggtgtttgaaaaagattcattaaagtaatgaatgaatgaaaaaagcaccttgatgacatataccactgacagtaaatctaacagcccagccactgtgaaaattatttggtgggtggtcatagagtttttaaaaaatgcttccttgaataacttatagagaatattggtatttgacataggggaaccatcatacgtcagcactttaagcatagccattgaaagttatgagagctttagacaatcattgtgaggggaaaaaatgtgaagatgacattgaacgcaacttgataaacattcccaacgtaactatgaatagaagagtttcctaaagcaacactgtttcctggaggagcgtggatggtggacagttaaaaataacaattcactacaagtgtttatacccttggttacagtgaatactaaattaatgtgaattaacagctcagcacaaagcctaaatgtagccagtgtttattaagtggtaaatgttattagtaggcatgagtctagatagtctagatatccatttctttgcaggcatactaactgctctttcttctaagtaattaaaagtaattacagacaatggttgtgattataggaaaatacacagacatgcagcctaaggctaccacattttattaaaaggcagagatccaccaatttgttctacttatagcaattctattctgagtctgagtctatctgcaacatgaaacctgttttacaagccatggaaagcaatcaaagaagtgtgccttttctttcaaggttcaacatcagatcctgcatttgcttacatctgaaaaagaacacagactgaaaaagccaaaacaacaacaacaacaaaaaactgctaaaagaaagccctgggttttctgaaagtatctttgaatccaattgccattaatttaggatatgatcttaagccgctcatatcatccaaaagccttggtttgtaatgtttggattttctagatgttagggacaaaagtagtttcaaaaaagtctaagtgtagcattcctaattctaagcctttttgcaaattaaggcctctggcagaggaagtctttccatactacacagtgttctgtggcaggtgtggccaatgttgcatgccaggttcttgaggaaaacattggttaccaaaacaggcaaagagggactgagatgtttgtaactgctttgggagtttcagttggctgtacctctaagtggtaacgatgaggtctgaaagacacaaaggaaggaactgaattcatataagacccacacagattgtctagattcacagccactgagaacagatcacctttgaatgattgtttaagctctttatgagtacatttttctttatcactcctcatggcaggtgcaaccagaaatagtatgtgtaccataaaatggaagtaatgaattgtcagcaacaaagaacacttctaatgtggggtaaatcgtaacaaatagagcacataggcagataccaaatttatttaaattaggagtggctatcaggcttggaattactttgattgagaggctgatgttgattaattgtgaagttaaactatgatgttgattaatagtgaagtaactaagtgacgtgtgtgcacgcacacacacacatcccaggtcactttctgaatctacgtagaggagttgggattcacagttgtgctatgtctagggccaggcccattcttacgacacactgctggatcatttccccttcaaactcctttgagtctgggcaccattgctaggagctactggtaaaatgtggttctgttgcctgggaagaacactgtattcacatgtactcatatagaagatcaacagaaaacaaatctttgggcaaagtggagcgcagagagggttaaaggtggaaaaagggggtcagaaggtgaaagatgatgtgtggggtctgcaatggggattaggggcccattcatgggatggaattggaggtagagaaggggtgggagagtggggctggggatggtgtcacctaaaccacaggggagagaaacttagtagtatgagaggaagccaaggaagctgagaggaagacagtatcttttcaacctcagagtctactcctttttctgaaaaaaaaaaaaaaaattacatttcttcttttggcccatgcaaatgaagaagtctcctctgagttaaagattcaactaatattatgttaatgtatgttttggtttctactgaagttatgcattgttttttaaacatttgttcaatggcctttaaactttattgccaggctttcagttcttgaaaggagctcattagattttcattaactcaccagctttcactcaatactagggaccaaagtcctaccgggccattctgcaaggcccttacagtcaaatcattaataatttccagttgaacacacttcagcagtgtattctcagcctctttattaccaccatcctaaggagttttttcagataagttttccccctaattgcccttttcccacaacatttcaattccaaagatatactacatattcatttatgtaactgtggccttttggagggtcacaaaccattgtaatatttaagattgtccctcagcccaaaccaaactttcctgcctttggtgggagacattgcccctataaagaatgcatgcttaaaaactactaaacaatgattgtggtccttccaaaatagtgttttcctcttataattgccgtatttatttcaacagttaactcttttcccacttaccagctcctttccctaagtaactagaagtagagctattatagggccccctctcagcaggaaacaccaagggaatatgcttaccatgtctctaacacaaataacagccccccaggatgtaactaccagtttcagttgctggaactgaaatgaacaattcagtagtgtgtgttttttttaagtatgtttaaaaattcttttttcggtgtggagaaggagagcatcaggataaacagctgatacacgcggggcttaatacctaggtgatgggctgataggcgcagcaaaccaccatcgcacccatttacctatgtaacaaacctgcacgttttgcacatgtatcctggaactttaataaaattaaaaaaataaaaattctttttttctgctagccttgaggagcaaggtttgaattatacccctttcagatgtagaataaagatcaatattgttgtgtagggcacttctctgccattgttaattaaatcaatgaattatctaatgtggtttttccagttctttgctgtgtccagtaattccatacctaggatgtctatttaaaaaaaggatgttttctggaactcctaagtagaaaggctgtcatatatattcatttattagggttgtcataacaaaatatcccagaccaggtggcttagacaatagaaatttatttcctcgaaattctggaggctagaagcctgaaatcaaggtgtcagcagaattagtgtcttctgagaactctccccttggcttgcagatgactatctgccagcgtctttatatggccttcctcccactgggtatgtctgcgtcctactgtcctctttttagagggacacaagtcatattggattagggctcatcctaatgcttcattttaacttcattacctctttaaggctttgtatcaaatacagtcacattctgaggggctggggagtaggacttcaacatatgaattttgaggggacataattctgtccataatgtaagaccaggtataaagaagcctattgcaagccacaaacacagaatttgactaagatgtatttattcaaattcccactatgtgttttactagctgtatgtctttcagcagctcacttaacctaactgcaattctaattagtcatgtaatagtcatccctgtcccaaaagacggttgtgagaatcacgtctaattaataactgtaactaaaaagtgtgtgtgtatatatatatatgtatatatatatatgtgtgtgtatatatatatgtatatatatatacatatatatgtatgtatgtatgtgtatatatatatgtatgtatgtatgtatatgtatgtctaggacagcatctggcttgtagtaattgctcaatagaaggggagtggtttattacctcttcctcttgaatttggatccagactttagtacatttgggaattggaagatcaacaagtcagtaaatattggtcacatgaagaaggggaaataaatgagcattattgaactataatatattgagtcttcttatgcacatagtaggccaaaagttttgttttttgcataagatctgtagattcattcattcaatatttattgtgcatgcaatatgtaccaaatacagaaagcagtcatctcacctactgtatggagggctcttctcacagctgatactcagtctcctatatttcttgtaatagattccctgggactggggagtttctgcgagactcagaatttaaaaggtgcctcaagtcgaactactattattgcagtcagaactgtttttgctctcttcaggaacagccttacctgtgttcagggactattgtgtggtatcatgctactggtctacattaccaattcagctattgcagcaattacatgaaggaattcttgctaatgataaaagccattatgcagttcctaaagagaatgcattccacagcattcattaattatgccagcctgtagatgcacaactaccacggcatacacttgagaccacacaccataaggattgaaactctctcaaagccacaatgtatgtctgtgttgctttgcactcttacattgcccatcctttacaacagcccttctcctgtccttctgattcctaaaactcaaaaccagaatgaagtaaggctacaaaatgtcatttatggggatgggtgaggcttaagtctcctggaaccatcttgggtcactcagctctacggaagacccccctaagacggtctagacccagagtcattctcagtcacacagtagttaagaattcttcatcctacggtatgccctctctagaaaaataatcgtaatgatgggagatgggacacagtgataaatctttgatgtctttgttcattagtttccttatctctctctcttctctctcttcccctaccccattattttctctttgacataaacagccaacatcagatgatcttgtttcatctgctgaatgttcaagtgatgatgaagactttgttgaatgtgagccgagtacaggtaggtcaggtcagtcttattttgcttgctttcttttttcttttgcaaaaaacaatacatacatatatgtgattatacatgtgttttatatatagattatagtgtgttaatgtgtgtatatttttatatctatatatgtataagtatacatatataaatattatatcaatgaaagcatcaaatcccatggaaagagcaataagatcctacaaaaattaagtcagtctcttgatagctaacaaaaaatcatggtatatgacttaacattgggcaagcagatgcccagacttaccactggagcagcaaatgtgtaggagccagtggcagctatgaaattcacagagggtgggaacatgaggaaatatatgttggaatgacatcaagaaaggatgaacccatggaggagcttaaagattggtaagtggagccataaagattggtaaatgacttaaaactcatgaattattctgagctaagagaaccaaaaatatatgtatatatatattttccatgggatttcaacagcagttaacatggtattatctttgtactaattttgttaactgtgtgtctagaaaacttgtgcaacaatatagtaaacacaaaattagtgctgtaccatgccgtgtcaacagctgtgatgcttcaaaatgtatctactgtgctgaagttgagaagactttagcaatcagaagcttcaatgtgttccccatttggacccagatacattttgatgttttatggtctttctttatagtgagctacatatgacctaatgtccagcaggcaattgcagtccctgattatttcctatcaacttttcccagttgtctgttttgagacttactataagttaaacgtttatatgtatataatagagaacagatatcatcgaatttctgtgtatgtttaatagaattaatagctggagttgggccaggatcttatttctgtgaagactaaaataaatagaattttctagttattttttgcattgctttcagatttttttccttttaagaaaaggaaagccattaaaaattctcttttgctaattctagaaaatttaagcttcatgaaaaaataatctaataaaaataaaaaccttccatttctgacccctaaatgatttacaagatttcaaatctgttgaagcctgactgctttggtttcttgcaagtggaattggatccaggaagttctgtgggttcatacccttagtatgacacagggacacatcattaatatgatagggcttccattctggagtgtaatctgttccattgggagctcagctgtgtggagggaaagtaaatgtgatctggtcagggctttctttttcatatttttaggtaataatctgtatgtgctatgtgaggttttaaccctaaaagggcagatacatccgaactataccagaacttgggtgccatgttttcattaatttattcattcattcattcaataaatatttttgagcactcaggcaggatacaatatatctctagatttgagtccttcctattctgttttttttttttaagaaattagctgtcagagaatagaatagttttgctatctaactcctcgcgtaattcaattcaacagatatttttgagagtcaactgtatatgttaagcatgtgctagatattaagggttcatatattaataggtcacaatcctcaatacgtacattaaattagcttgttttgtggcaaaccctttaagaaatctaggctttaattttatatatatatatatatatatatatttttttttttttttttttttttttttttttttgagatagggtctcactctgtcacctaggctggagtgcagtggcgtgtttatagctcgctgcagccttaaactcccgggctcaagtggtcctcctgcctgagcttcccaagtagctagaactacatgcaccactatgccagctaatttgttttattttgtgtacaaatgcggttctcaccatgttgctcaggctggtctcgagttccaggcctcaagaaatcctctcgctttgacctcccaaatgtttttcttcctttcttagcagtgatatctctatatgcagcaatgtttatcaaatctgtagattttaaggcttatcaaaattgaggcttggtcattctgaaatattatcaccatctttcctcaactactcaccctgcctcagaaagtcatctccacagcaacattcataataaggcagtgggcttttccagatctcagcttcagattctctagctctgtagctccccagtttatgggtatatattgctatttgttatgagacttgaatagcgtaaacctgaatggccccaaactaaatccatttgttttctagaggccacgcaggtattttctctgattcagaagcagaggacagaaattcaacaccaacatttcttgaataacatggggtgggtggggagatacagtttttagaacaatctgttgtgttctgtaagggagcatgagaggagataaagtgagtgacagaacccctacctttaaagagtgaacatgtagctctaggaggctgatattgatttcctccacctgtgattattcaactcatcacatttgaagaatgagcattgcatttttctaattttatttactccataaagtattcctggtgagtgatttggatatacagggaaatacgtcagtggtatatttaatacaagaagtaggtagatattcctagtaatgcagagagagaagaggtttgcccagaggacctgatttccactaatggggattacctgcttagagctatcaagccctctttttcattacataagaaatatctcctcagaagttcaagaccagcctggccaagagggtgaaaccccgtctctactaataatacaaaaaattagccaggcgtggtggcaggcgcctgtagtcccagctactcgggaggctgaggtagagaagtgcttgaacccgggaggcagaggttgcagggagccaagatcatgccactgctctccagcttgggcaacagagtgagactctctctcaattaaaaaaaaaaaaaaaatatatatatatatatatatgtatgtatgtatgtatgtatctcaggcttcacattttccaaaaacaatacagattaaaatcagaaatcagtttcttgggcaagatttgcactgcctaaagagaagggacctactgcccatgcagcaacagataatggtgacatttacacatctttgacataaattgccaatcttgcaattctacattaccactaagattaaaattctggttttgaacaccctaattcactgcctccatttctaaaacatttttccaggccttttgcttgatggaaatacactaaatttggctaacttccttggccttgttctatcatacttactactttatcttctttcactttgccagcgagtttattattttctagctgtctccgtttatgaggcatttaacttctacaggttatttcctgattaatttacatccatttgaagctctcacttttcataaatttgggtagtttagtgtgtgctataattcaatttttattttcatatgagcatcaaattttaaatgaaataatttattttttcttcaaatcacattggatttttaaactgctggttttgagttagttataagcaatcgcctttcactctcagaacttacttttgtgcttaagggtcaccacggtttggtatagcttaatcttattatatttaggaacaaggtaaatatttttggagtttggtcaataggagtctagaaaccttgcaaatccaatggaagtcaagttttcacggtatatttttgctggtaaatatgtagagaaatttaaagaaatcccaaatcatgagagcaaggcataaagtaaaagctcaattaggatttgtcgactaaattagtttgaaacagaactttatatctctaacttcatttcccctttaacagctaaaattaaacctattgactcatttaaaatttatgatttcatataatagggctgccctgacaaaatctatatttttaacaaatttgttttagaatttttatttctttattttgagactgggtaacaagactggctaacttttgtatttttggtagagacagggtttcgccatgttggccaggctggtctcaaactcctgggctcaagtgatccatccacttcagtctcccaaagtgctgggattacaagcataagccactgtgcctggccaaaacctacatttttttttaacaaagttattctctgctttttcctatccctacctttttctgggaactagattattttataagtcacagatacaatcacattttctgaatatttgcttcaagaacccagaattgaacctttaaacaataaagttataataaaaccatctgcatcaaatgaagatattcagaagtgtatctgaatagctatctagaggcgagggtctggattttaactcgatttgtaaatgttaattgtgttcttcacaaaacaaatcagtatctaatactttagattcgttctttgcatataaactgtttcattcccaactgcacttctattaatcttaaattgtgcagtaaattcatatttcattgtcctttttctctttgaatccaagaagaaaaacggatgagctggagagcattcaaataacccctaggaaaaggataccctcatgagattatggaagccaaatagcaattaagatcattagtaaattcacatttgtaatctaaaatgtgggaatgaattctgaaattcagagaaaataatacaattcacttcccatttcttctctttcccttacccctgctgctatccctagaattcccatctttggaaatagagtaatagtgaaaacaaatgtattcttggatgagcttttgtataattagatatgatcaacttcctggattttacatttttatagtttcaagattctaaaagtcttgggggcaggaggccacagagcagagcgaaaaaaaaaagtaatacttttatacctaataagtgggcatggcaatacttaaccacattgattcatccagtcgttatccaggggtatatttttcagtttgtcaagtagctagtttttctgccttcacttttcttaaatgtcctttgatcaaatctcaagggacagcacttccaccagagggcagacagtaaaaggaagtgaagatgaaacacatccatccatcaataagactgtgctaagcagctttcataatggttgggaaggagatgtttaaactaatggcagtaatatgagatgacaaaataattgctattcccagagtggttctcaggtatatttttactcctcaaatctacaatattcacatttgcatttcggtgttactgctacttagttcctctttgttagccctactataatatacaacccaagctgagtgaaatttaaatttggcataacaccaagatcacatctagtattttccaggtggaactggattcttaatctttatcagtctgagatgcctcgggaaagtatcatctgaaaatctggcactgagttactaaaagctcaccaaatcattttactttttatttgctggaacatggtagaaaatgcagctgaaatgttaatagataataataattttccagtgaaggatcaagagaagtttataccagaatttatagataacaagtaaatgtgctgattgttggccttaaatatgatgtttgaaatcttatagagatacgttttgtcatttgtgtctttgtcaagtttgaagttagcaacctgtatgtttttattacaaataagtcaattttatttaactatttattcactttagatttttctatatgaaaactcattagcaaatagaatcatgttaaaatttcattagtcaatggctattcagaatatagtacaaaaataaatgtccaagtaaaatctcataggaatgttggagtatgacagatctataaattcaatggtctgtaaatgctataaattctgataaaaggctcagatccacttaaacactttgaccaaagagataatggaaataatctaagataagcattttagctttggaaagagaactgtatatcgatagaaaattacttaatttaattcattattattggctgtggacatcagtcattttaaaatttgagttacaatacatgtctaatgctcacaaaagcaaatagttgttcacatacttaggtctaggctaaatcatatccatttttcaaccgccttcattgatctataaatgaatatagtatgttcatgggagtataatgttccagattaatgatacagtttttgtctttgttaacccaccaagttatttcactttcttttcttttttcttttttcttttttttttttttttttgagatggagtgtcactctgtcgcccaggctggagtgcaatggcatgatctcggctcactgcaagctccgcctcgtgggttcacgccattgtcctgcctcagtctcctgagtagctgggactacagacgcccgccaccacgcccggctaatttttttctatttttagtagagacgggttttcaccatgttagccaggatggtctcaatctcctgacctcgtgatccacccacctcagcctcccacagtgctgggattacagccgtgagccaccgcgcccggccagttatgtcacttttttataacagccccaacccaacccaagttattttttaaaccattgcagtaactatgtgcttttaaaatccttaatggtgaaatgctttgaaaattagggtaagaacagaaatataagaataggaaagatctactaattagctcttgcactttaggctgaggaatagtgtgcataatatatgtggcccatagatcgactattgtggatttcataacaaatatatttaataataaaaaaatgaaaaaaattctatccaactccattacccaagattttttagtaggttggagagcgaggcaggggaatccataaaatcaatgtatgagtgtatatacttctatctgaaagtttgataaatctcttctatatgtaacacttttgagtaactattacatgtaggcactagaataggtgctgggaaaacaaaagtattttgcttcagaaatatcgcttccagaagttcagtttattaggaaaggcagatataataagaggaataaaaggaagggaagaaacaatgaggacaatgaatggaaatgcccacgatattatcagcaccctaaggatgttggagcactccaattcagtgaacagcataccttatcagggatatgcaagaaaaaaaaaatcacacaagatgatgccaagcagtgacagattcaactaaccccaaggagcattcttctgtattttagtttggtgacacagaattctcatttattacgattgaagaattagtacagttcagtaaagtaaaaaagcaacactcttttggaattagtacagctcagtaaagaaaaaaagcaacactcttttggggacttcacatatacagtatggtcaaaggccacaccgtttttaggtaatagggtaaaggatggacatgttgaagggagaatttcaatctgaactcatgagaacttcctgattccaaatgccaatgcaagtggtacataaggagtgagcttaatgacatcattaagcaagtcccccaaaaataaataaagagggattgggttttaaaagagaagtttttatgggatttattctttttattctacatttttcttccataagccccaagtatatgtactgtgtgtatatatatatatatgatatgcacatatgcaaataatatactgcctgtcactccatatatatgtagacacagtataagtgatattagactaatgtaaccagagattaacagcccctaccatcagtcatgtgtttacacagaaattcacaccatcattcttaaccagcatcagccaacatagacatgcatgatactgttttaacttggcaaacaaagcatgttgatttttctttaagatttctttatcataattataatgctgactccataattcagttatccttgggaggggtggaaagaaaaaattatacagatatatctatccgtatatgcacattcctgtgtatatatataaatagatatataccttgtatatatttgaagaacattttgttgtttcacctcatcttgtgccgcatgaatttttggtggttcaatttattttgttttcatatttactattttgatcattatggctatttttaactcattgctatacttttatgagtaactataatcattattttcaaatactgagagatatatagatatacaaatcaaacaaggcaaaaaaatcttttcttgccatcctaatctcaaattcctcccctttcagcatatccctccagtatttatctcaaaacaaaacaaaccccaacgaaatccaagaaagttgtgtacaaaagaatgaatactgtgttttcctcttcctccttctatgcatatttttccttttaatttccgtttctttccttttgatttacccccatatctgcatggaccacttgcctttactttcccctttatgacaatgtaattaattgaaaagataagagtcagaaaaaaataaaagaaaaacacatagaaatgacagagaaacacacccctctccacaaatttcagatggcataaaaagaattttattgcagatatagaatatttgttgtatcttttatttctgtctggacaagcccaggatcattgtgtggcatgccgtgacaagttttgtagcgcatcaactaaccatggcctccatcacaagtgcatgacaccatcttgtgtttcatccaagtgacacatctaggctaacccagcaagtccagtgtatgagttgtgggaattacattcttttgtagttataatttcatgggtccttgtttttattattatttccattggatcatgacagccctaagagctgctctcgcagcatctctgtatggttttgttcttgtgttttcttttcttggcacagcagtcaagcatgtgtctcttgtttggcacatctgtcttgccatcttgtcttgtccactgtcgtggtgttgttctgtgattctgttctctgtaagatgtgatttgaaatcctctgcctttatttctcactctcctattgtctctacttttaaccttacccctagggaacttcacaaagaagcaaaacaaactttcagtcacattataaggctgatcactggtttgcatctggaagtcataagttgtactttttacctgacttaaggaggaaaaacttacagtgggaaactactgataattatactcaaacagcaaactgatcaacgacaataagaaacccttgttgattatttttggtatgattaaatgggcttactgttaaagggacttcatgtaagatcttatttccaaagagtttttttcataaattatcagtcttctagtcagaaacttttcttcaggagcagatcaacggaagatgtttttcgggaattgttagtgagggagcatcatttctgctgtgtagaacagtgcctgttcctgaattggggaggaactttatggaaatctgcaaatgttttattacaaaatgcatttatgtttatgtattaaaatataaatgtgttcagcaaggcatctgaggatgggaaaaaaaaactttttaactcactggttccacctcatgcatattttgaggtaagattatcttttgatctttctgagtcaactgatatacattttacttttttattttttaattcatggaagcattagagagccaacacttcaactttgacctaaattcattcttttcccattccagagaacacgacatacataatagctttagttctgagaatagagtctgaatttgagacaaacgtagaaggaagtgcccagttaattatccaaatgttggactctacctgtgattatccaggcgatttgatgctttacttggaaggatttgattagttggatacgaacagcatgaaaatgacactttgtaacaactttccctctttaagggttgagcacgagaatatcaaataggtataaaaatgagtaataggtgatatattaatagattaaagattattcaataggcctaaagatttcagatgaaaaatctgtatttgtaatctgaaaaagagaaagcatatccagacctgtggttttctgatgagatctttcagtcaggccagggtagctattggtttttcttaagggtaaggggaaaaaggccaaggatgaggaactggatggctctgtggactaagaacaactttctgatgaaagaaggaagggaaacaagaaaggcgaagaaagaggaggagggaaatgtaaaagaaaggaaggaggaaaggaagagatattgattatgagccaggtaaagctgcttgctgataaatattttaaaaccagcacacacacagagctctaatttgcagttttccagtttctgtatggtgtaaaatattcccaccatggctgatttctagctaccaatatgacagccctaaactcagaattgggaagtgtccttgctcgtacacaattatatggctttttcatcatacgtacactatagacgtcaagaacctcatagataatagtaaaatttagtaaaataattaggaagtaccgagttttaagtttttaattacctgtttttaatatacttgtaactttatatatatattaacttttgaaaatggccatgttttaacaaccagcttacaaatttcctagaaattttgcaatcagttgtcataaactggctcaagcacaccactagcccaggtactatactgggtacatgaaaacatagtattttatttaaatctcattttaagttattgtgagataaaaactagcttggtcatcttacagttgagaaaattgggattttaagtttgcttgttcaaggtcacatacctgcacataaatggtagaggtaatattcaagtccaaatctgtttgaaaatagacattttctttatattacagtgtgccagtcattctttcaacacttctcaaagtactaagttatcgaattttgacacgctcctttgtggagcttagcatgactcgggtttccctattgcctcaaggaggtccttggctttaactgtcttagataaaatggagtttaaatgtattatggttgtgtcaatggcaaaatgaagacagtgaagcaaaattagaactcctgattactctgtttgtaaatgccaccaaagttatgaccatgtcttcatgagaatgtccactttgactaattttgtttcctccaaatattcctcttttactaacattgacaatgaacaggatatttcttaggttttcatattctgtcccttgagctttggaaagactatcccagatacattttctgagcacatagaatctatagcatgatcccattacatagttaggttttataacttttaaactctaatgaattttatttagttacagtatgtaatgcatgttaattaaccaactgcacagtgaaatatgtcaatgtcctttgcttccacattttctaatagagtaagctagtatattaacatttaaaacagcatgagaaccatagtactgcagaaagcaactgcagtttttaaaaagatgattttattgtaagatacttaatcattgctctgtaaaagagtttgagaggcctgggaattaaaaaggaaagtgttgcagctttttagtccttctaatttgacaagatagataatttgattgggtttctgatagtgcagtattttgctttaatttggtgtgaagtttagttgcccccataattattattatttttttttggtcactctgtcacccatgctggaatttagtggcatgatctcagctcactacaacctccacctcccggattcaagcaattctcctgcctcagcctcctgagtatctgggactacaggcgtgtgccaccatacccagctaatttttgtatttttagtagagacggggttttaccatgttggccaggctggtcttgaactcctggcctcaagtgatctgcctgccttggcctcccgaagttctgggattacaggtatgagccaccgttccgggcctccctatatagtaaactttcgatggcagcatacacaacattgaataaagtcctttgaagtgacttctaggctttctcctataggtttgccactgctacaactttgtttcatcattcagtgaatattagcacttcctttagtgaaatatagtcttaagtacttcacattgttaactactttaatcctcacagcaatcatgtgagagtctattcttattatctccattttaaagataagtaaatggaggcacagaggagctaagcaaattatcaaggtcacacagcaaggaagtagaagaaatgggatctgaacccaagccaactgcccccagcgtggacacccatcactatgctatcctgtctcttacgtagcgcttattttccattaacctaaatatacgaaatagctgccggcctccttgataataaaagaaagtctgtgtattgaatgtattacatggttgggaagtagttgataaatgggttagttattatgtatcaaaaaggctttaacaatcttggttgatgggggttataaaattgttccattatgatttattcaaataaccgtggttaaaacaagttaccctggtttcccataaggaggaatgactccaatattggagagaaataccaacacttatgtgaggtgagtctcccttgatgtcacctatgcaataatatgtgcacttgggtttttttttttttttttttttttttttgagacggagtctcgctgtcacccaggctggagtgcagtggcgcgatctcggctcactgcaagctccgcctcccgggttcacgccattctcctgcctcagcctcccgagtagctgggactacaggtgcccgccaccacgcctggctaattttttgtgtttttagtagagacggggtttcaccgtggtagccaggatggtcatgatctcctgacctcgtgatccgcccgcctcggcctcccaaagtgctgggattacaggcgtgagccaccgcgcccggccgcacttggggtttctagctcattattcatgatcaattctgttcaaaacatatgcccagacaacagccacctttaactgatgttaggaatctaaggatagaggctcttagcgagagcttgggttaagatactgcattttctttatttcagaaataaatatgttccttagaacacagtgatttaggtgttacagctaaaagaaagcaaaaaacaacaacaacaacaaaacgaacttgtatttcttatcttagaccctttctgacacccacatgctcttgacatctcttaaagttgtaactatttgtttatcctccctttttcctcacttccttgcattatgcatccaaaactattttaaaagccaaaacacacacacactttttgtgggtctttgagtttcctatgcaagaaaagaatcttaaaatgagttataaagaactaaaaatcacaattaaaaaggaaacataattttaaaactgtgtttgcttgtattataatccttattccaaggcaagtatggcctgcacaaacatctgaggattccattacaaattatatcagtctcaacccatcccgaatccagatcataaactcataaactggaaaatgtgtatagttgaaaatgtttgcataccctctgtcctagagcagtgcttccatcttagctttgaagcacagagacctcctcttactaaaagatcatgaaaactggcaatactgtattgcccagtgttaaaatttgtcagattaattacccagagccaaagttagcaaactttttttctgtaagggctggggtgtaagtattttacactttgagcgtcttacagtccctgccctatctcctcaatcagctcttataatgacacatagcagccatggaaacaaataaatgagcagggctgtgttttcatgaaagttgatttccaaaagcagagatggagctggatttggctcagaggtcatagtttaccccaatctagagaagtcccataggttaaaaatgtgtagtctttttttttgtttttaatagataagaccttcttgcccattttatagtcgttcccaacatttgttgagttctccactaagtacatgagaccacataggatacaacaggacattaaaagcttttttttttttttttttttgagacggagtctttttctgtcacccaagctggagggcagtggcacaatctcggctcactacaacctccgcctcccaggttcaggcaattctcctgcctcaaccgcctgagtagctgggactaaaggcgtgagccaccacgcccagctaatttttgtgtttttagtagagacggggtttcaccatgttggccagactggtctcgaactcctgacctcgtgatttgcccccctcggcctcccaaagtgctgggattacaggcatcagccaccgcacccggccctaaaagttcatctttaaggacatttcccacctttgttttagatatgccactatctcagacatgaaacacaataacaaactaaaccagggtcatctccacccagcttgtacactacatatttgggtaggagcttaacgtcttgcccttcgctttgccagtgtgtcttctgagctccccacctctgctaggtgtgggctgcattcacccccaattttagacctctttggcagtagcttccttgatctcccgcccacatactgtgtcatatcccagtaattcttccccaaaccttggctatgggttattgagctgacaaatgtctaaatgactgagatacgatttcacaacctgctgagagcctcttctttccctgtactctttgatttgtagctttgtaagttttgtgaggaaagtgggaaaaacattcttggtgacacaggcagtgaatgaggaggacacaatggagtgggcaccatatctaggactcctgcctgcattgcgagcaaaagcatgtatttatatcttagccctctgaatgttagaggtagcagattatacagtatggtgcaggaaggagcatcctatgtcctgaggtgaataacgtgttctaccacctggcagcagattagaccagatcaggctatgagaatacaggttcacagccagatttagtactaccagccagatttagtactactgcaaaaatggcttttccttaagaagtttttgtttctaacttttattttaggtttatgggtacatgtgaaggtttgttacctatgtaaacatatcatgcggttttgttgtacatatcatttgatcatctaggtattaagcccagtatcaaaaaattatcttttctgctccctccatcctctcaccctccctgctcaagtagactccattgtctgtcgtttccttgtgttcctaagtcatcatttagctccaacttgttgagaacatgcagtataagttaatgcttactctctttaacatctttcacattagaaatctatggagaagaaatatgaaagactcatatataaacatggggcaaaccatgaagctaaatcttaatgtatcccaaaccccagagggagcataaggttaactttgggtggccagggtgcttagtgataacattatgagctttctacattagcagggccccctggtgtggttttgtgcctggagatgtaaggttctgaactacaaaggaagcaaacaaaatgaagagatgatgcaaggaggcaaaaaagatggaggcattaggaaaggctttgagggcaggaggcacggggtcatcttctaaaataacctattggaatgcatgttttaataagctttgaagatcaaagagattaacaagaacaagaggaaaacaagggtaaattaggcactattgatggcctgacaaggacttttttctccctttctgcttacaataacctctcattttaccatgtggctagttggtttgtttacttgtttgtttacacttactcattactagctttccctataaagcaagggaaaacactctgtccccaggggccagctgcataacatgaatagatgaaatagaccagaccagatgcaatctgcagtcatgggaactctgaactgaagagaacatgccctcatttaaaggcatccaaatgaaacattttaaaaacactaaaataaagagaccccatgaaggtcaaacaaggcataatgagacacacagtgttttttattcttttgtttcttaaattcctttaaatatagccctttcataaatttggcaggatgtgctctcagtaaaatttctggtttagtaaactcttggtgacattatcaaattaaacagcaatcccttccaaattcccctaaagctaagacctttttttttttttttttgcatgtctttttttctctgataatcccagagtttatataacctcaaactataagcttgatgaattttagagttcattgtaatgcttttggtttaggtgacaaaactgatgcctacaaagataaactgatttgctgaaggtcatggacctagtctttattggagttgtaattcaatcccaggtgtcctaaatctttaatccatgccattttattgatattatatattaagattttttttattgtatatccaaagatttctattttaaactgagataacatccaacagagaattcagaagtagtatgaaattgattatcttccctctactggacattgttgccatacaagacgatatcattgacccacttagggctcaaatatacaactctgtattattttagtcacaaagggaactaagagattatagacaagttgtgaagcagttagtggggactggaagtctcctgtggcacagactcaaatatatgctctagtgatgtgttctcagtcatgttatctgcccacacagaggacagattaagcaacctagagtactggttcccaagctcgaatttaaaactagtaccagtctatgccaaagctttcagtgacccatagtgaaatgagaaaagcaaggacaatatggtgagtctgcacaaagtcaaacttacagaactgccctatatttggatactgtatcatgtttttttggatggctaaaatcaatgtcttttacaaaagcagcattttgttactatgtatagcattcttaatcagcaaaataaaggttggcaatggtatgtcagtccttccctacagtttttctttgaagtttttttctcaggcattgaaaacaaacatccgaaaaagcaaaaaaacaagagttttaaagttttaaagtgttctctatgttgccacattagattgagtagatttcaaagactgaaggcctttttacatgtaaagttttattgtgaactaataatgatgatgttaagacccatctattttattgaggtcccaggaagttactagtttaagcatccgtcacttagataacaagcattaaggtaatttttaatttcagttaaaaaaatagattaaaggcacaaaatagatttccaaacaaacaaacaaacaaacaaacaaaaaaaccaaaaaagccaccctaggataaatataactagaaggccaagatcagtttagaagtctacttaaagaaagacagaaacttctaaggactgtgtggaaagataattcatgcctataaaaaagtctctgtgctaactctagatttttttcactgtaagccttgtaacaaaggagagagagctattttggaaagctgaattagcctacatttgagctaacatgatccatctttgtgtcaagagaaagtcaaatattatagtccccagccaaaataaggcatgtgatctacatcaaaggcaattcctgaatgtgtatctacgtcctcatcccctctcctcttttttgtctcttgggtaatctataccaataacctcctgattcatgaaatttattatctaaatattgaaaatattacactaaatttagcctaataaaaattcatgccaaatttactgagtatttattggaaatcagagacttaaggtcctgaatcaggtgtaagaattgtattatcaataacagacttaacagtgattatctctaggtggtgaccgatattttgataatcatactccaaaacatctatgtagaaattgggcatggtggcgcatgcctatagttccagctacttgggatgctgaggtgggaggattgcttgagcctgggaggtcaagggtgcagtgagccatgatcacaccactgcactccagcctgggcaacagagcaagaccctgtctcaaaaaatgaaacagaacaacaacaaaaatcgatgcagagcatgtattacatttgtaatcagagagaagggatatctgttatttcttaaaatatagaagagtatactaggagaccagcaagggaaatgttttaatatttagatacggaagcttcgccagacccgtaattttttaaaaatagtgaatcctttttcctgggttgaattatgatgtatggccctgcaaggaaagctgctggaggaattcaaagatgatgatgatgatgatatgcagggctctatatagcttaacacattagttccataaggtcagttctgttcatcaagtgacaaattgtccatggatacaccaggtggtaatgcagcagcagtgggcacaagctatcctgtaaatgacccattaccagaaagtttaaaatttctgcttggaacccaggaacacagatggaacacgaagtggctttcaccagagtcttgggaatatgcttgatcctttaaccccagcttcaggtgttgtgtacatacttaatgcctgaacagttctcatctgtacatctgctggttagatgaaaagatgcagttgcagacaagtaatttaaaactttacattcatgtctctctacctccctcttcctcttctgtctctccctcgataggatgtccagaaaattaaatcagctgcagattaattgagactctcttccatgtagggaacatctgtcactgcagctacaaagattatattaatgaattaaaacatttgattacctttaatccaagagaatgcagcagtctctttagtcatttagtttatcagggttttttgatggtttttttttccacgtgcatcttacgactatagtccacccctgaagctgtgagatctttcagcagatgttgttttccatatctttaccctttccgttgtggaagggggaaaaagccctcagaaaagcaattttggaggaggcagaaaaggtttccatcatgaacatacttttagaaacagctggtaaaacaaatggtccaagtgcaatgcctggagcatatctattcaaacaaggttgtttaaagataaaagcacccacttctaaatatcagcattagtagtgatttcctcacgtatatttaagagatggaagagcttgtgaagactttttgatttctattttgttttctgagacttctttaactcttttggttttgttagtatttgaatttatcagaagctgctcaaattgttaaaactgtatcatcatatgtaaaatatataaatttacatataacggatgcataaagatttgctttcttattctaagaatgttcttatttgataacatctatgcatagtccagaagattgacatgaaaaactgataatgtacttaggtattaccaatcctataacccaatttgtgaaaaggtcaggcactcctactaaagaacaaacgtttgtatttgtagcatttaaaaatctgattttattttgtatttgctacatttggagtcaaccttatcccttcccttctaatgacttcatttgtttaccaggctgttttgttctgcatcctctgccaaatgccattacgtaacttcctttgtcagaccaattggtgaaataattctttgtgtgcttttttttttttttttttttacggccgtccaattttcaaattatatgtggattttctgagtcaggcattgcacaaatgctgatttgttagcttgaactcgataaatgtgtgttcaccctatcagttgtcattcatgctgacttcttcctctactctcttcactctgattctgttttcatttaagaaaatttcagaagtagtgaagctaggagagttaatgagtagccacgttgaccctagtaggatcttacccattggagaaaagccctgttttaaaacgatgcacaaagaataagcttcaatgtcttcctctcctcaaccccagcatggagcacaatgcttatgtgatacacggaagtgagaaatttaagaagtgcttcactttaacttttctcaataagtaaataaaactgtcttttctagagtccaacacatcccaaagtgtgtgactttgctattttaccttaaactgactactctctgaatagattttcatgttatatagtctgagacttttctttccatcctgctggtgctggaagacatgatcataactactcacaacccagatcttaaaatatatatattgttacacttttatatacttgtattaaagcatcagttagtaagtttcatggttgtttcttctgatgtaaaagtaactgtagttatagatcctccagcacatgtcacactgaaaacctaatcacaaagtcaaaatatgtgcataaatattagcttgattatgtgtcacatgtaccccaaattacacatatatataccttcctcaaagattttttttttgtggggggacagtctcactctgtaatccaggctagagtgcagtggtgcgatctcggctcactgcaacctctgcctcctgggttcaagcaattttcctgcctcaggctcctgagtagctgagattacaggcacctgctaccatgcccagctagtttttatatttttagtagaggggtttcgccatagtggccaggctggtctcaaactcctggcctcaggtgatctgcctgccttgacctcccaaagtgctgagattacaggcatgagccgctgtgcccaacctgagattttttttttaaaccttggattttcaaataactttatagttggagaaaagttgcaagaatagtatatggaattcgttatgtccttactcaggttcaccagttgttaacatttgccacatttgctttaccattctctatatgtgtgagtgtacatgcacacatgagccatttgagagtatgcatacaaaacatatttatgtagatatgtatttcccctgaaccatttgaaactcagttgtagtcatcattccttttttaaataattcagtgtgtatttcctaacaaggactttctcttacaaaatcagagtacagtgatcaaaatcagtaaatgtaatcttgacacaaaatctcacctagagtacatattcacattgcaccagcgtctgcataatgggctttgggattatttttttcccagtctgtgatccaatccaagatcacacattgcatttagttgtcaagctcaccaacttttgaagcatcttcctgatacgttattttatttccccatttgtttactggtcacagaccagtaagagcaagtaaacttcttaaagtcctgccaggtgtgttggtgtagaagcgggaagatagagcctgtgcttcagcacaggaggaagatttcaatttttagaattaaaattatggcaaggaaggacctgtgtttcatctagtattcattccttagagagcacggatataatagtctgacaatgctttttattagtgttttcacttagctgcagattgagcatttactgtgtgctaagcactgaggatgcaagagtaagcaagaacagagatggcccttgtgggcctagtgggggacactgtcatgtaattaagtgacctccaaataaatgtgtgatgacaaacgttgatgaaggctatgaagcaaaggcacttggtgccatgagcataccatggtaggacaggtaacaaggcaggggtgggtgctaggaatgtagagaaggatgaggaaaccttctctgaaaaaaatgatatttgagcagaagagtgtgaaataagtgacagctaagaggaagaaaaaatgcattagagcttgcaaaaaattctgaacattagaaaaagtcagccatttctgggagagagttatctgggagcagcaactgtctcacaggattttgtccaaagtataaaataaggaagtgtgttaggctattcttgcattgctataaagaaatacccgagactgggtaatttataaagaaaagacgtttaattcgctcagagttctgcaggctatataagaagcatggtgctagcatctggggagcctcggggaaactacaatcatggcaaaaggtgaagggggaacaggtatgtcatatggccagagcaggaacaagcaggggtggagatgccacaaacttttttttttttttttttttgagatggattctcactcttgtcgcccaggctggagtgcaaagtcgtgatctcggctcactgcaacttccacctcctgggttccagcaattctcctgcctcagcctccccagtagctgggattacaggctcatgccaccacacccaggctaatttttctatttttagtagagacgaggtttcaccatgttggacaggctggtctcaaactcctgacctcaagtgatttgcccgccttggtcaattaaagtgttgggattacaggcgtgagccacagcacctggccgccacaaacttttatatgaccggatctcactgtcatgaggacagcaccaagccacaagagatccaccttcatgacccaaacacctcccaccaggccccacctccagctttggggattacagttcaacaagagattcaggcagagacaaatattccaaactatatcaggaattaagtaggctttgctgtccttttgcagctttgagtcaacccatatgagagtgaattctccgatcctgtactgctcctgggaggaaagggagtgggctttgtgaaaaatggagatttagtgagtaaagtgatgagttcactggaggaaggttggctagaaaaaaagtgacatggctgggcatggtggctcacgcctgtaatcccagcactttgggaggctgaggtgggcggatcacctgaggtcagaagttcaagactagcctggcaaacatggtgaaaccccatctctgctaaaaattcaaaaattagccaggcatggtggcaggcacctgtaatcccagctactcgggaggctgagccaggagaattgcttgaacccgggaggtggaggttacagtgagccgagatcacgctctgcactccagcctgggcaacagaggaagactccatctcaaaaaaaaaaaaaaaaaaaaaagtaaaattgtctttttttttttttttgcgtaccaaatcctatcaatgaaagagacaggaatagatttgactggaatagtcatgggagccatttccaggctctcatagtcttagagatgacacttggtagttcagtgtcttattgtgcttcttcaagcacatacagcctgattgagagagactcaagacagcatacaaattctaggcatttttacatctgcctagctgtagtgaattagtcatacaataattatttaaagaaagaaatgtttcctccatgttgtgctggagatacaatggtggagaggaagtggagatcaactattgatcgatttataatttacacaattccacactttggagaaaacacattccttcttcctcaccatcaccctcaccattataattattatcaattaacttgttcaatatgtaattttgaagttgccaatcatttaccagtgtgattcatcatgttaaaaggaaatggcttttacattattaatattctgcaataaaagtttgggtttgtgtgcttacagttagaataaaagaaaaatgctttgtactaagactatgttaataataatgataataataaagaaataacactttctccagaaaggaaatttcaggaaatctgtttcagaatacctgtctctaccacaagagctttctaagtcatgttttgattgctaacagcattccagtactgggttggaacatatgtattccttctatcaactgaggaacagcaggttttctgttattgcccatgcatggtcactctctgcttataaaaattcatcacttctgctgattgcattgtgtaggattcctactgattaccatttagatttgttaagtgacatagcacattttatggagtcaggagccagtaaccatcaaggtcaatagcagcaacctgaatcagttataaatgaattgtttaattacccacgcatgatcaatgtgtgcactgccataaaagattagttctagtccctgaatgtgtgtgtgtgcctgtgtgtagttctaagggattacagacttctctgaagtcttcttcattgaaagagattgcaagtgagtatcttttcagtggaatagaactgagttatggtaacaacatcatctatacatccagtctaccgtggccactgaatccaatgacttttttttttattaatatgaaggtgcctgcctatccaaagcactgcttactgtatttcattacaatgtattgcttcactcaacacactctgaatagagaagatatgctctacagcttcaaattcaggcacttcctccaagcagagcttgtttatctgtctgcaacacacttggagcatttgaaagactagtgatgaaatccattcatgctgtgaaaatgtgttgagcatcatggccgcttcctttacaatggcctggcatggaaggttggagaaggccattgttaccatataaatgactgtctatttgcctctggcatgacttgtccagacaagttgcatcattttaaaatgaatgaagttctagggagcatttttaactatagtaccttagttgtaactttgagagtttttaataagcttgcaaggaataaatttggaatctagagtagtttgttctatttctggaaaaaaaggaatgctttgtacatatgtaggatcctttacctggccacagagtttggtttgagaagtggacttgactctggatagtgaacaaaatgctttttcaatttttaaaatggaggcacctttttttctgagagcatagtcagtaactccccaaatgtgtgtctcttgtgtgatagaggaaccaagtaagagaatagcttggtgtgtgcctggttttcttccacaagtacccaattagtaaagggggcttttgctttttacaaagcatgaaaattaggggttgcctataggcctgagagccctgccagacagttgcctaatgccaccagccaggattatggaaaagaagccttggcatactattcaatggcaccgattcacccaaattgcaactgaggaaaacgtgttcatttttcaaatagagtttgagtaaccatagacacaggcaaagtaatctctccatttggtcacaatggactaaactaccttgttctattgtctaccttctctctcactgactccatcaaggcagacttgttcggtaaactattcaggtgactttgtgaacttttatttggtgcaaggctctgttaatagctgtaagtcagctgtttttggtcctccctctcattctcttcacactgattgatgaaatgggaaacaggttgaagaagctcacttttttagatgacaagtattaagttgacagataaacctttaggaggttccagttcatttcaggaacgtgttgacatgaggtctttaaagatcgacagtcctattagagatagagaccaccaggaaatcataaggaaaagaaaaatgaaggaaatatctagattcagtaggaaattgggggtgatgagagaattttaagaaaaacgcttgctttatcaccagctgtgtcattttgttcaaagggacaggaaacataatactctctctgaagcttaacagaactgcagacctattgccacagttttctcttttgcataatcttgtttagtcacttaagagctagtgagtgacagatttcacatgagaattggtcacgtacaagaatgttaatgcagaactaggtcagattatggcatttcacacatgcaagatgggaacacgcttcctctggttagacaaaggcttgacgattgcccatgcatctggtcctgctttaaaggaagctcatgtaatcatgagaactcacaatgtatccatagatttcttagatatcaagtttctatgagccttggcattgtgtatggttttattgttattttgccaaacgagggttttctagcttcacttagtatgcctggagaaagctattttggttcggcccagctccatcactctaagaaatgatgaggatgagcgctctcagtttgtaccgactactcatgagagactaagaactgatcatctggctgctggcaacattccactgcaacagctaatacagtgttttggaaagatgccgacaacaaccagattgcattaagcactttaccgtttaagatcagttttgcagttcagaacttgaagtcagcagcagatctaccttttagtttgcagtttactttgctccgagtttttcatgtcttctgtgagccccccacgtttatctcagggtggattctaacacacatatgcttatgtgaaaatttcataatactttagtatttaacaggcacttttatataagtcaattgatttcaggacaccccctcgccgccctgataccaaaatctgcagacgctcaaatctcttacataaaatggtgcagtgtgtacatataacttacacacatacttctatataatttaaataatttctagagtacttataatacccaatccaacatagttgttatactgtattgtttttgtgtttttaattgtaatattttcatttacctgcagttgttgaatgagtcgagggcaggtagatatggaaagctgactgttactacttcccttttacttatattacaatattatctatgttagtgatgttcatagttcaagagacacactaaaggaattacagtatggagtgtctcctaagttgcattgtggaactaaacactagagacaagagtcgagccctggctcaatagagccagtaataactcagtgtctttatgaccctgagccggtgccttaaattctctgcagcgtagtttctttaaacggtggttctaaactaaggggacttttgtccccaggggacatattgtcaattgtctggagatgtttttgattgccacaactgggaagatgctaacggcatctagtgggtagaggtcaggggtgttgccaaatagcctacagtgctcagacagcccccaccacagagaattatcccacccaaaatggcaatagtgtagaggttgaaaaatgtcactttaaaatgtaaataatgtctatcccattatcacaggattcctatggggctcaaccccacattttgtttaaaaaaagtaaaaaaaacataaattgcccttctatgtctgatgttactactatggggcattgcacatatggacaccaaacttttcccttaaaaaggaaaatggatttattcttttagattaaaagttataaataaagctatcagattaaaatatattaaatatatccactgaatcttggtttgtaattttatggttttaaatgaatgctctaaatataaagagaaacaatgaaaagttattaagtaggagaaacctactattcagtgactaatatagataaaggaaattggaatccatgcaactaatagacttttctattagggtacagccacagcacgtctttcctaatagaagcaagcctgaaatgataagttgtttggatcacattaattaacattcagctctattagatttgtacctgaggttgggttcattttactggtgctgatgaatatcaaactacacaatatctacgcacattatattagaataaaacatgttttacattgaaggcaaattttagattcgactcttaataatggtcttttatattaactcagataactagagatagtaaaagaatgaattaaaattccagtgagccaaactacaacattgataatagtaatgagaattaattctgtgttgattttatggtgcctttgcctcgtaggtatatataactctggagtttatgaggcatgtttatagatcttaacttcttaattttgtaatgctgtcctcttaaaatttttgcttgagacggacaaaacctcctgaatttcttcaatttacatgggcatttttactaggaaagagcatgcagccttcatcagattctcaatagggtttattaacaaaaaatgttgagaaatcaccttaaaaggcaggcagctcttaaatgcttgttctcactgaagtccttctaaaatgatattgcatggactctatcagtctcttagcagctcatctgtagaggtaccaactgatcaaaaattcaaagttcttaattgacatactcaggttttttaaaatttaaagatccagattggtagctcagccatatagctaaattgaataattatgcaaatgctgcacaatatttaattggaccttttggaatgaaaataacccaggtgtgcacaattctttgcaatctggagcaaccattctaatatatatctgcaagtgacaacatcttgtatgtaaacaggcagaggaaaagagttctggctgccctcccaggaaaatatacatgaaagaacgtttgtgttacagcatttgtgttacagcacatacatatttctgagttgtttgttattaaagtcccattgtatgaaaacaactatatagacagactggcaatccagagagttggtagttacataaacaggtcccacggctaccaataatattaacacggtattcttagcccttaagaaacaaaacacagaaatttctaatactgggagtttaaagtgccacaatggaaaagcaaactcaattacaaatgctggattccacctggagcctattcttttcattttcttacttctgtttctgccaccttcccttcttccgataacagattttcaagtactgctcttagaattgctaaatgtgttcagagaatgtgtgataagatctgattctcctggaaggccaggttattttaatctttccatttctcacaccaaccatttaactaggtattatttgtttctggacgtcacagctaaagacacaacattttacatgaaaatgtcagtgttgaaaatattatttatctatctatcaaaatgtagccacgcatctgttcttgtttgattctagtaaaccataaccctaaacatgacacaaaaggggctagtgaaatatttgccgagagcggtactctaagttaacagtaaataattgaaaataagtaagtcaaaaccaaaaccaggaaagtttgcattcattcccaatcatactttaacagaacttgcagctgccacagattcagacatcttcatcttcctgtggagcatttgtcttttcatagcagaggacaatctctgtgactttcttatatcactgagaccatcttgtacagtttatttcaaaagcaagagtgttctttttcgtttcatgccaccagtgacaatacgaaaccagatctaactgaaacttcactcaacacattcccgacccgccaccccaaccctaatagcctctcataaccaccgttctactctacttctgtgagttcaacttttgcagtctccaaaaagaagtcaggtcatgtgatatttgtctgtgcatggtccatttcacttagcataatagggggactaagttcaagagatctattgcacaacatggtgaccatagcaaataataacatcttgtattttgaaaatcactaagggagtagattttaagtgttcttagcagaaaagaaaatacaatgaggtaatgccggtataatttagcttgattcagccatttcacaacttgtatacatttcaaaacattatgttgcacatgataaatatgtacaatttttatttgccaatttgaaaaacagagaagtccctcttcagatcctgtcctatgcagctgtcactcacttggctttgtaagcctgcagacagtgtcatttaaaatattttcctctgtaccataacgcttttccttttaatgatatataagaataatatttctctctaaatagttatttctttaactttgaaataattcagcatctcatgattttgatttccatttctccatatatacattttttggggctctgttctgggatttagggctaacctttgtcatggagacatctgtttttggcagtctttgtttccagggagtgaaaatgtgtgtagaaagaattgaatagctacatcttaggtgacacaattgaggaactggatgaaagatatttgtggaaagcaacataattattcaaactggaatatggccattgccctgggtttcatatttatcttcataagcaaagtggtttgggattctgtgcaagtataaggatttaggatttaaacactaaaccacatccctgcacggagcacatgggctttgttgttgataatcatgatagtcgcacaggaaacttgacagtgacagcaggggaacagcacagtatcctacttggccactggtaggaggatgcaatttaaatcctggcatgcgtagaatagcctcacttatctgtggattgttattgtaatctacatagtaagtttcaatcagaactcagttttgtgcagttgatttccaattcccgactctgcatcattagggtacaatgttttctgtaagatttctttgtaatattatagagagaagagcagaacaaatgcagttattcctctcaaagttcagctgaatgctactaatagttcaagaatgtggattgtaatggttctgtgcattgaaagaacacaatggcaaatgacaaagatgacactaagtgtgagccacagctattgttttgatagcccactctgcttttctagttaactttcttacaaccatcagttccatatttaagactagaggatcagttctgatgatgctcattcaaactcttgccaactgacatttaatgcactttaaagttgttaaaaccaagagcaggaaatgttacacttgtagtatcaagcctggctcatgagaaagttccatccactattctggaaaaaaaatagaactagcctgcaggacacaaagctacctgtggtgatccgaactatgcttctcaaaaatctttcttttgtttggccacctttataataggagttctccaacagagaaagagctgcttacagcttcagagtacagatggataattgttgctgtgccatctctgaacatcttagattgagggtcccagagaacctcatgtatgtgaatgttagcacagtacaaaagatgggacagagctttccagagcagtaacagacagctgtgcccagcactttcttctaaaagttggagatgctggatggaaaatttgtcattgtttacatagcacccacacacacacaaaaaatcctgactcactagcttctgtgttgtcatttttttgtccatggttctattgctgcctaattttcatacgggaccctcacagtggttagtctgcacagtaaggagtcaactgtgacatcctcatccttgaatgctagactccccactttctcagctcaatattccatgtgtccaaagtaatactgttagtatcctacattattccaggatcttgtcatgccacttcaagaaacaaattatcaccgctttctaagacttaccaagctaggggtgttgtaaagtatgtatgcaattgacttttgacttttgattcttatgttgaaaggcaacatagaaaataagcttccattaatgtaatgatatagtgttaggaagacagtatctacagtccattcaaaatattctgaaaattatagtattgattttggaacagttttgattccattggccatagcgcttaccttaagtcatttttttttaaaaaaaccgtcttatccatttcatatgttttacaggcactaaaatggggcacagagactaagtcacttagttgagttaaccaataagtaaaattgccttcatattctgcttcctaatgttgtatcttctctagcaagttcaagagagcttactttctggaagctttgcttgttagtaggatgtataacctgtgggaaaagacccagcagcatccacttttacttatctccttgccttctctgaaaacacactgaacagaaatatccccatctctttctccatcgtgggtttttcctttgggccacaaatagtgaacgccactgctttacaaagttattcttttcaccactaatagttctttgatgtcattttttgtacaagtgtcaaagtttttctctagaggcttccacacagttaagttcttgcttttggattctttctaaaccaaataaataaatcttcgagactgcaggttaatcaaatgccttcaaacatgaaggctgtttaggagctaagctgcacagacattttccaacatttaaactcttcatgcagcatcttcctatctcaatttgtacccgttagccagttccacagggcatattgggaaataccttttattttcaatatttatatttgtcttatagatatttgtcctttcaagtaggacaaagtggtaatgacctgcctctatcaaaaaattctacctagtaatccaagataagcagtgtgttcctagtgagttgcttacataaaagccaatatattttgtactgaatagtatacagtgttaaaaactcagctttttgagggacccaagcaagcctaacctacatgattttacaaagacaatacttaaaagtcataaagtactaagtctcaactttcagacttaagactcataaacgttttaattttttatcccttaaaaatgttattttttggctaacagcattgaaataagcgttactatagattaatactatgaaacaggaacaaaactgttgagcagacattctcccagggaaggactgtgtgtgaacacattaaacttacgcataaaagtggagactgtaagtgggttccagggtttccccacgctgactttttaaattaaatgtggcagtattgctaaaaataaaatttagtgtttctcaaattttttttagatagatacctcatatggtactcacaagtagtgtgaaaacttaagtagtatatccatctaaagcagcacaagcaatatgtcagcaccttttcactattaccacagagaaatagtgttggagaccatattgaaaatgactgtagtctggctgaggagatattaagtgaccagatggcctctggcacttctgttttcaaagctgccttatagtgcctttctcactttgtgataccaagctgctgccatgctagtgtccaccctcgaacaccatgccactcagacatggtgggattcgtgtttctgaaggggcacagtaggaagctcattcttgggccttctggcctgcctgagactgtgctagcaatacagtctcattgtgcacaaaagaagccatttttcttaacacctttgagccattaatgaaacctaccagttagaggtggtcaaaagacaaaattacaacaaatttagcttaaagatgtattggttttacttgcaattgtagaattgggcaacaccttgttctataaaatagtatgttctgatgagctgggcaaggtgttgtctgactttatggacagaaaaggactgaagaaagcagaaacaaaatgagaagtagacaggttgtttcaacatttccttctttctaggctttaagcagagggtactttcttatgctggatcaggtaaagggccccttctgcttggttgctatgaatctcctgtttaaaaagaaaacaaaaacaccacacaaaaaaacctgacccattatggtttggtctggttggctgaggcctagggccggagtctagtctaaaacaatggcctcccctaaacttgaacagggttacattgtagaataacataacaggaaatgaaaagagaaatgtgatgctcttcaacaattggtttatggggccttttaaaaagtgtgtatagagtcaatgatgaattaagatgcagtgtgaaagaaaatgacacaggacagatattcagagatcatttgttcagttttaaaatcagattattagtattgctgttgagtcatttcagttccttgtgtattctggttattaatcccttgttaaatgaatagtagaaaatattttctcccactttttggttgtctcttcactttgtagattgtttcctttagtgtgcagaaggtttttaacttgatgtaatcatgtgtctatttttgcttttgttgcttatgcctttaaggtcttatccccccaaaaatctttgcccataccaatgtcttatagcatttccccaatgttctcttctagtagttgcagaaagcacttgtaatttaacagctcaggaagggaatcaaatcattcagaccaactgaagctttcaaaatgttactgcttgaatgggcagaatatccaaaaacatttattgtgtgatcctaacatctacatattagaaactgatagaaaacttctgatgtatcagtaagatgataattacccttgtaacatttctggaagcatgtatgtatgtatgtatgtatgtatttaaacgaatgcttgtatatctagcatctctttcaattgactcaatacccaaggaattttatctccattttacaaataagagagattatgacttatttcaggtcacagaagttggatcacagctggaactttagtccagttgggtctagaaattcaattttctttttactttcatgactaaggaccactctataactctgaggtaaaaagagcaaacataatgaagttatttagagtagtgtttctaaatctaattttgcatgagtcccttggggaacttttaaaacatgtagataaccaggcacttcctgttatcctttttccactgcccctagcagacagacttagtatgtctagcttaggtaacctgggattgtgcaaaaaagtaaatcttcagagtccctctgaatatcaattctcattatgcaattatgactcctaaggcttaaaagtatgaaataaatctgtagagatcttaggatctcctgtggaagttgtttttgtgcctaaagattagcttgtttgtaagttcccatactcagtgagaactgaatattttaaaaaactggtgaagggtggcactgtattttaacgtaaaacatgcaggactagatacagtcacggccattcaattttttaagttgtatatctttgggtgagttacttagcttatttcagcccagatttactgctatgtaaggtgtaattataattattgagtaaaataaactaaagcatttaacacgatgtctggcagagactaagtttttaatactcttaaaaacatcttctggaggtaggcttctagttaattagtgttttaattatgtaattataatttttgtttcctttctctgtcctcatatttgctagaaaaacactatgtcaaccatttgatcatactcatttgtttctaagcatatatcttaactaatctagagacccatattcattgagcttttggaatgactggaaaatttctcaaagcttcctcccttatctacggtttagtttacaaaaattaaataagcttatgatgtgtgtctcatccacccaagtacatctgcagggctcctctattgtaaatcagctgcctaaggctcaagttagacacagtcaaagccgtgtatatttagggtacataatcttgatgtcaagtgctggagtcttgggcaaacttttcatctttttatgtaaaactgatttccattaagtatgaaaacaccttggtggtattgattttatgaaccctgtacattccctgcaatgaagacagattttagggtaaaagaggatgtttgcaagaaatggtgagttttattgtaagagaacttaccggccctatagagaggagaaaacaggttggaatgtccagctgctaccacccaacgggatcccagcacaaagaaaacagtcaaaattatgttcatcatgacagagcaaatgagcttttggggaaaacagaagcaaaataaacctttttgaataatttattattctataaacacaatcataaagcgtaatggtatcagttcaggagaaaggtcccactgctcctgtgttctacgtcagtggctgcagggccacagcaggcagagataaccaagcatgctttcactgccctgatcaccattcccccattaataatttgcttggccctttccttcctactgcctgaagaaaatcaatgtttggcagctctaggttgaattactgtttattttatctttagcctacacaactgcaaaaggaaagcctgagttttccagtgcatattccaatacctgtttatggaagtgagaacgagtcagatagtgatgtattttttcagagagtttcttaagccagctgtggataagaaggtccaatttgcattggaactgctaactaggactcagggaaatcccatctggtttagagaagagtaaatgaaaataaaacagaattgtgaatgcaatgcttcaataattagtttgcaaaacatgtatccactgccttgtgtgggcaaagcaccatattaggaactatagaggactgcaagaaaaacagaaaaacagagtgggctccttttgcaaggtattcgtggctattccaggcatcctttcttctttcagcagtgatctcctgagttattactatgtgcctggcgctgttctgtggactgcggacaaagacaaagtctctgctctcttggagcttatattccagtgaagtgggggaggactaaatgtaaatacatgggcaaaagtcagctaataaatactgtgcagagaatcatgaggagttgatgttcagttagtgagcaggctggttcgttactagggaagatgtgaagggcctctgagaagtaaaattgtagcagagacctaaataacgagaaagacctagccaagcactgagcaaggcaagggatgttcctggaagggaagccagagagtatggccagagcccgagatatcctgggtctggtgagtcatagatgagactggagtactggagtaggcagctggcaggtcacagtggactttcccagtgagtcagggattttgatttggggaaacctttggggattttaaagaggaaagtgacttgatctgatttttattggatactttaagaaataaattttgttttgtatacttaaggaatacaacatgattctatgagatatatatatatagtaaaatagtcaccatagagaaacaaattaacatatctatcatctcacatagttatacattttccccttatgtcaagagtagccataatctgatttagcaaaaatcatgaatacaatacactattactaactacagtcctctgcacattagatctttagacttgttcatcctaaacacctgttacttggtattctctcacctacatgtcatttcctctcccacctctagtaaccactgttttattctctatctctgtgggtattagacattgtttttttagattccacatataaatgagatcatgtaatatctttctttctatgcctggcttatttctcttagcataaaaccctgcaagttatgtatattgtagcaaatggcaggatctccttatttaaggctgaataatattccacttaatattttataatgtgtccatcccttgacagatacttcgattgctttctatcttggctaatgtgaatataggtcgggtttggttccaaaccatttcaacaaagtgaatattacaacaaagcaagtcacatgaatttcttggtttcccagtgcatataaaagtatgtttataccatactgtgctttgttatatgtgaaacagcactatatcttttaaaaaaatactttgataaaaaatactttactgctaacaaaaatgctagtgatcaacagtattcagcgaatgtttttgctggtagagggtcccgtcttgatgttgatggctgctgacagatcaggatgtgggtgctgaaggttgggatggctgtggtaacttcctaagacaaaaatgatgtttgctgcactgactgatttttcttatcacaaaagatttctctgtagcatgcaatgctgtttcatagcattttaatcagagtacaacctctttcaaaattggagtcagtcctctcaaactgtgcctctatcaattaagtttatgtgatattaatatttaaatattttgtcatttcagcagtgttcacagcatcttcaccaggagattacttcttatgaagtcattttactaatccataagaagcaactccttaaccattaaagttttttaagaaaaattaattttaatagttttggggttataggtggtttttggttgcatggataagttctgtagtggtgattctgagattttagtgcacccatcacctgagcagtgtacattgtacccaatatatagtcttttatcccttgccccctcccaaccttcaagtccccaaagaccattatatcattcttgtacctttgtgtcctcatagcttatctcccacctataagagagagcatacaatatttacttttccattcctgagttacttcacttagtataaatggcctcgcactccatccaagttgctgcaaaagacattattttgttcccttttatggctgaatagtattccatggtggatatatataccactattaaagttttatcataacattacagcaattcagtcacatcttcaggtcttacttctaattatcttgctatttccaccatatcttcagttacttcctccactggtcttaaacccctcaaaactctccatgaggttttgcattaaacttcctcccacctcctgctaatgttgatattttgacttttctcatgaatcacaaatgttcttaatggtatctagaatggcggatccttctaacaattttttcaatttatttttcccagatccattagaagaatcactatctatggcagctattgccttacaaaacgtgtttcttaagtaagatgttaaagtcaaaattgctttttgatccatgcacagcagaatggatgttgtgttagcaggcacgaaaacaatgttagtctccttgtatatctccatcagagctcttggatgaccaggtgcactgtcaatgaacagtactattttgaaaggaatcttttattccaagcactaggtctcaacaatggacttaaaatatttagtaaaccatgctgtaaacaactgtcatctaggctttgctagtccacttaaagactacaggcatagtacatttagcataattcttaagaaccctaggaattttgaagtggcaaataagtattgactttaagtcaccagctacattagcccttaactagagaatctgcctgttctttgaagctttgaagccaagcactgactcctcttctctagctgtggaagtcctagatggcatctttttccaatataagaccattttgtctacattaaaaacctgttgtttagtgtagccactttgatcagttatcttagctagattttctggataacctgctgcagcttctacattagaactcgctgcttcactttgtgcttttatattatgaagatggcttttttttttcttaaacctcatgaaccaacccctggtagcttccaactttacttctgtagcttcctcacctgcctcagccttcatagaattgaagagttagggcctttctctgcattagggtttggttaacaggaatgttgtggctagtttgatctatctagaccactaaaatattttccatatcagcaataaggctgttttactttcttatcattcgggtatttactggaacaacaattttaatctctttcaagaacttttcctttgcattcacaactcagccaactgtttggcccaaaaggcctagtttttggcctatttcagctttcaacatgccttcctcactaagctcaatcatttctagctttaaagtgagaggtgggtgactctttctttcacttgaacacttagaggccactgcagtgttattaatttgtctaatttctatattgctgtgtctcaggaaatagggagatgggggtggggggctggagagagacaaggatagacagagagagagagagaccgacccagagagacagagagagagagagacagagagagagacggagacggggagagagacggagacggggagagagacggagacggggagagagacggagacggggagagagacggagacggggagagagacggagacggggagagagagggagacggggagagagagggagacggggagagagagggagacggggagagagagggagacggggagagagagggagacggggagagagagggagacggggagagagagggagacggggagagagagggagacggggagagagagagatggagagagagagagatggagagaaagacagagagagagacggagacagagagagatggagacagacagagacagacagggagagagatggaggaagggcaggttggtgaagaagaacacagacaatattaagttcactatcttatgagtgtggttcatggcaccccaaaatagttataatagtaacatcaaagatcacagatcaccataacagatacagtaagaaaaaaagtagaaatgtgagaattaccaaaatgtaacacagagttgcaaagtgagcacaggcaggtagaaaaatggtgccaacagagttcctggatgccgagttgccagaaacgttcaatttattaaaaatgtatctgtgaagcacagtaaagcaaagcacaataaaacaagatatacctgtatttgtttttaaatataaaaataatttgctttaatgctgaacaaaaatgtcccatgtaaaaaattcatgtgctatctgttcccaaactcagtttccacacctaattacagtaaatagaaaggagagaaaaaccaaactttcaagatggaaaggagaacccaggacagcctcaaacccaacacttagaatggtatttctgcatgcccaatctacagcaaactttcagacttaagaaggaagagagaatggataaaacgttacagaagacagtattacattttaaaaattggtaagatagtagaatgtttagatctggaaggactttaaattaatcttttttccttacattcagataagctttaatgtgtactaaattctatcccaaaatctctattctttgtgaccctactgtaccctacgcagatttttgttgactcaatactccactgcacttaatttgttttttagtctcagctagacctgaaacaactttaggaaagggatagtgtcttcttgcttacttttatttttcctaccaactagaatactaataatcattcaaatgtttattgaatgaattaatggataagcaaatgaattaatataattagttgcttatattttaccccccacactagcctatagctttaaagttgtggtgactacaatgtctagtcacttaacctcacagggcagatttgctcaactaataagattttgaatgagaaagtgcttaaaaattctaaaagtgcttctctaatatttgttactattgtgttcaaagactgttagctaccaaatgaaggtttcatagtcaacagaggaggctgaatcccagacaattacaactgaggcccgggctactccaagtgtgatctttggagtatctgactcagcaaacaaacaagaatcacctcaacccaaaaccctaacccaaatagccatcattactacttccttccaatctccatctccacaccctccaataatgatgaattcttaaagcttgaatacatgttttaattgtaaatttgggttatttctgcatgtaattttacagttattttatttcacccttgtgagttggagttaagctctgaaaaggtcttattttgatgtctttccataagattgtattccttttttggcaagagaacagatctggagttgagctcctgccctctaccaaactgtgaaatttgagacaagtcacttgtcccccatgccaacccctggggcctcacttttcttattcaaaaagatcaaagattttgtcctaactcatgaaatcatgagcattacatgtaaaattaccttagaaactataaaatattcatttcaaatgcatcaagatgttattagctatattttatgagctcagcactccttgatggtcctgaagagaccaaaggggctgaggccaaagggagaattctccttaaatctcttggaaacaatctgacagaccttagaattgtgtagtaagatgaggacataaaggaacagagggtcaaggtagtatcttagctcctttctcccaacgtgttgatactggttaagatacacaaaagggaaaacccacctaagaaactgccaggaattcttttttttttttttcattttgttttaatgctaacttaataatcatgtcttagtgtaactaagcttttcttcatcaagaacattataagctcattgatgcacaggctaaatctttatgcttatttggtgctttttaatctgtctagcacagaatagggcacaacacaggtcttcagtgtgcctttgctgaattgaaatacaaaaaaatagcacatctttcaatacttgaagctcatttttataaagtatatgtgtgtagtagggaattctaaaaactattttttgctggtactagtttatttaatcaagaggaaatatcttcataaagtcaaacaaccagaaaggacagtgcaaatggccctcaaagcttgagcttagcaactgctcccctgttcttagtcttgccactgtgtggaatttaggacttctatatgcagatagtttgttacttgcaaaccattagaccaagcttgtcctacccacagcacacagggcgcatgcagcccaggacagctttgagtgtggcccaacacaaatttgtaaactttcttaaaacattgagtttttgcaatgttttttggtctcataagctattgttagtgttagtgtttttttatgtgtggcccaagacaattcttcttccactgtggcccagggaagccaaaagattgaacacctctgcattagacccttttaatactattataggtaatatattttacaacataaaaaaatcatctgtgtaccagtcagaaatgaaggttttgtatgaaacattttcattcttcagtatcaacagcccaagattctcctgactttatttctccagccctggcccctcacctcaccatctcttagctggccccagatatggcccaggtgttttaatcttctgggtgatctgatccagcctcttgactttaaatggcatctatatgatgataattttcagtttaagcctcccttcagaattccagtttctcaaatccatctggctattcaacctttccactttgatatttaagagacactttgggttcagaagagctaaaacagaactttggattccccaaacttgcatgtcctccaaattttctcatctcttaaatttgattcaggtgtacaaactccacatttgtcatcattcttgggcccctgtcccaactctcttccccacacccagtcaagaagtcctgttgactctgcctcgataacaaattgctcacacatttcctttgctccagctacccatgctgtagtgtaagtcaccatcatttcttgcttgaattctgcaacggcttcccaattgatctccccaattctacttttgcttcccaaaagtccattctccataccgaagccaaagtaatctttaagaagtatacatctaaacaaaacacttcttcacagcaaagaaatcaatacaatgaaaaggtagcccacaggttgaggaaaacatatttgcaaaccatatatctagtaaggggctaacttccaaaatttataaacaactcatacagctcaataacaagaaaacttataacccgattttaaaaatagacaaagtaacccgaatagacattcctctaaaggagacaaaagtggccaacatgtatgtgaaaagatgcttagcataactaatcaccagggacatgccaataaaaatcaccatgagatatcacctcatacatggtagggtaggtattatcaaaaagacaagggacaacatgtgtcgatgagagtgtggagaaaagggaaccgttgtacactgtgggtgggaatttggattggtccagccattacagaaaacagtatggaagttcctaaattaaaaatggaattgccatataacccagcaatgccttttctgagtatatacccaagggaaaggaaattaccatcttgtagaggtatctgcactccatgttcattgcagcattactgtaccgcattatgaaatgggttccttcaccccttttctgagcaccctccatgtctacagaagaagttatgaggaacaaaggtatatgcagggctcgttttgtaatgctgacaacagcaatcctcacatccagacttccatgtccatgtacagggttctctactttcgttctaagtcaaactgtgattcagaaatgagccatccattctcccagaattcctccattcaccccacagacacaaaaatcaaatctatgaaaatgtttttgtatatttcataggagaaacagatgtggaggcttaactcatgtatccaatgccaaaagtcttcaaaatcttcattaggtatttgttatgccaacttctttctcagccctcccggtttgtaactttttaaatctttacccagtgttgcacgaagactgttgagatggttccctctgccttcctctctctagtattctccctgggaagtttaaaatatataatgttatgtaaagtaactcactggggccttcctcttgggcctcacctctatacactgaagacaatgctttctagcaaggaggacccatgcttccagagaggagggtttgcaactggagtaacttgagtatgtctttgggattcttgagctcaacccaaagcagttcagaaacatttctttgaaacaagttcccaagatgaattctaacaactgtaatatcgcatttggcattttaaaaattttgattttacatttagacagagctattaggacatggtgggataaaaatggtagtatcgaaatatactgtttcaaatcaaattattgtattatttgttctcaatgacagacataacccaaacacattcttagtacccagaataaaggcacagccatgaaatcaggcagttattaataaaaacctagtgtagatagctaatgaaagatgaaaatgaagctgtgacatgattatgaactgctattagcaagcaatgtcattttgtatcttagagaccaaacaaggtttgtgtatgtgaactaatggttgacttatatggtaaagatatacatgcattatattcaggctatgttggcttcatttgaaactacagcttccatgggtttaaaaaatacacatatgatttgcaaagtgacaaccctaaattttcgtatattcaattgttcaaaccagtgatttctagaatgtaagtggtgtcctacttgtaagagttttaaaacaggcaattttggaataggtaaattactcagtagaagccttagagaacccaaattgctgatgtatctttttcgaaatgcctctcattatccaggagaatgtgtgtattggaagtatcttattctttaagtctcacacttagaccggttatgtttcctacttttaaaaattgtagaactttattctacagatgtcatttgatgccttttgagaccgaccatatatgcatttatacaatcttaattcaatgttaaaagtataattagtccaaaaaaatcaactaaatggcaacaagggtttttctttttctatattattaatttttttttcctccatctaaaactttccagctgctctttgtgaagttcccagaataatgattaacattattaaaccagagactaaaaatcttggtacggactgacccatggggacacattgctataattattttaaagtaaaataataaaaggggcgtcccatagcgggcaaaagttggactcatcctcaaaatttactctatttgtcaaagtcccctaaaagagttcttaggagtggttggaattggttgtcagaaccaggtgctctcaagtgtcttgcctttgtggttcgcctacctgggtttcccagtccttggttgaacattaatgttctcaacgagatataatactgaatataactcttgtgatctcttccagtggaggctgaggccatttctaaaaattccttccctctgtttcttctacagtatcttcctctccgtgtgcatacatgtgagaggcatagttttccccaacgtacttcagataaaccttattggcatagttttcctcaaagcacttccaataaactttattcctttcatgattgtcctgtagtttacagacactgatattgtactctttggagtggagaggggttttgccattcttacaaaaaaaaaattggctattcctccatttatcaggctcattttattaacattctactgtcatcattgtgctctgtcactttgactaagcccaagaaccctcccacagagcaatgttaattataacccctctatgcccgtaaaatatgccatctaaaggctttgaataaatttgggataaatttcctgaagcagaactcatgaacccatatgtattttgattccaattcctgtcaatacaggttctagttcaactcccaacacacacacacacacacacacacacacacacacacacacacacacctctcacatgctttccttctaattggcaagaagccttcagatgtccttcacccctactggaaaggcatgaaacaaaacccagtaccttcctcctacccctaaactggttttgtcttgctgcccctaatcctagcttgctgttctgtttttctattttcccctaaatgcaacttactttaagcatgtgttaactggattaacattcctacaattgaaggatagtatatgataacccatttgtcagtctagctactttcttctcttttaaatgtctacttacgacgtacatccagactgcacgccctttttattttttcaaagcaaagccaaaaaataaagaaaacgtaaaattagtttttaaagaaaatgcacaatctgtttttaattttggctatcacgaaaaggggaattaaccagccaaaaaagcaaagcaaaaaaaacgtgtcccctgactgctctgtctgtgcctttcaagcctgtgcgtctggttgttcatctctgaaagtgtgtgaaatacttttttctttaaactttttgtttttttctcccttcttgtttgggaattaagtgctttttatattatatatatctatatatatatatcaatgtgtttcttttaattgctagatctttatcttagatttgattttatctaaaattatgagaaaaaaagttatgaattgttttctgcagtttttccccactccctctttaaatgtggaacaacttcagctgcagaatcctcacatccacatctttcaaattagcctggtctcattgccaattgcgtgcaacatgggtggcataaggaagatggatgatgtcgtttggaaaatgccatttctctatagagaagtaattagcaacccagtgcgtgggccccctgcttagtagtgcgtctcaatcacctctgtagatttctgaacctcccccactctagatggggctgtgtggctgccgatgaagttgttcaacttgaatgcataaatctagtcttcttgtttttgctttaaactttttgatcatgactactagtattttatgtattttggctatttttagtaggaaaaagtttaactgtttttattatttgaaaatctttaatgaaactgtaataatttttggagtaattgcatgttgaagaagttgcagcttagggtgtgtgagattgtcagtgttagagttctgttctttatttccatagatgggcatgtgtaggctcatttgtttttgtatattgcccatcccttccttacagccagaagctctaatgcagctagatcactccgtgccgcccttacatggacatggcgactcacttacacatttactcctatcatcttcatctcctgtgtagttcactcatagatatgaccctccccttcctgcatctttccttcccattctccccctttctttagcattgttaaaatttatgtgctgtcatccatctccctaaattaaagaaagcctaaaatttgtcaaaaagacaaaaaaatatatatatctgaaaacttataaatgcagaaattcattcaaaacccgttagagtcatagaattttttgaaaggcaaattataaaagtaaacaggtttttttgtttggtttttcaatcatagcaatcggaattattttaaattcaaaaattgatgccctcccaaaccccccaaagtaaaaatttgttaaagtgcagattttttttttctttttatgttatgtggtgtggatgtatgtgttgttgcctccctgtatcatcctctgttgtaaattattatatttgaaaaattagacattttgctcaaaagtttttaagaaatgacaacaaaaaaagcaagttacaagaatgtggcaattctatttgtccaagagcattcttacacaactttcttttgtaaatttttctttcatgccaaaaaacatgcgggcaatttgttgatgtaagttgactataaattaatatggtatgcttttttagtttaaattattttgcctatatggaaatgatttctttttttcccagaacagcttctatttttaatttgcttttactttttctttccattcttattatattgtgaatgcctcaatgttatttgctctccttctcccagcttactttggctacgaagttgattttattttctactatataattttgaagactatattttttatttcatttgtgtcgatttgctgaattttcactgttatgttttgtgctgaattgcttctaataatcaatgtgaattctactctcagtagaagggggttaatacattgttcttaccacccaaagaaagcctggcctctttgcctgaactttttcaccaccgtgtttaaagccttgaaagtattggtaggctctatttggtatcttaaaattgtttccagccagtgggaggcctgtaccctagaagaaaatgagttgagttagctccaagtagtaccagtggtatttgcatctttttaaaattccttaaaaagcatttaggaaattagttcttttccttcagcaaaggggaaataaggtactctcaagtgactatggtagagtttggttatccaggatcatactctcacttttgcttcaggctacaaaatcaattatactgaaaatgcagatatcaagaatcccaggtgtttcgagtattgttctatgatactgacgccttccagtgtatggaactaacaactggcaaaaacacagacacacacagaaggcacacacacattctctctctccctctttcctttgtctcttctccttttccctttttcatttctctcaaggatttaatcaggtaagctttcagggatcttaagattctaccaagaaaacatgatgattttcatatctaaagttatacttagaaaatatttcaggtgggtaccatcatcgtgtaactacagggtaagactattccttcaccttaagattatttgaaccaatgctgccttatgtacttcaacatacataagattggtaagaagcactatataattttttcatcaagaagttacttgttttgctttacagatatttgtgttatttgaactgttatagaaatatcaaactgaatggtggataagagtgtttccaagccagcagcttaatatttgggctctctctacctcagtttatgcgattttgtgttgtttgacatgctggataatattttaggtctaaaacttagaacttcctaaatgggatgttgttttatcttgatgcattaaaatattttctttctatgaaaaagatatccaaaggtaaatttaataaaatgttatttttaaaaaatacaagctatttgaattataaattatttcttatattctattatttaaaatagcctcaatatataattatacttctactttagcatgaagccactaaataaaaaagggttagaagaaagtgattatgtaagtgtttatagctcagatacattagtagaaataataacattagtaactagcatttctgaatagtagtaggtactgtgttaaccatctaacatataaaaaatacttgatatgcattattttaatatttgcattgatggtttgaggtagggtattttattattctcattttccagagtttaagaaatttgaccaaattcctagcactagtaggaactcctagagagttccgatgttaagagtctgagttacttcagaagcaaagctcttaataagcaaatgaaacactccacttgacatttcctgttttgtaatacataatgatatcaaggggctgtggctcatcttattgttgaaaaatataatctgtagcctttccaaatcaaacctatttcagacaaaccctttgctggggtggaagggtggtggggaagcgagggagaatgccctacctagaaattctcatcctgttaaaatacaagttaagcctctttgagacacttgagtttttctactgtcttctccccaggtacttgccctgtttgtccatgactattttttcccgaaggttgatagagagcaatttcatggttacaagctttatgatatttatgtgttacaaatacacacttctatgtcaccaaagagctaaatatctttgaaaaattaattcttggggggaaaagaattatttccccttatcatgtgaattttcaggaagaaatttggaataatgcaaataagagatgaagtaaaatacccaaatatataaaaagaattcaaggaattcaagcatggtgtcctgtcccagagtctcactgttcagcatcactgttttggtattttcgtgaactctcaaaacccaaatatctccagagaggcaagtgttgaaacttcatgcttgtttttttgttctttttttttttttttccaaagataacccactgcattcactatcacccacaacattctcacagttcagaagaattctattaaattttttatacactgtcttttttgatggcagtgagccccttttgctggatatcagccctagaggcatgaattatatatctacaaatacactcataaagcaaaaaagccgggaagccttcagggctaaaatagaccttttatatctctaatgatctctctagtttaaagaaaagcacaatcctgccaaaaaggggtatgtatgcctgattttaaaatgctaactttaaagaatatagatagcttttatcccaaactaaagaaaaattctggggatagcataggaaattaggattttgatggattacaggttttgtattactctgctcataaccctttatgactttgggttatttgcttccatgaatacttttgtaggcatgggacacatagttgatcactgacttcatgatctctgggaagtgaagaaaatattatcagctacttgaacatttctcagggtagtcacttttgattaaaataaacaagaagctttgaatagcttcccaccaaactacttttttgtttgtttgtttgctttttgagacagagtctcgctctgtcgcccaggctggagtgcagtggcgtgatctcggctcactgcaagctctgcctcccaggttcacgccattctcctgcctcagcctccccagtagctgggactacaggtgccagccactatgcctggctaatttttttgtatttttagtagagatggggtttcaccgtgttagccaggatggtttcgatctcctgacctcatgatccgcctgcctcggcctcccaaagtgctgggattacaggcgtgagccaccgtgcctggccaaactaagttatttctattaatgatcttatagtaggagaaatacatcactttctcctctcaaatgatgtgtgcctttgatcccccaggacactattatcatctgcaatcttaaacatggaatttaatattaaaattaattacaccaacatatacacttgtcccaggcatttttcatgtttacagttatctaaaatgttctacctattttcattagaattgctatttgtcataaggacccccgtgtactgcagttgacttcattttaaactaaaggcaatcttcccacttcttgagaagccaggaaagaggggttaggaaagcttctaccactttgttgtctaaaaatcagcataatttgggctcagattttcccaacagagggtatcatttatcatttttatcgctgctaccgagattaataacaaaatggcaaagaaaactagagatcagtagttctgaaagattttgttttctaaactctgagatggcatacccatcattttagttttaaaataagctcttatcatttcactttgggactcaccaggcttttagaagctctttataaattaacaagcttcagaaccctcttactgtagagttataaaaaatgtggttactcttttttttttttttttaaatctaagatacttgcattagtgtgttaaatgagagggagatagcaaagtaaagtaattcaactgcagagtgaacagtttgtagattttgaaacaacaagtacactgtggaaactttagctggtattgaaaggagaaaaaacaaaccgaaaaaacaaaaaggcaaatttaagactccggttgggtgtcacagatggtacactaaaattgcaaatgaatgccactctgtaatcatgaagatggtgatcttaatcccacttaaagggacactagcctcttacccaacagtttgcctttatattcaaactatttgtaccagggctttgcctcctaagatatcagttattccttgtcctttaacctagtttcctctttgcttactctacatggggtagatttgtcattgccataaggaacaaatgactcggtgtttgtgccagaaaagaacacacatgttaaacctgtgttacagataagttaaaaaaaaaaatcctgccttgtcctctgaaggtaagtaaaactgtgcctgagaaatccttacggaagctttagacagagtccatgggccttcacttcctctctctcatcactgctctcctattactcaaaccttgccctctttcatatatcaccttaaatctaccacttgggaccccctagcagaagaataataaaaaagtttgctcagagttagttttaggactggcttacctttagggaactgcactccaaatcccatttgtaaaaactagcaaaagtgtgtaaattatgcattaaataagttgtaaggcatatgaattatatatgttcacaatgtaaaaaaaagaaaaaaaaaaaaaacaggtgtctgctggtctagtacagtaagtgtgaatctttggcaaatctgcacagatcattttgctcaatagtttcaaactctgagcaccagaatagaggcttaggtttagagcacatactacaagatcatcttgagaatctcaaaaaggtatttttttaaatttcatagtaaaattatcacataggccagagatgacactgcaacattctgttgtcccttcccttctaaatggtacacattatatgctttctcggttccctcagaaactcagtttctttctgcagaacacaattgttattggctaaacagggagagaataaaggcttctgacatgggcaccaacagtttctcagtgcttgaaggtaggtattagctttcttctcaggaagcccttctcttagcacacctgaaacctggacaatttggatgcatgggaaaggtttcaggatgcaaggtgtggaaaggttgcatcttgaagcatttcctatgcattcaaaaggagagttttaatttgtgaatcaatcttcataggaaaaaccctggaagactgtgtaggctccaaggcttattcacttggagtcccctagaactctggtactgaatcacctccttgtctggctttgttactgatgaggtgggtacctcagctacagtcttatctgttaacagctactcaaacactgattatactatcacagcaaagttattaccaagtgtaagagacacacgtacgtggtaccagttgacagctcaatgggtcagctcagaaagaggccttcaacaataacgtcacattagtacctcaaccttctaaataactggggcagggaaacattcgcagcatccctgcgagtggattttttttaagtgatagtgggaatacatttttctggaatatattcaataaagagacatggactatgacttcttaagattcttcctttgcttggaaaacaacattataaagacactgaagagagatcagttatcctgctgacatagatgcatagcaatcttggccttacagtagggtaagcaaccactactgcagaatatttgtggtacccatgatctgcaaggccctgttatttaatgaactattctgagctttctttcccaacttagtctgtatgattctaagtgcaataacgagggtctatgggtaaacagatatgtttttgccacactagttagcaatcaccaatttaaaaaactcactttgctaagtcaacatttctgagtctaacagtttcaagtcatggatatctaggctgagtattttgaaaatctagcttccagctcagcatatattgcatacagcatgaaagcaatgcatacaaatattagactaatgcaaggcaagctgtcatttaatagtcagggggatttctggaaaagcatggtcaaaatggatttgttagatgaatatttttaactttttaaaaatccctattgctcagcttatagtaaacaaggactgtgattaataagtgtgaaataaaaggaagtaacttaagaaaacacaaaagacacaatcttttatgtttcttgatcttggtctcaataagatggtgaatcggtcattctcatcctcctgggagcaaatgagcagaatcccaagaaggcaataaagaaatcttaaacgcatgttaataaattcttaagttaagcacacaatgtgtgcgtgtacccacacatgccaattttgatagccagccagtatttataacagtatcattgactgaatgtcatcagcccataagcagatcctggaaagaacatatatagttgaattttatctaaataattacttgagagtatctttaaaaaatctaagcccctgatctagggatttcaggtttgggtggcaagaggcatacagaaggctccaaatctgcctagaatgattagactccatccagaaaagatccagatctttttattataatttctgaggcataatctgtgaatgacgttggttgagtgagagttgtttacaaatatactaattgtttttctttttcttttccatcccaggaggtgaattagttatccctcttcttgtagaagaccctttagctacccctcctattgctactcgtgcaccttccattacactcccccctacctttcgccccctcctcaccattattgagaccaccaaagattccctgtccatgacctctgaggcggggttaccttgcttgtcggaccaaggcagcgatggttgtgatgatgatggcttggtgatatctgggtatggctcaggggaaacctttgactctaacctgccccctactgatgatgaagatttttacaccaccttctccttggtaacagataagagtctttccacttcaatcttcgaaggtggctacaaagcacatgcgcccaagtgggaatccaaggactttagacctaacaaagtctccgaaactagtaggactactaccacatctttatcccctgagctgatccgcttcacagcttcctcctcgtctgggatggtgcccaaattgccagctggcaaaatgaataaccgtgatctcaaaccccagcctgatatagtcttgcttccgttgcccactgcctatgagctagacagcaccaaactgaagagcccactaattacttcccccatgttccgtaatgtgcccacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagttaaaaaagaaaaaaacaccaaaaaacaaaaacaaacaaaaaaaaaaacccacaacccttatctggttctgaccagtgtgcgtgtaactttatgatctgaggggaaaaatggcttttgggtttttgtttatttttttgataatgactggacatcagaagaggaaaaaaactcaaaacaaaagcgagagagactattgccatatgaactcaaaagctatcatggtgttcactctacatatcaggttatggtgtctctagaatctgttgtttgtttcctataagatgctttgctgaacacatagcaaaattcatgtgacggatgataaattgattcgaaaagctggtcccccaggatctaatttcagaatttaccacccaaacccggaacagatgggtttagggctggtgttatcagagctattggctttacgtaacaatattgttcctgtccattcacccagccaaattgtgttaaagaggaaagccccacaaactaaaacagcctttcctagggaagaggaaggggaggtgggctggatctgtgactgattgaaatgcatgcaaataaaaaagacaatattaaagtctgttatcaaaccagacagtaggggagttcaactcgtgatggaaccacaaaaggtcacacaagccaaccatgtcatgccagagtacaaaacacatagttctttccccgccccgaatgtgacaatggttttcatagtggtttaattttgtagcctgacatttatggataactctgtccttccatttgctcacttctctcttcacccatcttttttaaaaacaaataaatgaataaagctgctgtgacacacacacaaaaggaatttaatagtataatatatatataaataaatatatatacagatatatttatcatggtatgtttgatgggatgactgacacaggaaatctgttaaagtcttaaaatggaatgagaatgttgttttaaaagaaaatagcaaaacaacaaaaaagcaaaccttaaaatgtgaagaaagtgtgaattttagttttgtcacagttaactgtgtcaaagagaattaaaaaaaaaaacttcagattttgtttacatattttactacatttttgctggtataattccttagccacctatgtacatactgctttaagaaatgtttttttcctgtttatttctgtttggtttatattctggttgtctttttctttttgtaaagaggaaacaatgtacagaaaaacaataaactggttgtatggccatagctatccgaaaagcaagagacaaagcaagacaaatattcacacaaaaatgaagtgtgtcctctggagggtcagatatacaatttcttttgtacagatgaaaatcaatcagctgcttagatttagaaatctactcttgctggtctttgtaagttgcatgaatatttgactttgaaaaaatatcttaacgacatggggcaaaaagtgcaatctaaatggtagcctttactaatgtgtgtggaaagaggtgttcctcattatctaatatttcaatgtgttaagagtttaatttttttgttatcattaaaaaagacaggattataaagagatatcaaagcacgattttagataacctaaacggcccagcctatacgaagttgattatatctcgatgtctgtaaaagattgctgttcttggagtcttgaggtcttgtgaattgatttcctgctttctttcatttttttcaatttaagtaataatacatttgttatattcctttcagtgtaagtttctatttggacaattttatgggaacatgtgcattctctatgtgagcttctatcatattcctgttttattagcagaacctaaaggaatttatttaatgatgttgtgacattactgctttttcttttttcttttcttagttcatatttgcattttcgttcaaggatatgcttagcaataaaatgttcttcccaaaaccttgtatgctgatgcacttttattttcttaacatttgagaaaatctcgcactgaagctaattatgtcatatcttattaaaagccgagtaagagctagaccactttcatgtgatagaagatattctaagcagttactaattattacattatcaaaatgccatatttatgagataattatctgttacttgaggcattattttttagattgctatgatagaataaccaggagggagtgcatttttctggaaagatgatagaaacattgtattctagaaaagattattggatactatggttttgtttgtttgtttttgttttttgtttttcgttttttgtttgttttttttttgagacagagtctcgctctgtcgcccgggctggagtgcagtggcacgatctcggctcactgcaagctccgcctcccgggttcacaccattctcctgcctcagccccccgagtaggtgggactacaggtgcccgccaccacgcccggctaattttttgtatttttcgtagagacggggtttcaccgtgttagccgggatggtctcgatctcctgacctcgtaatccacccgcctcggcctcccaaagtgctgggattacaggcgtgagccaccgcgcccggcttggatactatgttttttaaaggcatttcgtaccttttacgtattttctataagtcaacaagctttaaacagtatttaaaactatgttcacatagtgccataagcactagaaagtcttagatgtcttctttccaagcctcccaccatattaaaatttaaaattaaaaaacagaatccaaaaccaaaatttaaatgagttcttcaattttaacagcttcttacaagaatttctgattacaacttgtttcatacacccattgtagcagtaatgtctcatatttctcgttctctcagcacacacttacttggccaattggataatccatctaccctttgttcttcactgtaatctagaaatatagatttaactgaacagctgtcctttatccatatgttggttaccagttttcaaagagttagaattttaaaaatatatatttagttaagcctgtgccttcaagataacattagtggagtggttatactatcgactatgttaggaatgggggggagaaagtcaggttcagtgatgtcaaattatgtaaagttttttttttgttcctgtcttcaaagttctgtattagatgttctcccatcattttttgagatggagtcttgcagcctacagtgcagtggcatgatattggctcactgcaacctctgcctctcaacctcaaacgattctcctgcctcagcctcctgagtagctgcgactacaggcatgggccaccacacccagctcattttttaatttattttttatttttttagtaaggaagggtttcaccatgttggcaaggctggtctcgaactccttacttcaagtgatccacccaccttggccttgcaaaatgctgggattataggtgtgagccactcctcctgaaatctttctaaatctcactaatatataattctaggactactttaagcattcactttttctttaattcaagaaacatttattgaacacttatgtacaagctagtctactattggctattgttactttgtttcaatgaaggcagaaaatggctagaaggattttaagcctttttgtctcttgtataaatctatacaggtccagtctctctttgctcatattcaaattgaagtttgatctttctccaaaaaatatccaagccctgtgtttgtcccagttgaactaatatcttgattatatagtttaagatcagtttgataatgtctattgaatatttactaaatgattatgggatattaaattgagagccttgggagcttatcatctagtaaagatgaacaaaaaatggtactatagtgaatgcaaataagctatcaaaaagtacaaactaagttgggagcttagaagaaattatgtaagggaaggcttcatagaaggggtgacattttggtaaaccttggaaaactgataggcagaaataagggctgtatatcattctaagcaaacccttaaagtgggagcaagcaggatcaaaaccataatttggattgatgacagactgcaaaaagtacattggaggaagatatgagtaggaaggtttttgaaatcatgtcaatgaatgggaagagagaaatgggagaatagcttgagaagttcaaggtcaagggctgctttgtcgagtacaaaggactcgagcatatttgaaatgaaaggtaataactgatctactcttatggagcaaccgagtttcctgatagagatgtttatctgggggaaaaaggcataagtcaatcttcttggagagaatgggatcagaaactgacatattgctacagaggttacaaaagctgtagtcagagggcttcagtgttctggatatattaaaggacaaggtcagatacccaagtgggaccgtgagtgattaatggcagcagtccactgacagcaccagtaggaaggcgctaatgaaaagatctctaaatatcagtaaggggttagctgccattaataatacaactttatagctttactattttttcttttattgttgaaatagtgagggcacgtatttttctaattgtgtttattacaaagaaaacagacccgaagaacttaaatgacttctccaaggtcacacagctaatacatgacaatgtcatgacttaaaatccagtcttgtggttccaaatttagagctctttcataaacctgtctctagagaagcaagtcattttctactttttccagaagcatttgaagtggaagctaaggcaggaaatgagaggatattgtgttagtctactgggattaccctggcaaaataccacaggctgggtagacaactgaaatgtatttctcagttccagaaacaaagttgcagatcaaagtttgttagggctcagtttctgggaagggctctcttcctggcttgtagataataagctaccttctcactatgtactcacagggcctttcttctgttcatgcactgagagatttctttttcttgctcttcttataagaccaccagtgctattggttaaagccctgccattatgactttgtttgaccttaattacttcctaaagacactacctcccaatacagtcatgtttggggttgggacttcaacatatgaatgttggaggggatatggttctgtttctagcaaatgtatagtagtgggaattgcaaaggttgaagttccaaagtatcaagggaatcagaattgggaagcaattctaacctttttgaagtggttacatggcccaagtagaagagcaaataattccaagagacaccaagccacagagcaggtaggatcacgtgagtagggcccaggatagaagagcagtgttagggttgcatgagagtgagggcatataagacaacaacagctaaaagcaatgcatgctcagatcttgggagatgtattaaatgagtagagtgaatttcaagatatctgagttttttttttttaatgattacatgggttctagagtcaaaatgccatggctcatctggtactgtaacttaagataaactgcttagctaaggctcagctttcatacctataattttgttatacttatcttgcaggtttcttgagaaatattggatgaaataattcatgtgaaatgcttaacatatgtgtgacaaataattatccttaaataaatgttggtcgttattacaattggctttgttacttgattcaggcaggatcaaaattagctgctatatgcatgactaaccaggaccaaaaagttaataaaaatacgaaagtttggcactcttagtttttctctaattctttcatttgccaagacaatataaaatttagttgctagctcattagcaaagattttccttcatcagcactagttatttgtttccagctaccagcttcagttaggcccagggaagccctgcatcccgagaatgtcactccttttctgagtttccatccttcagctttcttgtggcccttggtcagccaaatacctcaggcaaccttgcacccctttattgatatgcattattttgtttttaactttttattgtgaacgttttacaaatataccccaaagagaatggcgcaacaaacccccatttatccatcacttggtttcaagatcaatattttgttacccttgttttatctgtgcccacctccctatgaaagaatatcttgtaatattacacaaagttataaaacaaaaagcattcaaagagttgctgctgggcctctcgacctgagtcttatttagtgtttcagtgtacctaagcctaacgttctttctgatggacaattaatggcatgattctagttctttattcagtgacaacctaaaagagattagctgctaagtagactcttcatcatttaatgagattgcctgaaaaagtgaaagatgtttcagcttgtacgtatttcaattcaactgtgctcaatcaccttttaaaatgaataaaaagcggtctatagattatatattgctgctatatcttttgtaaaatgtgccattgtggaagagaatctgtactctttcaagagagtaagtaaaaggggagacttctaatttgtacatgtgaaagctaagaaatacctttacctctaaaaacatgatcacagatctactagcatattttaagagggttatattcatgtattttcaatagctgtaactatactgaatttacatgagtctacacagaagagatatccttaagcacattttcaagttatgattttttactgctccattgtcttttgacaatgattttcttctttgttctcactcacttgccatttttgacctagaattttcactataaaaatatcatgagagagagactcagagacacagagttatagactatttgatagtacattcttttctaccataaagtcaaggtaagtgttaggatgaatggacagaaccactataaacttttgcttcttcatttcatggagccaaatggaacatagaataattagtttcaacaagttaatgatttttctgttcctactctgcatttggtagtttgatattttatttattttggaaatttagcagagcatatataaacattcttaaggcaggtcctttaggtttgcaaaagagtacagtagacaggctgatgggtgggggtcagaaagtagataaaaacagaggcatcattaaaactgaatagctaaaacttccttggcattacagtatagttttcaatgttcatataccacgcaggaaaatgtacttatatgcatgtatgggtatgagtaaccagatctggtttgatgtcaaatttgatgtgggaagtctaggacagttctttcttaaaaaccaaagcaagaaagaagaaaaggtagggcaggggaagagagcagaggcaggagagctgcttctaagcagtttgtaactgctcagaagacagttccagaattaaagcatgtaaaataataatgaggtctctcccttcatgccagtagtgtctgatgctaacagataagctctgaattcacgcacacacacacacacacacacacacacacacacactctctctctctctctctcctgtctctctctctctctctctctgtctccacttcttttgaacaaaaggaaaaaaatgagttgcttgttcctatatggtaatacattgtaaatcgcttcaggtattgtgcttgtcttttgtactagaacttgtgtatctttttcttttaaaaatgcaaaacatatttaaacactgctattataaacaccacttccctaaaatatattttaagaacataattcccatatgtgcttaggtggacaggcttgacttcctcatctggcaaatgacaagctgcaatttggtacatatatgtacaccagggcaatagcatttttttttttttttgagacggagtctcagtctgtcgcccaggctggagtgcactggtgcgatctcggttcactgcaacctctgccttcctggttcaagtgattctcctgcctcagcctcccaagtagctgggattataggcacttgccaccatgcccggctaattttgtgtatttttagtagagatggggttttgctatgttggccaggctagtctcgaactcctgaccttgcgatctgcccactttggcctctcagagtgctgggattacaggcatgagccaccgtgcccggccggcaatagcttttataactagacaggttgatgttatgaagtagtaactggcaagtgtattttactgagaacattaggtatagataagttaatgggctttgaaaaaaaaaaaggataaaaagtaattggaccactccttggtcacgattaacactgaaaacagtaatatttttttttaattaaaagattttacaggtcaaccatacatggacatgtgactttgatatttctatgacataaatcagttgaagtgggaccgccatcatgcctatatcaaaaagccctctacatgcacacaaaaaggagaaagttttcaaagcctaagccagtcaaataatgctcagatgaaacagcggattacaaggcctcggttaacaagtactccagctcccgaaccagtgggcatcccaacattgactttggcaggcaggtgctggatgacatgcagaaggggtccttagaggctgtttccccttacacaacctcaaagaagtttaaattttcaatttactttttaaaagcagatacacagtaaacattggaatgtgagttttatgctaaatacattttggtttcagagtagttatctcatgctgccagaatagccctgaggattaagatggtttattgggatcaaatgcctaggagatttattatagtgcagactgtttactcattcccattaaaatgctgataatgcttatttctttacctctctctcccgcctgctttcttccttcctccataacccatattctattattttattttcctgctttaggttgaatctacttagatttttattctttattaaaaattgaatccttggaagctctctgactttatggctgcaagaaagtggcaatggcatacatgcagctcattaaagccttgggaacacggaatccctgcttagcaatttagatctaagaagtattttcagggagagtgtctaatgactggagagatgggtacacactggaacaatttatattaaaagatcaaaaacaccctggctatcatcatctataatataaagtcacgtagaagtaaagataattttcttccaggtagatgctttagttggataaagaggaagattatctactttatggccaaattctatgtaaattatatgtaaaacattcaagaaggcagatgagtttacacacaatatagcagcttttaggaaaatagacatgagacatcagaaaatatgatcacttaaactggaaagctagagcccaggaagtaatcctggagaacttgataatgcatccatatttataagaaagccaatcattgaatctatgaaaatatgtagaatgattttatgaaagttgtggttggtcaggcaagtgtttgccatgatctaaaatattcatcttgaatcctcagtaacccttacagtgtctggcacagaggaggtgactgagcaactttagtggaaggaacaattgaatatagctgatctgatactcatgggatgtacaaacacatctttatcattttccttttttttttcccccagtactttgctttgaaaatttgaggccagccatttgtcaaactttagcacgtgtgagaatcacctggagggctcttcacgacacagatcactgaccccactaactacagttcatctggaatgagatctaaacatttgcatttctaacctgcaaaggcagttctgtgctgctggtccatggaccacattttgagaagcacagtagcctataaagtcacaaaagagcaattatatacttcagggcaaaagagtagtcaactccattaatttaaaaagcatgacttgatgtcttttcctgcccaatggctcagatgtcttccaatctgaaagctctttgaatctatgatgaattatttggatactgctgatgtggcagagaaggaagctgatttgctagaggaaagtgataaaagaggaatgcagccaattgagccttactattaggatctgtgctaaactcttatctcttgtcacaattgagaaaaatcaggcttagagagtttaagtgacttgtccaagttcacacttccagtaagttgtgagatcagaacttgatccttccctgatacctaagaaattaagacatgtaagccaaattccaaatataggccatggtagcagaaccagtattgacagcaatattaacagtgccaacaattatagcaatttgaatattactcctaaagagtcctatgatatggatattatcttcattttatctttgagaaaactcagaaaaataatctgtctgagattacatagctagcaagatatggactaaggagtataaactccaaagcctgccttgtttatacaccactaagacctaacatcaagcagtacccttcctagaccctttaatgtaaatacatttatcaaatgtggatggcctataatgttactataggattccactaaatgaaattttgtcatttgcccattaacgacagatgaatgctgtgatgacctacctgatgcatagtgtcaaacttttatgtccctatccataggtttactgggtccaatagtacatttttataatttattttaacaaagcaatatatacatatagtttaatgggacaaataaaagctttacaataaataacagcagccccctgctctagttttccttcactcctcccacatcctgcttgccagaggaaaccacattctggtcttattttctctggtaattacctccacatttctccagataaaatatgaacctatcttttgactcactgatttcagatgttactgacttcctaatgttaaatgttaggattttgtctgacacctccctttctcttcctcattcttccaatatagttatattatacattttaattaaatactgttaggtccttttatgattatgactacaaaaatactgtcctgttgactaaagtatttttagaattccttttgcttttctacctaaatttttataaaatgcttagctttttctggaattgataatcacttttcattccccccccacctcacctacttggattcatttggctaaatcttctcactcccattaatagctttcacaaatgactcaagataagctttcacaaatgactcaagacaagctttcacattgtcaagtcttactaatgatgtattcaatctccttgtgttaatctttgaggcatctcccccagagttctctattttcttgctccaatctgaactggttgctctttcaaccactttcacagctactacccatcatcatcaacttggttttttcatcctctcctgtgatggatttcctgttttctggtttcacattgttcctttacattattcccttagtttagtaaagcacattctctagtagccccctgaaaatggatgtatcatatgtatctcaagatttttcatatctggaaatattatcatttacatttgatacttttcttcaagtacagaactctagagataaaattctttcccctatttattgtatttctctatggtcttctagcttctaatgttcctgctgggtggaccaatgacattttggttctttgtcttctgcgtgtgacctgttatttttttttccccagaatattctctccctggtgtttcaagtgccatgatgacatgctttggtggctgctgcttggttagcaactctatgaaccttacaatcttgtcagcagaataaggattatattcagagtttaatcaaatatttcctcctcccatctttttgtaaccgtatgcacacactgcaagagagactgcatgcttcctttttgcaaaactctgtgcaaggcatggttcctcctttcaggatgcttgacatctagtaaagtcaggtgtgataagcacctaatctaaaatagaaaacagaattttaagcatcatatatgaaaagtatcacattgcttcaagaaagataaataattttagatagggagatgggaaatatgctaagagtgaggggatgtttggtgagttaagaatgttggaagagtggtaaaggtagacgggaagttagcattggaaggtgtctgaagtctgggtggttagcacctgtagaagaggtagaagaggcattcagtcataggcatcaatatgtggaaggcataaaatgggaaaatgaaagacttttcaagaataacaaggtggctggattctagttgacacatggggaaatgggagatacataagaggaatttggggccaaaatacggcaagctttgcatgcaaactcaattgtagggaggtaattgatttcaattcaattttttcatttactagttcacatttgctgacagattaccgtgaaccagtccctggctgggtgctggagagagacctgaaagaaacaaggctcctgctctcaagcagttaggtgtctgtctcacgtgagactatgttgtgttgtacttctgtttgtacctaagttctacagatgaagtgtgaatgagatatataatttgcattgggaacacagaaaaaggaagagccagattgcctggattgtttagaaacggccaaaaagagatgatggcaccaagaagagaaatgctattggtatagtttattggaagtattggtagagtattcttggcaaaggaaatcacacattcaaagacacagagataagaacactggtatgtatatacacttatatttattcattcatcctacaatttttttttttttttgagacagagtcttgctctgtcactcaggctggagtgcagtagtgtgatctcagctcactgcaacctctatctcccaggttcgagtgattgtcctgccacagcctcctgagtagctgggattacaggcacacaccaccatgtctggctaatttctttttctttttcttttttttttttttttttttttttttttagtagagacgggatttcaccatgtcggccaggctggtctccaactcctgacctcaggtgatccaccagcctcggcctcccaaagtgctgggattacagacataagccacggcacccagccacaaatttttgttgagtgcttattaggcactagccatagtactagccatgctcgaggaactatagatctttcagtagagaatatggtgtccctcctaggctgtcagcttcatgaggccaggagttatatctatcttatttgttgttttgccaatactttatatttgttaagtgaatatatacggtactatagtaacagatatctatagagaatatgagtacacaatgataaacatgttcatgaaagagatgttttaaaaattagaaatgtttaatgttaattaaaataaggagtacagataaaattgtttagaggctatgtgtgtatatacatatgtgtgtgcatatgcacgtgcatatatgtgtatacatagacatatatagacactgagggctgactatgtctatagtcattctccttcctcagtgtccatggggaattggttccagtgtcaccccagggataccaaagtccagatgctcaagttccttatataaaatcatgtagtatttgcatatagcctatgagcatacccctgtatactttacgccatctctagattacttataataccggataaaacttataggctatattaatagttatttgtatcaattaggaaataatgacaaggaaaaaaagtctgcacaagttcagtacagatgcaaccatccttctttgttcccaaatattttcaatctgcagttggttgaatccctgaatgcagaacccatggataaggagggccgactgtacacacacacatacatacacatgtacgtacatacacacatatacacacacacgtatttccagtaaaaagaacagaggtcaaggaatgaaatacatgggaactcaaacatttttgcacgaaataggaaagtactatcattacaggagaggcgacatctaccacgccagagggaaggtttgtttatttatatcccctgtaaactttgactggtaaaattgaacaacttatctctggagaatttttttttctttttttttagacggagtctcactctgtcaccagcctggagtgcagtggcacaatcacagcttactgtaatctccgcccccccaggttcaagcaactcccctgcctcagcctcccgagtagctgggactacaggtgtgcaccaccacacccagctaatttttttgtattttagtagagacagggtttcaccatattggccaggatggtcttgatctcctgaccacgtgatccacccacctcagcctcgcaaagtgctgggattacaggaatgagccaccatgcccggcctctttggagaattttataagtgccccttctaaaaacctcaatgctctgtctccctcagcccttgaacatttggttccaccagccaacatgattcctgcctctagaattggtgtttctactttgcctttctttagtcattgaatcctagttatatccaaactcaaacttagctcatgccctgtgtgcctcaccaaatagaaaccaatcccagtgtttcttccccatggaacataaccatgatctagccacttgaccacactacaatcaagaaaaccctatcctcttctcaatggggcattttgacacgggacaaagtggccgcagaaggtacaaactactttaaagcattatcaccaaagcatcacgaaagggagaactgcctttttgaagcacagcatttaataagacctgaaaagtaggtcggacccaggggctcacacctgtaatctcagcacttcgggaggccgaggtgggtggatgacctgacgtcaggagttcgagaccagcctggccagcttggcaaaaccccctctctactaaaaatacaaaagattagccgggcatggtggcaggtgcctgcaatctcagctactcaggaggctgaggcagaagaatcgcttgaacctgagaggcagagttacaataagccaagatcacgccactgcattctccagcctgggtgacaaagcaagactctctctcaaaaaaaacaaaaacaaaaacaaaaacaaaaaaacacctgaaaagtattcttcgacttccaggaatagaacaaagacaaactttttgccctcaagaggctcaaggccttaagagacaacactcactataggtaaatatttaattcccctaggtaagcccagcgctgcaataggtttatggtgggtacccactgtatggttgtggaatgaattaatgcacatgccatccacgctctcacctgtttctttgacttgggtttggcacctagaaggtcattgttgcccacataagaagattttccatgcagtaatagaagcagaagtcagacagcaaaaactaaggactgtgtgaaagatgagaaagtcaagtaaatgggcagacaacctactattctggaaagattaagtttttaagagacatacaaattttcttgatggcaattatttgaaaataaaagtcagagtgccccacgattttacaatgcaagtagattctccatatgccttctatccctcaaaagtataaaagacaagtagtcagtttgcttggcagcctgaaatctctttaaggacaaggaccagcttttatttattattgccattcctacagttcttaacttggcatttgttgcataataggtacaatgtttaaagtacatatgttgaataaattcacttatgaataacacaaataatatgctggctatttttacatattctacagtataagcaaggggagaggagtaaaactttaatagcaaaagatggaaattgggcaaaatgtatcacttggccacattttacacatgacatccccatgagataaacaaactgttggtggtaaatgacagtgagtgaatgaataaatgcaacattagatagaaaatattcaacatatgtacaatcttagttatgaggttattttaatgatcaaaggccttactggatattgaagtgtttgtttagtcgatgtgtgttcatcagcatgacacctacaactgttcgccaagcattttggggtgaatttatcagaacggactccaagccatctctaatgataaaatgcataaatatatccagaaggagaagcaggtcactttttcctacctcacattccctttcccaaaggaaactgattgccaaaaagtgccacctctctgcttatttttattattcagcagagagtggggaatatagtgccatctcatgcattaccattccagagacgtgatcagtaagtgcagtaattgctatgtggaagcaagaacagattgtcatgattccttaacctgggtagaaaacagtgcatgcatcttgtaatttgctttgtagattgctaaagtgattgacactgtgggttacagtgtataattttcccttttttgtgtgtaagactgcataattccaggcatgtttgccatcatatggcacgaggcattatcattcaccttgaatttttcctaaacttgtcttccagaaaaaaggacgaaaacaaggcagcaccctgtcttcccatggccatataaccacttttgaggagagaatgcaatgaaataagtaccatgagaaagggactaatctttctttaaatgacaagatcttccatagagactgcagcccagtgatagaaacttcttctacactgttcctgatgctttattttatttaccacagcagctaacactccactctgggaccagaatacaccagcagaaagatctataaagaatcattagagttttagacagatgtattcacaattctacaaaatacattctcaactggagttagttattagctggtaatcagctttggtagcaacatgtatcaaagctcaaggaacctcctcatactgatcactcaccatcttgtgccatctgggtagaaatgtacaaattcagattttacacatttataccgacaatgggctacactactagaaaaggtggtgggagagctactagcatcacctgaaatgtttcctatctgactgaaatattcaattatggctactccaataaagatacaagttctgggaaataactgttttcagaacgaagtcagttctctatcagtggtttgacaaggcagaatgactgattgtgaagagagtctttcagagaaatggccaaataattcctagtggggacattgcatcactttaatgtaaaatgttgggaagaaaattgaaacaaaaatgaatacattgaacgacactttgaaagtaagtacaaaatagtaaggatacctgtctttatacagagaagtttccatttaactggtaggcatttccagaaactagacatgttttatttatttttaaaactaaaatgtatttttttatttttataaatatgctataaaaataaacaaaataaataagcctattttatgtttcctttttctactactcaaaatattgcttcacaaaagtgagatgtcattttcccagaattttttttttttttacatttacctatttttatacctgatttagattccctcttccaggagctaaaactggctaccatgcagataatgtcaaaggaggaggaataaaatataagaggtatcaataggaagcttgaatttcctgagagtggagagtcatgagatctgctcatctttcaatgtgtgcttaagatgccatgcctttgaagagacaggacaccaagcgcaggataacatccattgtttcacaccatggaaatatagcctattttaagatagcatctacagaatgccccaaaaggaattccagtgctttctattatttattttagtttacctcaacctccttttgggattgaaagttagtggttccagatccctaaatcttcctgaggactaagggtacatttgttattttttttttgtcctgttttcagccctactcctctgaaatagcctgagtacacacgtttttgccttgctgaacttttttccttttacctcccatttgccctctccaattcaatttccttaaaaaaataaaataaaataaatgggctgtcagaaactaaagctttacacactggagcctccctgcattcaggaggtaatgagtgattctttcacttgttcactacactctaatcctaatttaaggcaattcattttatgattttatgtcttggtgatagtatctcatgaataacaatgaaagaatgaaagaatattctatcactgcagactctcttacaaagtggtgacatataaatgcaaagataattgccatttaaaaataaaggttcttttttctttaaaggcaatcagttgatactaaaaactagtcaaaacatatgttttccacttcctgctttagtctgattaatacagacaagctttgacccaaggatactatcactttgagagtgtcactgatgtttacagtaaaagtaacgagttctacttaaaaattgacactatgcattagaagcaagaagttatctaataaaagaagattggtacatatgcaattagggattcaaggatcaattgtgcttttaattacttagcacatcaggaacttgatctcaataatccaaaccatgtagacagatcttgattctatggcaaaaatgatctgagaaactggaataattaaaactcacagataatcccaaaccgttatggcaacaattcattaagatctccttccttagagaaatggttttataagagctacaaatcattacaaaactggctggcttatgtctcctctcctttgatgattccactgaaatctccggggaaggccatgcaaagcagtgaaatagccaagtcaggaaggaagagaaaagggacagagcttcaaggagaagccataaaacttccaaatgcactagactgtcagtggtgagtgtgtcctcgagaatagttgaaaacaggatttgcatcattccacgtaaaacaggagtgagtgagtaacctatgggagaaggtgtgtgctgatccaggtggcaatccccaagctagaacatgaataatttatagtttggtaactacgtagaaagacgttttagacatcatttttcccttattttctgcctcccttctattagcctcagtaataccagcatacaagactctttgttatatccaagtaagagaaaatcgcagtactctcaactttatctttctcctttttgttatttttcactggcataccccctgccttatcagtcacagcctggactaagctcttgttacagacgacctaacttctgattcaccaagttccttgattaaacaatattttatcctcaaaacttcattttacaaaacctagatacatgtctgccaggtcttcatgccctcatttcaacaagactctagaaaactctaagcaagctttatcattctgtctcacagtcatctatcaaaatctatgtttatgcatgctcttgacagtaattttcatcaggatgttgcaaacacatttcccaacatgaataaaggaaatcatactcaggaatgccaaaggagcacagtgacttatagacaattgacccaggaggggttttcctctctcagagggatatcctttggccaaggatgcaacatggagaaggggcatatgtagaatattaatagagaaagaggtttaggcccaacaactaaaataatctgccaaattaacctgggcaaccaatacataacaaatacaacaataccattgttgatactttctgaaatcaggcaaaaaaatactgcctctttctcttttccctccttcccttccttcttgtcttgcttgacccctattaacttccatatggacggcatcagattcaagaggttgaagaagagacccggagccagagaacaaatcagagttcaattgggagaacttacttacagggaggtgcaaccgcagtaggctggacaggagaacagcaaccgcttctgaagaagcatgccatttatatagcagtatcacttagcaactcccctcagcgatctccacattgcaaccctcatttcttaagctaagtcaggtgtgtctgccataaggtcatcattaagttactgctgtcaggtgtgtccatcatacagggtccttctcaaggtttacttaatttattgctgtcaggtgaatctgccacacactttctttttttcttggttctttccctccttccttcactatcacttcttgagcacgattccagatactctaagaggtactgataaaatggtgagggagatagactcaggccttgacctgaagcttacagtccaataggaaagttgcacaaattaaaaagttcaaaaaacaaaaacaaacttaacagggtaaaaaaaaaaaaaaattggtgcatccacccagcagttgtcaattgtaattaatttagtctagggtttctatcagagtcagaggaaggctaaggaagtaactttcgaagtgagacctaaaggatgaagaattaaccaaatagcacagtagagaggagatgagaaagtaggcagtagaagcctttcaggtagagaataatagaagtagagaggaagcctcagagagcatgagtcctgcaaggaacagaaatgaggccggttaggctggagcggaggatgcaaagggagaaaacagagagtgataagaatacaaacgtaggcaggaaccagagcataaatattcttgtgagctaggtgctcatggtgcaaaatcccaggctctaaaattcagacatgaaagcatctatctccattttaccttaactcaacatatttttaattatgagtattatgataaagatcggttagctgtttaccaaatccatttcccattcctcctagacatgtgagtagacaaggtttgccaatctgtctcgctattagttatggcatgagtctgagttctgaccagtggaatgaaagatgataacatatgcatcttctaggcctggcccataaaaacctccagtgtagtcctcgctatcttccactatctcttccactatcagtcagtgggatattgatgtccaaggtgaccttggaaaccatgtggaaaagagcattgctaccccattactgtatgcacatgcatgcacacaaccacactgaacagttgttataaggatgatgtttctattgtgctaagcatttgagattttcgtgtttatctattatgccagcaaatcttaaaatatggtttcaggagtagcagcatcagcatcaccttgtaagaaatgcaaattcgtgagtcccagcccagaactagagaatcagaaactttggaggtgtggccagcagtctgtgatgtatcaagccctccaggcgatcctgatactggttaaatttatgaacattctattacatcatttcacattaccttaatccactcaatccataataaaagtaaagtgtaattaattcaggagagttgcaaccaattcagtgtttccttagtcaattcaacccatgtacagtgctaatgcataagattgggtccatctgacccttagttattttactcacctgtgtgatctttacgatttctttttcttttcttgacaggctttggttgtttctctgtgaagatttgtcttccttatgtcaacttataagcttcttcatgttgggcctccagctacttttgcatctttctttacacacaagacctgaatgctcccttcaggaaaacctaaattctcatgcagttgtctctgctctaatgttttctgctgtaggagagctctttgttttccaactcctcagactctccctgggttgttaggtacaggtgtcccatattctaagatccccctcccaaacctgcctgagttttacgctcctctttaaccaactcacctagtacagaggcaggagtaggactgtcttagaaacaaataacacaatattccaatgagataatatatggccagtttttaaaaactatctcagtgaatcccttttctctggcctattatgaagcaaggaaaactggctcttcaattgctgatattttcacgttttgctaaatctattctttatggcataaaatttgtgttttagtttttatgaagtcaaaaggtaactgaaagaaagtaaaaagactagcaatatactgggagaacatgtttgcaacatataaacacaaagaattgtatagttatacatatgttcatatataaacatacctatataggtaggttaatacagagatagatagctagatagatatcttactaaatcaatagaaaaaacaaacatgccaatagaaaaatgggggaaattcagaaatagctatgtacaggaaagtaaacacatggttaataaacaggttcggccatgttactaatgctttagagaagctaataaaaaacacatgagatataatttgatctcatttaattggtaaaacaaagtcaagaaaaaccagaacagtgatcaacagggtttctaatacagtactcattgaaggataaattgatacaatcactcttttctttttttgagaccaagtcttgctccgtcacccaggctggagtgcagtggtgcaatctcggctcactgcaagctccgcctgccgggttcacgccattctcctgcctcagcctcgcagcagctgggacaacaggcacacgccgccacgcccgactaatttttttttttttttttttgtatgtttagtagagacagggcttcaccgtgtgatacaatcactgtttaaacaatttagcattatctattatggttggatatctaatgaggttgctatgttccagcaattcttcttctgcttacccaagaacaattcatgcttatgtgctcaagaatgaaattacaaggtgaggataaacaaaatttgggagttatccttgcggggtaggcagaagggtgagatagaagaagagcatgtaagtagatgcaagttattggtaaagctcttgttcttggatggtatgctgagtttgtgggtgctccctacattattaaaaatgaaacaaaataaataagggctttgtaggagccaatgaaagggggtttcatgagccaagggtcagaactcatttaatgacgagcatgcagggtccataggagaaaaaataataataatcctttggcttttgtaagtcataagctctttttttgctgagaccggtaagattttaaattacattaattattacaattattatcattattattatttgcttctctgtggcaacttttctctcctaaggcattgaatggattccatgaggtgaaaaaaaaaccattgctggcagcaaaacaagcatttggctggcatatgaaaaaactattaataataagatgtgtagatgtacacttttaagggcttttcatttaaacagaattatggggtcttcatgagttatatagaatattaacaaattaacatatcctacattttcagaaagtctgagataggtcagtttgcatgattagctactttctagtcatttatcttgagacaaagcagttgttcccatttattatttgtgaaatgtggtttatgtactatttgcttaacttcctcacagacatgcaaagaaaaagattttcattttttcaaacaaagatgatgcattgtgaaaagtatctgtgaaagaaaaacctgatacctaaccatttcacccacaaataaatattctttgataatacagtgtctgggttaattttttttcccccaatccaaagtgtcattggtgggtcccattgtagcttttaacaacatgaaacacattcttaaactgtaacttagtgcttctaatgaaggacactttctttttttgtgtgtttttgaaacatgatagcaatttaatattaattcttcaatttggaaaatattggaaatattctagaaatataaacagaggaaatagagataaacagaagaaacactatcatatcataaactcctgacaaccattaggcaataaacacagttttgagaacatacaattaaaagattatcctcactggtaaaggcctgacttcgttcaaattatgaaagaggatttcagaaaagctgctcttaagtaaacttacacacaaaaagaaacaataggaaggccccaaatagattttttaaaggaaatgttacttagatatattttagctagtttgctttaaatgaaggccccaatttgtgctctgtaggatattgtttattttaaaatatatataattttagtaataagttctttatgtgaaaaaaatgtacctatagctatgaattactataattaaattgaacatccaattgcttgtatcattatttataatattaaagaaagtagacacaatattcaatagggaattatttaaattatgttatatcattaaaattcaactaaaataaaaataattattagcctttgcagtactgtttcaatcattttgcggatattaaaatacatgtttatcacaattgtaactatatgagcattttattattgccctgttgctgtgttgggagagcaagcagtatttttctatatttccgaattttttatagaaattacaaccaccatgataagcatccttgtgggaaaaacctttgttcatattcatcgttgccttacaactaattcctataaatagatttgttaaattaaagaacattttcaagacttcttacctagtgccaattgccatctggaagtttgtacaaacgtacattcctgccagtagtaaataaggatgcccccattgttattgtgaagaaagaatggtggaacaagccatcaatatttgagcctccttttcccaaatgcgattctcaaatagcatcatttttttggtgaaggaattgaaaaaaaaaagcattaagtcatgtgctgctgcttctaagcatggtagcaagtgcacttggaaattgcccagtgttttctctgattaagaagctttgtatagatccttgggagacataatccctacaagtttatgtagtcaaggtaaagctagttctggcagctccgggtgagatcactctgcaattactaccccttgaagaccacttctactctctgtgggccacccaaagtaatttgtgtctggatttttctcacttttgagaatcgtccttactttcattcagtttcatttgtccagatttcccatgctaataattaaacaccatgaaattttaaccaagtcattagctaagttttttaatgaactatagcactttatgaatttaataaatcacttttcatcttgtcattcagtaaattttaggaaaatgagagaatacattcttattcaaaataagaggttcactttcatttttattttattttttgtttcattgtaaactgcaacacttatctgtgccttgggcatcattggttggaattttctacaactgaaacacattgatatgttataaaaaagatgtaatgaattctggaactagaacatctgaacctaattttttttttaataatgctgtagtttcttcatctaatgggaggacactaatagtaactgccacatagggttttatgagtttaaataagataatatttgtaaaacatttaacaaatatgaatgtatcactaagtatatgccagacactacttcacttgttgtcatcaccatcatcattaacaaactcattgtgggaaaccttctcaataagtagttctcaaacaccagtgagtgattttaaatgaaaattcttgggtctccatttccaaaaattctgactcagtatgtaaaaggtggggcctgggtgattctgatgtaattggtcaaatgagggcattttgaataattcagaacttctgacttatttaggagtcaaggtagataatttaactctcctattatttgttttcagtccaataacacagaagaggaaacaattagaaaaatactgtttcaaaaaggcagttcgtttctaaattggttatcccatgttaagatgtgaacagctattgataatctaccaaagtgtacatgtctttggtgcatatagagtcctcttcttttctctcctgatgctttccttccgggaaatttaattgttccacttaaatggactggaacagaaagaagaggagatccaaagcagtttaccgtcaccagtgcagtggtcaaaacatgaatattgatgctgcatggcctagaaacatattgtggtttaatcacttaactcctctgtgcctacattcttacctgtaaaataagaaactaataatacctaacttaaagcattgttgtgaaaatgaagtaatcggaatttgaaatggtatgactaaaattaaagtgcattttaattaatcatctttgtccagctgtcttcctccccaaaaagtgggcagtcattgatcaaacaatgtgtcctatttcctcctcttgccagccaaagatgctgcatcggatagagaatacacattataaaaggaaacatggaacactggtcaagcaaaatgtatttctctgcctgcaatttcccttctctactccagatattaaaaactaattctctcagttattcattgctggcagagatgattaatttaacctttatagataaagtaatatgtttggatgaaaggagcaaatactctgctgagtctaattgcaaggcaccttcgggtgaataattcattgtgtacagtataatgatatcatagatggttagccaagaacaaacatcaattgtataaaggaattaaactaaactgagtccatttggcagtgaaaaatagatagagcccttatcaccaatatggatcttgttttggtaaatcttaccatggtctgagatttcatttttaccaatttctgataacctgtcatgtgtgccttcacttctcatacagattctccacttaggtaaaaaacgttagagtaactctggtgattagaaatgtgtgagagtaagagagacattggtaaaatcccacactgctactaagcttggaggccttgggcatgcgacttaacctccacaagctttccatttctcacccaaaaaatgaggaaacaaaacatcaggttgttgtgaaaatatgagacttacttaaaacttcacgtaatacattgctgggtttatagtaaatacttgatcggaaagaaatatggggacatattatatgtgaacatgtataaacatacatataaatacatacacacattctgaaaaatatttctactcatccttctatattctacctatctttatttttaccacccagccctgttcatttctgtcttttttcaaggtatttttcccctttcctctgcacattttataatcctcatcaacaaatacaaaaagaaaacagatggaaagattctttttctcattagtagttaaaaatgcaaattatagcatcctggaaactaggattaaaaaaaaataagctgatgtggctaagataaaccagtttcttcctatcactactgccaaactgatgcaatctttttgtaaatctatatttcaaaagtaagagcataaatgtgtccatagccagcaccccttctttaaaagttatctcaaaggaacaatccacctaaagtggaattattgtgacacaactaatatttgcatggataaatctaaaattgcaaaaatttttttaaaagagcccaaatggaaggttgtataatttgacgtaaccaatgaaatgttatacagttattaaaagtggtaataaaatgcataaaaatattaaaacctaaaaacatttgataatgtaaacataaataaattgtatattatgattgtgactatttggatgtgtatatgtagaagttaaagcaaaattagagctttcagagaggtgaaaatatgagcaatttttgcaatcacaattttttgaactttttttattttggctttttctttactgaaaaatgaagatttaactctgatatactctgcaaaggcttcccaatatacgcaaattatatgcattttcttcccttttttaaaaatagtacaataccatttcgttttagtgcttattctagaccttacattatattggctttatcactccctacttctctcatgttaatctcttcccagaaagactctgaaccttttaaagataaaggctgggtaatttccatttaaaaaacacatcacaatatctaagccagaaccataaagtgtaagtatgtttttaaactttatgtctgaatccctaaggaccggatggaggtaggtgataccttcaccctacccgacaaaattggggttgacactgaatgcagctatattacctggtagtaaaaatagcacagcagttttgcacctctgaaaccctaccctatgtgaacgggaatggactgagggcgagggtaagaaaaaagaaatgaataaatggatatgtaatgaggaaaatccaatcatggcttcaacactttaaaagaggctcagagcaagagataatagtgtgccttagattaattgtatcagatgccctttaaagggtaaagttgtatgtttgctgagaccacttttgctttcacaacctgacaagatgcaatggaagtctgcaaacctgagtggcttcaccctgagaaatatttttataagatatagatatataattatggacttagactaattgacagtgggattctagtaacgtggcagtatcttttgagttgtatatccttttgatataaaggatccatcttcaaagactgggaatgaactgtgctattataagctgtaataacatatatatatttggtcttcctccccatttccaggcatggagttcgtagatcctttagtgttacagggaattggcaacaaacgtgaatgaatcacaaaagtgttagcaagttacttaaataaaattgattttatcaactttagaagtggttaaccaaaccaaaatgtttgttaggcatcttcatacagtttctagtaagcactgtgaatcccaactatctgagacaggtctcagttaatttttttttttttttttgagacagagtcttgctctgttgctctgtcgccagcctggagtgcagtggtgcgatgtcggctaccttggctcattgcaacctccgcctcccggggttcgaacgattctgctgcctcagtctcccgagcagctgggagtacaggtgcgtgccacgatgcccagctatttttttgtacttttagtagagacggggtttcactgtgtagccaggatggtcttgatctcctgacctcgtgatccacctgcctctgcctcccaaagtgctgggattacaggcgtgagccactgctcccggcggtctcagttaatttagaaagtgtattttgccaaggttaaggatgcacacccatgaccatgatagagcctcaggaggtcctgatgacataggcccaaggtggtcagagcacagtttgatcttatacattttgaggactcatgagatatcaatcaacatatgtaagatgaacattggtttggtccggaaaggcaagacaactcaaagcaaagctgggacaacttttttgggaagcagggaaggggcttccaggtcaaaggtagataagactagataagagccaaatgggtgcattcttttaccttctgattaacctctccaaaggaggcaatcagatatgcacggatgactttgaatagaatgttaggcaggtttgccctgagccgttcccagcttgacttttccctttagcttagtgattttggaacctcaatgtttattttcctttcacatttctccccttttctttgttaaaatcttttggagaaagcattttagaggaaaatgagtctctggtctcaggtttcatctgatctctgatggctaagatggtttattcctagacaggtagttatgcctgtttccatggtatctgtgcatatgtgctggcagatgctagagtgactgcaaaggtgaagtttctagagggaggtgggcactctgcagtgtctcactgtgggaagatacttgtttaataaggacaagggcatgaagattcagtgactggggagggtagatgtatgtatgtggatgcagggaatgaagtcaaggtcggaaaactctcagatatggcagaggaatatttttctctgtttactttataaagcaatataatttgccaaagtgatatatgttgattttttttaaagtatgttcctatgtaatgaagttaaaacctccctcatcctccatttttccatctctcaggtttatccaatcaaacctctgaatcatgagaactaataaatattgttttgagtaagttttggggtagtttattgtgcagtaaaagttaactcatagagacaggtatcttgcaatgcaaaaatataaatatatgaacataaatatacaaaaaccactcttgtttataatcacctgaatagtatatgattatattctttgaaactccagccctgcacacaaggtgaaagaatcctttaatcagaagcccaccatcctggtctcgtagatgctgtcatgactgagtgtgcatccttctggatttctgccagctttttgaattagaaaacagaaatttttaccttatttgcttttactttaaacacaacagcgtgtcttggaaatatacccataccagtaagcataaatcaattcctgtatacacagaagactgctttaattcctgaagctttatgagatgatttgaattctgttagatcaagttattctcatttattctttttcaagacttccttttctcatatttattccttcacttgaatattagactcagctggtcaagatgatgaaaatatttctggggggaattttgggggattccattgaatttactaagtttgaaagaattgatgactttaataaaatattgcaagcatcttcccattcataaacttgttatagttttcttttcttttcttttcttttctttttttcttttttttttttttctttttgagatggagtcttgctgtgtcgcccaggccggagtgtagtggcacgatcttggctcactgcaacctccacctcccgggttccagcaattctcctgcctcaaccccccaagtagctgagattacaggcatgtgccaccatgcccagctaatttttgcatttttggtagagattgggtttcaccatgttggccaggctggtctcgaattcctaacttcatgatctgcccaccttggcctcccaaagtgctgggattacaggcatgagccactgtgcctagcatatttttcttttactgaagttttttttcaccatctgtggtgaatttttctaattttctatacattattagacatttatttctaaatttcttccctgttgctttatatttctcattgccatcagaaaaaggatctcaaatttattacgttttgctggtatacaagaaagcttcagatcgtttttatcatctatcttgttaggccacaatgctgaactcttatttattctaatagaaaaattaggacaatcaactgacaaactatgtggatgatgttattacttgtaaataatagcagtttggcctcttccttttagtatgtgtcctttgtatatttttcttattagcttggagttccaatgctatgttaagtagtaaaggaattagcaggcatctgtatctagttcctgactttgatggaaatgttgctagtgattcactgtttactgtggtgtttgctgtagatcactggtagaaatctcatatcaaattagttgcctcttagttctcatttgcatagagatatgcaataaaattgcttttttttaaaaaaaataaagaatggcttttggatatcatcaaatgcttttttagtatctactgagatgatcctacagtctttttccttatttatgaactgagttacaatgttaataaattctaatattaaacaactcttgcattcttgagttaaaccataattaatcatgttgtattattttcaatacattttgatgctctattaatagtattttgttttagatatcacactcctgttcacaaatgaaattttttaactgttttattttctcattctctctttatatagctagatttgttttttttttagatggagcctcactctgttgcccaggctgaagtgcagtggtgcgatctcggctcactgtaaccttcgcgtcctgggttcaagcgagtctcctgcctcagcctcccaagcagctgggattacaggcatacgccaccatccctggctaatcttttgtatttttgtggagatggggtttcaccatgttggtcaggctggtctcgaactcttgaacgctgcaaactgcccacttcggcctcccaaagtgctgggattacaggtgtgagccactgcgcccgacctttttctagctttaataacacataaatatatactcctttctccctgataatctaagatttgaaaatgatatcttgagattaaggtgctatttctatgcttgtgtctgtgttttgttctgccaatggcttacatttattaagttcaggtaaaatcttcttatttatcttatgcccatctttctgctgttggctcccctgagtaacttctgtttgcatcttctaaaataggtgttgaaatttctaattctttctccaatgcctctcactttctcttaaatttttctcagcttttttagataatagttaataatagtagctagtgtttatatagttccttatacacacacactattcccagtgctttacacatagaaactcaatttaatctccattactacccactcctgactgaatatgataggattgattcaagaaaacaaaactatactagatatttcaacaaagagagctaacgtagggaattggctaagtattgaagaaacaaaatgagaacactgaagtaatctagaagcacatagaagtaataaagcagctactactcccatgtctaggggaaccaaaggaagattattcgaatctagaaactccatagagtgggagtgcagaactcagaacaagggatgccactctaggtaacacagtgaaaggaggagtctcttggaaatgaggcagagcccattgtgctgacactggtgagggaatgtgcagaggcctgttcagggaggctaaaagatagaaactagaaccaaccgctgctgccagaattgcttcctgctgttaggacaatggtgacagaaacaacagcaaattaaaagattcggtccatccctcctaccccttaggagcacaaccccttagttgtgcttttgtgccctctattttagcatgactttacaggaaaccagtggaaaaggagaaactagcccctgctttacaaataagaatattagaaggtatgtttggagctcagagaaaatagattaataataaacacaaaacagtgaaatttttttttcaatgttacacagctagtaattcagatacagtatttgaatccaggcggtctgtttgcagaatcctttctcttaaccactactcaatgcttcctctccaacaatttgaaatctagaaaagtccttggctgaaattccagcttactcatttctcttgaactatggcctttcttctctgttcagcccagctgctgagttttatgtccatgatgacagttttgatttccactatctatcatgttgattttattatgggtggaatatcttcttacatttctgaggctgtaaattgtacttcctctgaacttcctgttctacttgttcttctaagtctctgttccccagattaagttcttttgttgaggaacagcaaagcattggctttcctcaaatgataggcagctcttgacgtgccttcatctttgcacctgagataccctgctggattgtctgttgcatctgcttatgagaaaggctgagctgacctgttgtgacttgtgcgttgtgcagctttctttcaggatgggaggcttgggataatgtgccatgcatgtagtaccatagcagtcagcactgtctcatttctctgaccccaagttctcactggataactctccccatcccacctgagtcagatacccctgtagctgctttttggactatgtaggtaggatatgtagaagctgacctgcttggcccttctgattatccaattggttactcttaaacttctcttgatcccagtatccatacatacacactcccttggtactgtgcccagattttctaacagaaaaattcactctgtgtttggggaccttactttttctaatcactttcctttcatttctcatctttcaggaatttttcatgcgttttgttccatcagggttttccttcttgatttacatagtggttgtgaattttaaaaggaaaatacatgatcatttctagagattttataagaaatgagaaagctatgtctgcaatctagaatagaaattgtgtttctcttaaaaaacgggattctgctgctcataatgttttgcaaattatttttttaatgtatcaataaaacacgggcatgtttccatgaaagtagatatgtattattttaatggctgcaaaagtattctagatataaatgtgccacacagacattctcctattgatggccattttagtctgttttccatttttactattacaaataatactgcagtgagcatccttatgcactcctaaattatttctatagcctagatttttcaatgtggatttgtaatataaaagggaatgttcataggacatggttttcaaataaataaataaataaataaataaataattctttttactgtcaggcggtgtgtgtggggagacagagtctcactctgtcacccaggctggagtgcagtggtgtgatctcagtttactacaacctctgcctcctgggttcaagccatcctcccacctcagtctcctgagtagctgggactacagacatacatgtaccaccacacccggctaactttttttttttttttttgtagagacaaggttttgcaattttcccaggctggtcttgaactcctgagctcaagccatctgcccactttggcctcccaaagtgctgagattacaggcatgacccaccgtgcccggcccttttttttgttttgttttgttttttttttgtttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgcccggccctttttatgcttttgtaacacccaactgcattagctcaagtttctctttctggcatgttccataatttggccacttccatccagggaaatggccttggagaggtcaggctcatcacttatcagtgtcctcactgggtcaaggaaatagcaccaggacagagcaggaaattatttaaagacctggagaagttggaggccaaaaacctgtatcactcatatattctaaaaacattaaatattggagctataataccacttgatgaataaaataagaatttttttcttcatataaatgtttaggcagggcacggtgtctcacacctgtaatcccagcactttgggaggctgaggcgggtggatcacctgaggtcgggagttcgagaccagcctggccaacatggagaaaacctgtctctactaaaaatacaaaattagccaggcgtggtggcaggcacctgtaatcccagctactcgggaggctgaggcaggagaatcacttgaacccaggaggcggagtttgtggtgagccaagtttgcaccattgcactccagcctgggcgacaagaatgaaactccatctcaaaaaataaaataaaataaaagtttacttagttgtgtgtaggaaaataacatatcctaaaatcagaatatcttcagaagtttcacatataccaagaaacatttaattaatccctttcagcaaaaagttctttccttcacaccctaaattcctcctctcagtagagtcaaatcccaatatttgaccttgttcttcttctaagcattttatttatcctgttcttttttttatcctcaagcacaaacttgaaaatacctgtattggaaccagtatctggcatatctaccttataacccatctgctataaatcagctctttgcagacaagtctaatctgtaatgagctgatttataacagatgatcaaaataccactagaatttactagaaatacagttttcatgtgtacttgctatttttcttagaaactataagaaaagcaaaagcaagacataaccaaaaaaaaagaagaaagagaaaaagaaaaaaaaggaaataatcactagcagattgtattttccaaaatatgtgcacagccatgttcccagttccacaatctcagaaccctgatgcttctctcatcaaaacatggagttgaatttctaccccttgaatgtaggtcactgtgactgctcaataagtagaagcaaatgaagagacatttgtgacttttgagactaggacacaaaaggtgatacagcttccatctggctcattctctctagggacactcacttttggatcacagccaccatattttgaggaaccccactccacatggagaggccacttgtaagtgatctagctgacaggcccagattatctcccagccgatggccattatcagccaccaagcatgtgaataaatagcttgcagatgattctagcctccagccttagaaccttccagctgaggcctcagacaatatgggttgtagaaaagctatcctttctgtgctgttatggttaatttttgtagcttcatattgcctccacatccactttgaatatgggtttaacttacgtaaaccagaagcagagcttacttgccctcaccacaatttccagttctctacctcttgccagttcctcagtgtgatggacccagataactcctcatacaacacctcctggcgaccacctcccagtgggacaactacctacaacctatttggctcaccccactaacccccacagcccacatggactgtgcagatataccactgtgaccaattctctgtcacagtgtgactcctcagaactcatgcctgcgtgctctaaacccaccaattaactccctgaaggaaaacctgcctgggtaataccctcaattccaataaaggcactggtctacaaatcccttgctctctttttctctgctgatttaatatgtgtgtccccgagggctccccacttcctcctggccctgcaaggtatgctgccctctcttttctctgcaatctgtgagtaatacgttgcttcttttatttcaggtatgttgttgagttaccagctctgtgtctcatctgtccaacacactctaacctaacttctttctatctcagggctcctctagagagtggctatcttggtagaagtaaactggacacaggggagacaagagccataaaggaacctgtcagtataacaagtttcttgtgataggggtaactaatcatgggttggacaactgagcattaggctgttggccaaaataaacaagtatcctgtgtgatcacattatatgtggtcttttgttactgtatcctttcacttgacaaaatattttcagggttcatccacactgtagcaggtatcagtctttcattcactttcctggctaagtggtgttccattgtggatgtatcacatttgtgtgtgtgtgtgtgtatgtgtatgtgtgtgcattcatcagctgatggacagttgagttatttccaccttttggctattgagaatggtgctgttatagacattgatgtacaaaaagaagtatccagtgaaaggtacactgtaaatatccatgacctatacccctagagcccaatcagatcaggactagagttaatagccactctcctaagacagacctccagaccaaattagaggaaaatacaacagctctgttcaaatttctgacatacaaagaatctgcaatgaatggctgtttataccataagttcccccccgtttaaaaaaattgtggtaaatatgcaacataaaatttaccatcataaccatttctcagtgtacagttcagtgatttaaaatacattcataaagttatacaaccattatcaccatctctctctacagttttcatcttgaacaactggaaactatgttcattaaacaataactccccactccccaagcccttggcaactaccatctactactttctgtttctatgatttcgataactctaaacaccgcatgtaagtggactcatacaatacttgtctttctgtgactggcattggtataagaataatgttttaatgttctttcatactgcagcatatgtcagaatttcatttctttttaaagttgagtaatactccattgtatgaatataccacatattacttatcctgtcaatagacattgggttgcctccacattttaactattgtgagtaatgctgcaataaacatgggtgtacaactatttctttgggatttcctgttaattactttgggcatatggcaagaattaatgttgctgattcatatggtaattaaagatatatgtgtgtgtgtatatatatatatatatatatatatatatatatatatatatatatttttttttttttttttgagacaggctggagtgcagtggcacgatctcggttcactgcaacctccaccttctgggttcaagtgatcctcccatctcagcctcccaagtaggtgggcctacaggtgagtgccaccgtgcccggctgatttttatattttcagtagagacagggttcactattttggccagactggtctcagactcctggcctcaagtgatccgcctgccttggcatcctgaagtgctgagattacaggcatgagacactgcggtcggcccatatggtaattatatttttaatttttgtggaacagccatactgttttcaacagctattgtaaaattttgcagtcccaccaacagtgcacaggagtcccaatttctccatgtccttgccaatacttgttattttcttttttgataagggttatcataataggtgtgaggtggtatctcatagttttgatatgcattttcctattagcgatgttgaccatctttttgtgtgtttattggtaatttgcatattttttggagaaatgtctactcaagtcctttgttcattttgaactgggttgtttctctttttgctattgagttttaagagttatctatatatgctgggtatcaatcccttatcagatatatgatttgcagatattttctcccattctatgagctgcttgtttttactctaatgatgttgtcttttgaggcaaaattttttaattcacgaaattcaatttgtgtatttttgactttgttgcctgtgcctttggtgtcatgtccaaaatatcattgccaaatccaatgccataaagttttgcccagtgctttctgctaggattttcatagttttcagtcaaacatttaggttagaactttcaatactatgttgaatagaagtgagaacagtatgcatccttacctcattctcaatctcagaggaaaagctttccatttttcatgatttgagtatcatgtttgctgtgggtttctcatatatggcttttattatatagtttcctactatttttagtttgttacattttttatcacaaaagggtgttaaatcttgtcaaatacattttgtgtatcaattgagatgatcatgtgaattctttcctcttcattgtgctaatgatcccttcattctgttacattgattgatgtgcatatgtttaaccatctttgcattctaggaataaatttcactcagtcatggtgtataatccttttaaaatgttgctgaattttttttgctagtatctgttaagggcttttgcttaaaagttcataaggggctgggtgtggtggctcatgcctgtaatcccagcactttgggaggccgagacaggcggatcacgaggtcaggagatcaagaacatcctggctaacacggtgaaaccctgtccatactaaaaatacaaaaaattagccgggcacggtggcgggcacctgtagtcccagctactcgggaggctgaggcaggagaatggcgtgaacctgggaggcagagcttgtagtgagctgagatcatgccactgcactccagactgggcaacagagcgagactctgtctcaaaaaaaaaaaatgttcataaaggatattagtctgaggttattttcttgtagtgtctttgtctgattttagtatcagagtaatgctggcctcatagaataagtcaaaaagtattccctctcattttattttttggaaaagtttaagaaggattggtgttggtttctctttaaatattgggtagaattcactagcactagtaaagccattgatctaggacttttctttgttgagagatttttgattattgactcaatcgccttaatagttataggtctactcagattttgtatttctccatgatttgtcttgataggttttctgtttctaagaatttatacattttcgtttaggttatacaatttgttggcatataattgttcatagtactcttataatcttttttatttacattgaattgctagtaatatgtccactttgattttagagatttgagtatcctctcttttctgattacttcatctagctaaaatttgttgatttggtggttttgtcaaagaactaacttttggtttcactgattttctctattatttttctcttctgtatcctgtttatctctgctgtaatcttcattatttcctactttgtctagctttgcatttagttagttctttttctagtgcctcaagttgtaaatgttaggttgttgatttaagatctttatttttaacataagcatttatagttataaatttcatgtctaatactgctttacataccgtttttcccaccttggctcccacaagctctttgcaagttgctccaggaacacatgtacggctcactgtcatgtggctgagataggtaattactactgtactcatctgaaattgactaaaattaaccacaatttaccatccaagtctttctttgtaagttgcaagccttcagtagactccagagtcccaaaataattacatcgaacagcttctgctagtgcaattgttgtctaagtaggtagagagattcctggtactccctactcttccatcttcccagaatcctctccttttttaaacctcagtcttgccacaatattttatgtagtaagtggaaaaatcactgcaaccactaaaaacaataaaaaagttctcttatgctattaaaataaataaatattgaaggatatatgtttagagcagtaggtgtgaacagggctagacatgtacacctttccaccactgatgctgcttctagtgtagaattaatgctttcactagagaagagaatcagtatcaatggatctgaagagattcaggagggcatcttttcccatctttgggcattttctccggtctatagttggaaaggtttaaaatggcaatagattctcctcatgtttaattgaacattgcccttgctatgtgttaaggcatcttctctgagcttcctatctaatgacttgtcaaccttgactcctccattccatactgcacatttttggctgagattcagttctcttccttagcacctatatatttcctgtcaggtttgctagacttgattagaattaattatttatttggaagaaattggtgtttattatttagcaaatatatttcagaatgccttagcctcatctatcaatgcctcctttttctttagcttgtgaaaaaagcagtaagggctttacccaagttatttattaggccaaccctgtgaagagaaatcaaactggttatgacttgtttttgcttttagttttactgagaaagactccttgaactaaaagcttgatgcaacagctaatgggaaattttttctctagctctctctttgttattgtgtaaaatagtcacacagttgtgtgtacggcatatattcaatcagagattaaagcctccactcacatatggtatcttcaaatctgttttagtgagatttaatacaaaaaattacactgcaggtaattctaatacaattgttatctgcctacgtttataacccctgccatgccgtttttggacaaaaataatgaaatttcacagaggattaattttctatatctgttttttctttaattacccaatatggctatgtgaaagaagggtgaaaaaaatctttaaaaactggattctattctgttgtttttgttgaatctaatgcagctgtgattttcctcttccagatttttcagactgaagactttccactgatattggtattttatttccccaggtgaaacataggtaatgagatgctgctgcccattttggagaagaatgtgttggaaagctgttaggattaaataccaatttgcaatttgttgggttaaatagtccagtattactttaaagtcaccatcacataaataaaaacagcccaaagtgattaaaagtgggaaatatgtagcattgttaatctactcactgtgtctgaaaagtactagtggctaatttgtttatgatctgggtgtgtatgtatgtatatgtgttcatatttataaaatgaaacaaagaccaggaaagtctattgtctgatagaaatagcataaaaacaggaaaagcttttgtccctggagttattggtaacccttcttctagtctactttcagactgtttttctcaaacagttgtagtgttgagaggggggtgcacagcagacaataggatattacccccgcttcctctgcacctgtaaaagtagactactataagtttccatctcaaccaatcttcctttttgacagtttccaagcttatttctactgtcataacacaatcatgtacacaagagacctctaaacatagtggatattgctagacaatctttattcaattatgagctaaaatataagtggctagaaccatacacatgtgctcatataaaaatgtgttttgtgcacatgaaaaaatgctcatcatcactggccatcagagaaatgcaaatcaaaaccgcaatgagataccatctcacaccacttagaatggcaatcattaaaaagtcaggaaacaacaggtgctggagcgcatgtggagaaataggaacacttttacactattggtgggactgcaaactagttcaaccattgtggaagtcagtgtggcgattcctcagggatctagaactagaaataccatttgacccagccatcccattactgggtatatacccaaaggactataaatcatgctgctataaagacacatgcacacgtatgtttaatgcggcattattcacaatagcaaaaacttggaaccaacccaaatgtccaacaatgatagactggattaagaaaatgtggcacatatacaccatggaatactatgcagccataaaaaatgatgagttcatgtcctttgtagggacttggatgaaattggaaatcatcattctcagtaaactatcgcaagaacaaaaaaccaaacaccgcatattctcactcataggtgggaattgaacaatgagatcacatggacacaggaaagggaatatcacactctggggactgttgtggggtggggggaagggggagggatagcattgggagatatacctaatgctagttgacgagttagtgggtgcagcacaccagcatggcacatgtatacatatgtaactaacctgcacaatgtgcacatgtaccctaaaacttaaagtataataaaaaataataataataaaaaaagtgttttttgtttgtttttggttttaaacaaggttttgctgatttcagattttgcttcacattcttgcctgtaggaggaatttccaatgtgtgttttattaggcaattaatctcatgctttctagttattgtgatagaatttttgtagtggctataattttctttctttttttctttatacaccactacaaaatatccttcatctagtcaacacttaactgtggtctatgatgtgtgaccgaatctgttggtaaagttatctattcatgcaagaaatcagtgcatacagatttgggagataattagtttgtactccacaatctcagctattttttccttgaagaaactctaggtattattcttagaccatttaggttgcaagtcttttggtcacttttttttttttaacagcaattgccaccactaagtattactatcatcacatttttttgtagatacctactagacgtcagacactgctctagatgctagctaaacatatgtggcctccttaatttttttgaagatgatatcagtcctgttttacatatgaggaaatcatagtcatgtgcatagtggaaataggaaaactactgatgtcagacagttttggactcactctcttctgctttggagctgtattatgattgtgccagtcattggatctctttgagtctcaatggtgtatcagataaacatgtttgatttcaggtgatcatgatgaaaaaagcaaatgaaaacaaaagcaaaatgtaaaaaactacattaacacaaagccgaaacgggtaaccaaactttaaggtctttgcttcctctggttgcatatattgttattaaagttactcaactagaggaactttaacttcagatttttttttccttgaattgtaatagaacaaccattctcactgatatgctgaggcttttaaccaatcaaggaatgaattttatttgtgcactatgcactatgcacataactacgatttgctcatatgtaaaatagggctgtttttatatatgcatttaaattttaagctcctaaaatataattttgcccccattttaaagatttctggacattatgatagaatctgtgattaatcaagggttttgctcatttcactttgaatcattgtcttattgaagaaaacctaagaattaactggattgaggttgatttcaagtcattgtgtctttggtcattcttccttttcaaacgaagttctttagttttttggtttttgtattttgtttttactaatacctttaaatcaagacatgtaactgacactaatttagaaataattttttaaaggacactatggagtatacaagggaattttaaaccttagctatgaaaagacaatttacatatccagtctttaatggttaatggaaaacattagtccagatgtaaaatacttcttagcaagattttaaagccttcatttggcccagtgtatgagaaatctttgacgctttctctgggcagaaatgtatatagtaaaatatcacctctgtttgcccacagaggcaaccttctggggttacagcatcctaacctaatttgaatggtctctgtgatatcctgtgtccacaaaggaagagctgtgtattgatgtctgaccaatagctcatactactctagaatcttcccttttcatcttctgttttcagatgatcatcataatccagggggaacattgttttatgcttaggggacctttttcttctgaaaacttcaaggtgaaactatcattaaacccaagtggcagtcattatttgtccaaaactcaagtgaatatatgaattgtgactaaatggctaagggcttagtcactaacagaattctaaacctgaattctgaacctatgcattgtcatatagactgcagggacagattttatattagggaggttcagtaagggagatattctctaattgtggttagggtttattcatttaaaaatactcagcacacatttattgaatgcctaccatgtgaaatgtaggccctgagtccagtcattcccttggaactgctctgggaaaaaagaagtattttcagaggagatgctaagcccacagtcgttttcaagttctcaacagctaagactttagaagtgtggtttcacactaaaattttccaactggaattaaatgctggaaaagacttgagagtcaaagacatagctaattccacaccctacagtcagatacagaacacttaattagaaaagactttactgaaaacacaattctctctagtgtaaagtgtcttaaggggaatattcacaatttttttatagaggtccaaacccatggttgttagaaattgctgtcctcctgtttccttgaattttagagataatatttttctttccctttttgaactgtttatctcctggtatttcttcattatataatgcttactctattccattatcatttccatggaactgtggtttggatgttgatacctgaacaatttattttgttgtttgagacagaatctcactgtcactcaagctggagtgctgtggagtgattgaggtccactgcaatctccacatccttgtgctcaggcgatccttctaccttaggttcctgagtagctggtactacaggtgcatgccaccatgccccgccaagttttgtattttttgtagagatgaggtttcaccatatttcccaggatggacaatttctaaagagttggccaacctcttccctgcctgaaaggcaacttgataatcatctcagactcactagaatgtctgcaatttatattacatataaattaagagtaagtacatttttgaggtaaaatataaggctgagaaagccacatttaaataaccccaggtgaacatctctctttagttatcagtttttaaaattattcccttattaaaatctgaggtaaatgaaggcacgaagggtctctgccactttgatcattaattatctgcttttcttccccagataatgaaagataatcttttgccttttggttttctttcatttgtatattaaagaatgctttgcctgaatacctttgacacattgcatttcatatcctgcttagccttttgtgatccagagagcttggcttttcttccttagaaggcccatttacttagagacaaatgatatgaaataatcagcaaaaatggccttgggtgataaacatgtgcctatgctgttcatcttcatgcccttcaactcagtgcaaattaattttctatccattaattaaatcattagctccttatgggcagagagtacatctgtctctttttcttcctctctctctcccttctctgtctccttttccttggtgcctagcagagtgcaatatacatcgtgagcacattgagaaaagggtactggcatactttggagaaatagtaatataataataataaaaccttccattctcttttctagtttcctaatctaaactctgtatctttctatcaatcattcttatggtccccctcagctcccttcttttcaattgtattcttcccctaagaaaatgaacaaaccaatgtcaattttcacgtggcaatctcatgcatttccatggctttatttactatgcatgcaggtgacagccagatcattccatcaatcacagaggtaaattcccatgagtccccaagatgcctcgatttattatccttggactattccctttgagagatttatcagagaaagggtatttcagagaaacctaaaaatccttgcattgaggttcactcaatcattcagacagtctaaggaatcatatttgtgaaggcttttgatgcatagaataatgcatagagagaaataaaactcacactggacttacactagtgagaaggccatgattatagtgattaaaaatgcagtgattcagattcagtctaggttcaaatcacagctcactgattactgactgcgtgtgggagccagtttctgaatctcatatgaaacaaaacaaacaaacaaacaaaaagaataccaacctcataggtctgctaagaatttcaaatgagatgatatttataaggaagaaacctcgagaagtatctggaacatgctgcatcttcctaaaactgtaactatagttattcttaaaggttgcaaaatggttaatttcattatgaggagatttggtatcacagttccagaggtacttttagttaagtcatattttaaaaaaatacccctactgaacatggtggggagcacatattatcagatatcagtggttccattttgccacctccagcattatcgaggagttggggaatgttcaaattgcactttaactctctcaggattaagaaaaaaatatataacctgaatgataggctataggttaattagttcaaaagccaacggagtacttgattttaagttcaacttgaaaatttaaatttatttctcagttcagtggactagtaatgttaatagctaatattaattgagcgactccttatgctaggcacttgatttcctagcctagatatttcttcatttagaagagatttcttagagtccctgggacaatgatctttgggtaggcaataactatcatgctttctcctcaaattaaaattcaaatcaagctctcctttgactttgggtatgccaacacctggcagctacattgacatccatgtctcagcaggccatttataactctctaattttcccatctctctgatggctgtattttcatgagttcctcaccaatgtgtaaagcctttaaagtttagtggatgtgcatagtcagatgagaattttcagggaccagctgtgctactgtgatggtcatttgcaccaccactgggacatttcttcttgtccaatttttatctatgtgatgacaaagcagaggaaatattggatagttaaaactgttaacacagaatgatatagctgaaaagcttataaatagagtaacaggctgcacaggactaaaagcaataatttcatcatgggaaagttgcctaaaggtcttatttcacattctgatgatgtagcagatctagacaccagcattttagagtaatacctgaactgccaaacattaaccagaaatcattgtccatgatacaggtagcaatctatcatcgtaaatgtcactatagggaagacctaaaagccaaataaaacaaaaaaagacgagacacagagctcatccaactgaactttgctctccagaggaatggtaaattcagattataattgggtgacttctgctttttacaagttctcaaaaacttctctggccctgggtggtggtgttacggccctgcatgattacatatcacatcccattacaacacaagcagtctttggatgacataaaagttttgcaacttttaaatcatggcccatgtttttcaaaagataagctcaacatgataaaatttcaaagtagcaccaataatagagttggattcattctcggaatcagtactaactaaataagctctctctcttgagtttattttttattttttttgcaaataatctttcaaataaaaccaaaactaatcaaagatcacaagctaaatacatgagcttccacttttgatctaatatccttatttctatcaatgatatgataaaaatgtcatattaatttttttcaaaataaaacttaaatataatgcttatctgatcaaaaagcctccaggacacttgtcccagaaataaagcctaaatcatcagcagaatgtttaattttcctaagtgacccccaacttaactttccacactttttttctaccatttccacatacctccaaaattcatacctaagtcacagccacatggatcagttgctatttctccaatgtgtcatatactttttcttctctgtatcttctgcttaaaatgactgacactcttctgcataaacaattctaaattatccttaaacctcagctcaactacaactaacagaacttgttgctttttcctctatctgtacacagtgcctatatcagacctgccacattgtgctggcttctgactgtatcacagacagcaatcaactctattttgtctttgtatctccagcactcaaaatatcatttgggaggcagtaaacaataatttattttttcttaatgaatcattcccaggactactgtgtacatcaggacatctagggcccacaattcagatagactgtgatttaaatagaaaccttgcagttgtgaagtgtacattaagaacaaccttacatagcagcgtgtcactcactcatgctaacatatttatattcttgcatgataaattttaatgttttctgcatgccctcctccatcagttgtggaatcctaacaagtcagtataagctaggttttgctgcagtaacaagtacccaatttcagtactttgatatacaaaagttaacttctcactcatactacatgtctgatacagttggcaggaaaacttcatagtccatcagggaacagagctgacagaggttccaccttgacacatgaattcataatcaccgaggcattaaaatcagaatgcagcagattatgtactagttactagagcttctatttggatgtagcacacacactcctagtcatacttcactagccaaatgtaatcaagtagccgttaacttcaaaggtgccaaaggaaatccaattttaccatgtgctataaagaaaagaaaaacatttaaaaatgtctttattgacaggtacagtcagctccttaatatctcacaatttctcctattcatactccatttaattgttttaactcttttttacttcatccttggactattgtagcagctcacttaaccttcctgccttctttttctttatcccactttgccctcagcccttctccctataaccaacaggttagccaccctaaagcgcaactctttacttctttcaagaaggtatttttaattaatacctttagtgattccccaccaactatgaaattaggccccagtttcttccttcattaaatctttccttccatttattccacaaacagcattgactacttaagagggatgaaaaaccatatgaaactctgaaagaacaaagaaaaatagttcctggacataatagacctcatcgttagataggggagttggccacaaagaaaatgagggcaagtcagtgtgatgagcttgatgctaaagtggcatagttcagtggtaacatcaaggagaaaatgactttgatgggagatcagtgaaggcatctctgaggaggagatgtttaaggtagttctgggattttgaacacatgttttccaagcaaatatagttggagatagaagaatggaggatggatgaggaacatggaggcataaaagttaggtatgttgcaagaaataccaatgtttctataagctggaattgaggttagtgtggtggtgggataggaagagttctgaggggatagaaagtacaactgaaaagagagattgagacaaattaagaaacagagaaggcttaaatgttaatattaaggagtctggctttttgtcctttgggaaatgtgtaattattgaatagtgagcctgagaagaagaagacttggtgtggaaacattggccacattcaagtatgttaagtgctgtcattcatgaggacaaatctagttttagtagctccagattgcaaactgtggaaattataaaaagtaccagatttcaagtcagctggagaaagaacgacttgaggtgcatttcattgttgtatgaaatttccagtaaaatgttggatattttgcattttataaatgttttttaaatgagtgaaataagttataagcattagattgatttggcaaaaaaatgtgtaaagaggctgaagctttgataaaattgtaatgaaaactagaatttggaatttaagatgcatatcatggaaaagtaggatgcaaatgtcactattagtgcgtataaatcatgttggagctcaccaagctctgataaattaatacaattttcccaggtagctacctggaactacctactggtagctgttttacaaatgtaggttgctttacagtttagatctcatttcatacactcatctcactcaatcctcataatagtcttcagtgcttagaattgacaagtcaggaactcatccaagacatgttaattggcttgccaaagacagcaaaacctaaagtggaagaggtgtgacttgaactcacatttacctgtgctgtttctgatatttatacccattacccaaaagctacaggaaaaccttgatttcagttccaggaacttacatttgaattaaaatttactgccgaaactagctcagtgcttttcaggatgatcataatgcagatactaactaatgatttgctaacaatggaggtagacataatctgatgggattgatcaaatgtggctccggttgccccagaagtaatttccatagactacacagagaacctaattatgtaaatcactcgagagatccccaactgaccttcttgacaagaactaaccagcagtgatcagtgggaagaaaaataaaattgaaacctggatcatttcctcagacaaatctagagttgattacaccaccatttgaatttggatgctgcagctctgactgggagctataacatgttgattcaaactctctaaatgggctgatgtatagatttaccaggaagtaaactaaaaagagacctgtttctgtatgacctacttttatgtttattaaaatttgaaatgttttttaaagtgttgataaacttcaactggcaaggaaaaaaaaagtcaccctgtattttctaatcaaggaggattaaaaggctgtgaaactatatccaatgcacaaatgttgtaattgcaataaatatttgtcctttctgttttctctacaaactcaaaaatcctagagtctgtgtttggcacattcgggagattacagccatctgctgggagacaaagctgtcaattacaaagcaatctggctttctgttccattccatttccaggttaaatatggcccaattgaggtaggatctttttattattattattacaattggaagcttcttggtactgtccaacctttgaccctattctcaggatcccaagagagatttacatgtctctgaacttggagtttgcaacacaaggtcaaccatgtcttatacaagccgtttaataaggtaaaccactcttaggcagggctctgagctcgttagccaacttgaacacaagatgagggtttcattcaattaaagtgtgctttagcctgaggaggaaaatcatagcaaatagaaactaataaatagagacaggggtatcttctgtttgctggggtgatgagcatttaaaacagaggctttaaggattgaaaacagtacaaaaatgctccatgaaacatggaaattaatagccaatttaataatgtaagattcggcaacattgaggagggacagttcaaaaccacagcagaaatattttaatagaagaggcagttggccctaaaactgcggacactaaagacctaatggaagtgaattagcctttctttcggccagattccaagcctgaaaattcaccctgtttcctttaattcttcctgcagttttactggaaacagttaccttgtgttttgtcctaaaacagttaaattgcctttcaacagacttttcagaaaatcttgtgttcctcagcaggagtggaaacaagaattggcttttaagcagacatgtaaaagtagagaagaaaatttttctcatctagatctgtgcttgggtcaagcctgagggcacctctaaggagtcattgaaagctaataattaagaatctgtttatatagcactaatcacatgattatctggaagaattctccagcaagaccattagtgaccagagggaagtgaaaatgatcctttaaattttcccaagtgcacctgattcctcacctcaattcaattcacacccatatcttgcatttcaaaatagtgacctaatcttggtccataattttacccactgactcttgcaatcaagggggataaaagactattttacaggtgaagagcccactggaacctaattgaaaaattgctaatacttctcagttaaatattaacatacttatgtaaaaggattcagtttaaaggaaattgggtaataattaagggcatctggctctagctcatggatgcagctttggcctctgggttcagtaagaaggttaggttggatttcaaagtcatcctcaactttccagctgaccatattctcccatatggtgaccacttaccatcacaggatccctaaagccgttatttcatttgctgttcttctctctggcttctcttacccagccatcaatatttatgtgtcccaggtctgcttctgtcaactgggttaaatgttaatctcatagtgaggatcagctgactaatcttactgtccagcacaccagttcttagcttcagtgtcatattatactgctaggtcataagcaactgtgaggtttgtcacaatcaacttgacacctttacagagattcctctggtaaagggctttcaacttcagtgctttcatagatataaatgaagcttcactgcaaaagtatattaacatttttgtctccaacaaatgggatcagtgatcctgcagataagtgttaagaaagatcaggatttgccatcccaacatttgctactttggcacaagtattattctgaactgaaggcaattgagaatcaacagatgcaggaagagttctctgccctccccttatctacctaaaaacagggcatacatttccctttgtgaaggtacccccatcttaccagaaagtgaagaccaactcttatcattggagatggaacatttatgcagagatgagtttctataaacaaactgaactaaaataacccttatctttcattagttccacaagatatttcctagttactttcccatgacttattgtcctttgaagcccaaatctcctttcctttgttaaagtggtatataacccctgagtttaactgcttctttgagtttcacttattttctatgactctagtatacacataaatgttaataaaaaggtatgcctttgccttttctcctgttaacatgtcttttattagtttaattcacaggcccccagttactgagcctaagaaggcagaagaaaaatctttccttcctgacaatgtccagaaattaaatttcaacattgtttgcccaagattaatataggaggaggagagaagtatatttgagactgtaaagcctacatacagtaaagttactgttgctgaaaatttttctcagagctatgaattatagttcagactcaaggctatttgcacatcataaaggcgaatgtcaaggaagagaatgatgataaccaacgaagtttgtagaggacatgaattccctgtgtggcacccactgcttaataacctacaatatctattatctttttctttctttttttttttttttttgagacggagtctcactctgtcgcccagcctggagtgcagtggcgcgatctcggctcactgcaagctctgcctcccgggttcacgccattctcctgcctcagcctcctgagtagctgggactacaagtgtctgccaccctgcctggctaattttttgtatttttagtagagacgtggtttcaccatgttagccaggatgttctcgatctcctgacctcgtgatccacctgcctcggcctcccaaagtgctgggattacaggtgtgagccaccgcacctggcccagctctattatctttttcttattcataactattaattccttatcaggtcttgttttattcaggaccccagtgtttaactgtttaggccagttaaaataattttccccctcagactcccttgcaactaagaaattatgtggctttgttgtcactaaggaggggaggcttccaggcagggaatgagaatgctactgttttcctgtcaaaaaggaataaattcagccagcatgaacatcttgctgtttattcttctcttattttttctgctagaatcaagacaaaatgtctggagtctagcagccattttacaatcatgaagttaaaaggtacaagctaagggtggtggaccagcaggtagaaggaatctagttctttgatgacttcctagagccactgcaccaattttggactgccacctctggaattcttgttatataagaaaaatctttatttgcttcagctcttgtcagggtttctattgcatgccaccatcacaattccaagtgacacacactgctattgatgacatatgtttgttttggtgagaaaagggcttaaaaggtctgattttaaagctgaaggatcagattttaaatctgcaggatcagctcacatttctcttcaggaacacgtactggatgaaacaagttaattttttcctttgtagctatggatttataaaaataaaagaagaaagaagaaggcttacatagagacattttggctatttattttctttgtcaaagagctaagattaggaaattatttctctctatatcaattaacactcactgaagaatatttcctataataatgccttcctccctccctccattgtccgtggaagtttgccagttacaatagaagggtggagctccaagtaacaacttggaattgggcacagtcatgaacacaccttggaagtctatctggtttgagaatatccttgggcatatttgcacagggaaatagttttaaactgctggaaataataaagtcagctggtattagttctctgaattgacacacttcaatttttataatctatctttaaaatgcaaaatcttgatccagcaaagtgctgtgggggaagaagaaggtgaatatttgggggaattgcaacttttcagtattcttcaacattttctctacctccatggctaagctcttctagcatatgaatgctacatggagtctatgctggtggaaaagctaaaggaggaaaaagatgtgaccttctttacagtactttgattatgcatccttaagctctcctcagtaggtctgcttgcacagtagtcattccttagaaatcctgccatcaggtagagattctatcatcagttttgtgacttggaaaattccattgctgcctcactgtcactggcaggaaccacactcatcaatcagcatcacttccccaaagctctgtttgcaatcaaaaggaccaaaggtctccttgtttataattatgccagggaaacaccccgctagaactagatccacatgggatcaccagcatcacacatcctcaccccaacacccagctcataaagaatacacactcttctgttgcctagagagagcttagcaagctgcttaatagctacacagaaaccctacacagaactgaaatgcaaaggcatgtaacggatctgatagaatggcaggggaaatttcagatggcagaatgtaattacctaagttactgaggttaaataaacaccacactctcttatctaaaagatgtccacgatcttcagtatccataaatgacctggatcttagttttataactccatggttgagagggaggcaattctccagcagcacaggagcctttcgcttggaaactcttgtttctcatccggcaccacctgtgtgtccccttggctgccccccagccaggtgctcatgcagccaaacccagtgagcccataaaagtggccagagatgcagcagaaggtgtcgggctttctggcccctggttgaggccatctggactctccgttacacctgtttgggagggtttccgtggcatgatttacaaatgtaaatgcaactctggaaatattcctgtccagtgcgtatctcttgctttcacttttggaggagttaattatgcaacaagatcatttctatgcccattttcctcttccattataaactttagatggtgaaaaatgtgcttctcagtatttttttagtgaatgaacagatgtaaaagtgctttcaattccttaataaatgtgacattaggccagatttgatattacactaagtctcacataacatttaaaaatgggttttttcaaccataaaattactaattgatctgtcttgtaaaaagataaaggaaatgaatgcctatttgagtttcatttctgtcaggctcccgatttcttattttatgtagcagaaaatgaattttaatgaagcagcctccaaatttcaaaatatgccattacccttccgaagtaattggcatatttgactgcctttgcctttcttagagtctgtctgacattctaatcttgaagtcaatgttccattcaagatgttcttctgcataccatctgaaagaagtaaattagaacaaggggaagaactacaacagaaagcactcattcatttaggcattcaagaacttatatatggaatccccattgtatatcaggcactgtttcagatgctacagaagacagtagagggcaagatagtgaaaaatccctgctctcatgaagtttctattttagtagagtgggataatacaaaaacatagacaaatactgtatgcaacatccaagtgataatcaatgctataaggaaaaatagtgcactttaatgggtagggaagggcagaagagaggaccgttgtatataattttttatagagggaagcccacacagacttctctagggagatgatggttgagcagaaacctgaatgaagtgagagaatgacccatactgggaaagaaaatcaacagatagaataatctttcttctatattttttgcccacttggtatgtataaggagaaaaaaaatggcttttttcaaagcaagtctagttattttgtctaatctgggaggatactgagtgggtgaaggaggaaggcaactttgattgagtacctacctatcatgccagaatatgcatcatttatgcttttcataaatgtgtgtgacaactctctgaggctgatgatctgagcctaattttacaactggggaagcagaagcttaggggcaggtagcttggtagtagaatgtttcttcttttcttgttcttcttcttgttcttcttgttcttgttcttcttcttcttcttcttcttcttcttcttcttcttcttcttcttcttcttcttcttctttcttcttcttcttcttcttcttcttcttcttcttcttcttcttcttctttcttcttctttcttcttctttccttcttcttcttacatttatatagagacagggtttcactatgttgtccagatggtctcgaactcctggccccaagggatcctcctacctcagcttcccaaagttctgagattacagccttgagccaccatgcctggcctatttattttatttgtataaatttaagggattcaagtgcagttttgttacatggatatattgtgtatggtgaagtttgcactttcagtgtaaccatcaccaaaagaatgtacattgactacttttaagtaatttttcatccctcaactctccacccttctgagactctgatgtctattattccacactctatgtctatgtgtatacattatttagctcccacttgtgagtgagaacaagtggtatttgattttctgtttctgaggcgtttcacttatgataacagcctccagttccatccatgttgctgcaaaagacatgatttgttcttttttatggctgaatagtattccatggtgtgtgtgtgtgtgtgtgtgcatatacacctatacatacatacatatatatcttcatatatatatacacatacactattgtgaatagttgttgctacattacaaacttctaaattctatggcttaaaataagagcaattgcttgtttttcttatgaacatgaattgtgggcaataattaatagaaagggctgaatctgctccatgtggcaccagttgagagcacaccttgaggctgggtgatcaattcccaagacagctccctccatggctggcaagttagtgctggttatttgctgatagatcagctgggcttgaaggcctgtaggcctttatttctctctatgctgattggacttcctcatagcatggtgactgggattctagggcaagtgttctaagaaagagaacaaggcagaggagtattgcatttatgatacacttgcagtcttggaagtctcatcaacccagctctgcatctcactagtgatgaactttcagcaaattgacagcactggaacccttcacaaggacattttttcccaaataacaggctttgtctgttttcatccatttagtcagcaggcatttttgagtaattctagcacaattgtttgaaatacctgctgtgaagtccaattgctcaaatttgcattccaattctgccactcacttcctgaaaaaacttctgatttttacctaaactctgtgcctctattttattaaatgcaaaacatgaggatttaaggaaattctagagaacttctcatgcacctaataaggctacccctataattctagcacttcagctccatcacctaaaataatcaatctcaaggaaggagctaaaattagaatgatggcccttcttctccaaaaagactctcatgtcttatatttccacaagaggaccaagacacacatgatatctttcttcacaaacactactattttcctatggttctgtatacacctgaatctaactcaagctcttactcttcctgatccactaatcccctcgactttgcccttggaaattcataatctatcatcagaaaaaaaaaaacctactctctaagtagtcccctcaccttctttctgtaagggaaagtgagtggtttcctaaagttctcttctatgatagttatttctttaccaccacaatcctgtgtagcctagggctttttggtgggatggataccctttttgttctttgttaccaggtctacattatttcttctttctacatccccaaatctaatgtcctttgaagcaaatgccatcaggctatactgcctacaatcctttcttcacaaagtcatccatcaatgcccctgaccatttctcaccctttacccaagactttagcacctggctcattcactagatttctctctaccagtattcctgtcaccatgttatgtgtctttatcacacatgtagatgatccatccaccatcttggcctctaacaataattcatgacttcattttttcaggctgctgtaacaaaaatcccatagcctgtgtggcttaaacagcaaacatttatttcttacagttctggaggatgggaagtccaagttcaaggcatcagcagattcagtatctgttgagggcccacttcctggttcttagatggccttcttcttactgtgcccttacatgatggaggggtaaggatattctctggggtctcttttataagaataccaatcaaattcatggtgactctatcctaatgacctaattacttcccaaagaacctacctcctaataacttcacattgggggttaggattttaacctgcacatttttggtggggaggggacaaacattcagtcctacacaattcctctttcaacaatctcatcttttatcccatctcaaccacctactcttatagccatgccatatcctagatgtcatatctttccagcttatgtcttttacaacctggattccaattattctccaaccaatcaagtgttttaatccactttttcttattacctctctcatgttacttacttacacagagctaagtaggatcacatgtccattattaataatcacccttcacatactatctcaacaacttgaccttcactacgtgtatattagttttatattgctgctgagacaaattgccatgaatttattattttaaaagaacactcatttgttatatcacagttctataggtcagaaatctggagggctcttatctgaaggctctagggacttacaagctccttcaaattgttggtgaatctagtttctcaaggttgtagcactgagatttctatttcctttcttgctagctgctggctggaggccatccatagccactttatgtctctctctagtcctttcatgtgggccactacatttcagaggcaacaaggtacatcaaaacgttctcacagtttgaatttctttgatcttaccttttgactcatctctctgcttttaatggctcatgttaattatattggatccatccggctaatgcaggataatctcccatcttaaattcagctgattaataaccttaattattcttcaaagtccattcacagcaggacctggagttgtgtctgaataatgtaggggatggaaatcctgaaagggcatctttagaattctgtcaccaccacccatgtaatttttacctgacaaactccaccttgatttaaacctgactcttcacccctccgcaactgctccatagcacctcagtgtagctgaagaaaaatacaacgtactaacaaggctcattctaaatttgtgatgggaaatctcaaggaggcctcagcacagcccagcaatcattttacatttccctaaacaattcctgtttccactctcccagacaacattttgtacatttttcttctactcaaaactctaaccatcttcctaacactccatgttcagaagatgacctcaactcttatttcactggagtggagatttgaagagattagaagaaaactaccacatttcctcatcaccaaatctagtaatctgcctgcatttttatgcatatattcagccttgctgctcctgtttaactctccttgctgttatcctcttatttaatgacaacctcccatgaaggtactctatctctttctctcttgactgttcaattatctttctattacaattactctttctccccaggattctttttctctctctactgctttgctgctataaccatacaaaatatttcctaagaaagaaagaaaggaagaaagagagaaaggaaggaaggaaggaaggagaaagaaagaaagaaagaaagaaagaaagaaagaaagaaagaaagaagaaagagaaagaaataagaaagaaagaaagaaagaaagaaagaaaaaagagaaagaaagaaggaaagaaagaaagaaagaaagaaagaaagaaagaaagaaagaaagaaagaaagaaagaaagaaagttagttcttccctggactttgttttagtaaggggttctatggcttttagatgtaacgcaatgtattttggcccttttatcttacattgtgctagacgccttacctcttaccttagactgtgctggaatttgcctggtaatgcataacaatcttaggaagagtccaaacattcaatgttcaatattttaaaaatagtaacttagtgaaaagctgaaattaatagttttctaattggctttttggggtttctatatcaactggtagttaggacacatttcttcttctgcactcccattagactgcctctgcccttaagtcccatgaaatcctgaagcactgccccatttctctgctcatctttatagcaaaactccccagaaaattgtctgtactttctaccttgatatggtttgactctgtgtccccagccaaatctcatcgtgaattatactcccctaaatcccacctgttgtgggagggatgcgatgggagataatgtgaatcatgggggtggttcccccatactgttcttgtggtagtgaacaagtctcatgaatctgatggttttatcaggggtttccgattttgcatccttctcattttcttttgttgctgccatgtaagaagtgcctttcacctcctgccatgattctgaggcctctccagccatgtggaactgtaagtccaattcaacctctttttcttcccagtctcaggtatggctttatcagcagcatgaaaacagactaatgcatacttcttcttccttaatggttatcttcttttaaacccatccttgtcagtcttgtccttagcgtttactgatattccacttctgaaggtcaccatgaacctccagtatgctaaatctaatgaacaattcccagttatcagcagcatctgacacagttgatagatcccctgttctaaaaacaccttctttattcatctcctggtgattatagtttcctgggttttcttccccctccatgacagttcattttcagttttcttttcttgattatccttattctttctgagctctaaatattggacttcctcagggctcagccctgagcccttttctattttctagctacactctctctataattgaaattagttccattgttttaaacatcttctatatgttgatgactcccagttttacatttctagcactaacctctcctctgagcattaaatttatttaccaattgcctcctcaacaccaccacttggttgactaataaagttctcaaaattggcatgtctaaaataaaattcatgcttttctctacctcttctcttcctccctttgcactcccattcatttttctgactttctcatcttgttcagtgttacacaaccactcatcttgttgctcagatgaaaactgtattagccagggttttccagagaagcagaatcgataatatgtgtctacatctagaaagagggatttattttcggaaattaactttcataattatgagaattggcaagtctaaaatctgcagggaaggttgacaggttagaaacttagggaagagttcatgttctagcttgaatccaaacaagatctagaggcagaattccttcttcctcaaggcatcccagttattttcttaaggccttcaacctgactggacaaggcccacccacattatggagtaatgtggtaatctgctttactcaaactctactgatttaaatgttaatcacatgttaaaaaatacattcatgacatctaaactggtctttgaaaaactaggtatcatggcatagcgaagttgacacataaaattaaccatcacagcctacttcttttcacctcagcacccacatctatttccagacttaatctcaaaagaaagacaataataaggtcatacttctgacctaacatgttctgcctaacatgatacaactctcttgtgtacaaccaaaaatgctgtgttagtcagttcatgctgctataacaaagtgccatagactgggtggcttataaacaacaaaaacttatttctaaactgctctggctgttcaaagtcccagatcagaatatcagcacaatcgagcccttatgaaggcacacttggaggttgtgcactgccggcttctccttgtatccttatatggtgagaagagagctagagagctctcataaggacactaattccacctcccaatgccatcacattgggggttaggattttaacatatgaatttgtgatggggaaaacaaaaacattcaatcataataaatgtcccaatgctttttctagaagatgcaaagctcttagctgatgttcactgaacataatatcctataattaaatactataatgcaatgttgatacatatacaacaaagatatttgctatatgcgtatacacacatatatacatatacaaacattcataacaaaataaggaatatttatataataattacagtcctcatgttaataactggtcacatgcttatagcaggtatttataagcttttttccactatgaattttgtattttctttgctttcagtgagaacctcagctagtcatgattctttacctaggaggtgacccaaaacttattcctgaaggatctggaccattcatagccctgtctcaattgggttgttagagtattctattgtatttagtcagagagcgtagtagtactaagagatgctctaggaaatcttccatatttcaaacacacacttccttctctccattttagagcagtctaaatttctcatggtgatcaggatcaatcatcctagctagcagaacagctccctcctttgcctgttcattcaaaggtataaagctaaaagtggctgaggggcaatctttccttcaagttatcattgttgtagttctagttggaccacagtgacatttgagacctcctagatgtagtatctattcaaagtcagtccagtaatcccccaaaagtctgattatttcctttgttgcaatgtacaatcaccttggtgaaagaccataagtttctctgaagaagactgagagaaagattaacagtataaattgttgtcagtgcagcaagatcgtttttcatagagacccagcctccccttcatttgagaggttctaagcccataaactggctcaaagtctgagagttgattaaaggagtctaaccctctgcttttgtgacttttgttcccttaacccacaattctccacttatacagattaggaacaatttagcagatttcccacctatgtcactttctagggacacaatgattaactagctaacatcatagatctctgtgagtcattttattctgattgctgctttgattctgttttccatcatggtaaccatgcttactttgcctttggtgagtaaatgccatcactttgtccctgccaccctgggacctagttatcctcattgcatttaggtttaccaatccagtggcagcaattaccactgtaatttctgacccacagagaagagctatcacaagctcttcaaggatgcattgctcccctcgcaaattcatttctcactgttatggtgaaagctgtcctctggacccttcccagtgggtgagaagatcgtaagtgataaatccacttgaatattccaatttttctaaggctttaaatacctttttctatagtataccaaggcagttatggtatttcaattcgtttagtgtatgtcaccttttggtccatgtttcagccaaccaaacaaacaatttgagctctttctaataccccaagctgcaacattaaatctagatttttttgcttagtgggcccatgtcagtaaattctgcctgattcaatctcccagtataatacgcccttaatactgaaactgcctttgcaaaattatgatggagagagtgaaaaaggtctaacataactgattccatcttgcttctaacctccaagctgtccttgttcactcctgggcataggttgaactaactttgggaggaactcagtttataaaacaaagacaataacagctttttcctaaaacaaacatccttcttccttagggattagactgtctttacaggactaacaaattagccacaagattagaaattatggtttaggagtcaggcagctggaggctacaaggttctgatcctccctaaaatgctgctaagatcagtgcttgagatattttgcggaccctgcacttgatggatcagctggcaccacccagattgataaactggctcatgtgatcttgtggcccccacccaggaactgactcagtacaagaggatagcttcaacttcacatgattggttgggtcaagagtgctgacccaacgaatcagcactcttgaatcactggccttcctccacccacaaaattatccttaaaaactctgatccatgaatgctcagggagactgatttgaactctggtctctcacacagccggctctgcacaaattactttttctctattgcaattcccctgtctcaataaatcagctctgtctaggcagcaggcaaggtgagcccattgggtggttacaatatccactcccacacattctctagatttctgtctgtaaatattagaaaaatcatattgttattttgtagtgtaacaacctcctcatggggcacaatttgcatctcatctttagaggcctactgagacttgagtttagttataggtctacgaaaaaaaggggttgtaagggtgggtcctgaggagaatcagcagtgttttgtaaggcagttacctcagaggtgaccattactctttcatcaggcaaagcagaggtcatcttctcagatagagatggagtggcttcttctactgacaaagcatcttcagaatgtaggagtttaatgccccccagcttcatcaggatcttcccatatgtccccattccaattttcaggaccccattcctttccaattaatgctaccactttaacagcagacaccctgtgagcttaggaattcaatttgcattgtaattcagctacttgcaaaatggcactgtgtttagttttcagcaatctcagctttttggctacaggtaacaaaactttcttccagggcattcatacaaaattttaggtcatttatgcagtgcatgagctgggaatttgaatccttgaattcatccttttatttctacactttgtttacatcaataaggagcaaccagccaatctctttgtactcatcaatttaacaaaattgttctagggtatcaaatacatggtcacttttgtctcttataagtattgattatggtcactgaaaactttgtctcttataggtgtttgattaggaatatccacagtaatattttgggtatctcaactgatatgtcacaccatgtactatctatgctctttttgcttctagaaatatcattagtgcctttaaatctagttagattagagaaccagttccagaaaccccataaccaattcagaaatctcatccttaagattctgttgctctagaacaactcttcttatccaaatttgtattagtcatgattcttcagataaatagaaccaataagatgtgtattacacacacacacacatatatatatacacacacacacatatatatgatgtatagatagatctatatatctgagagagagatttattctaaggaattggctcacttaggagggctggcaagtctgaaatctgcaaagaatgccagcaggctggagccccagaaaagaggtgattttgcagtcctaacgcagtctgcaaggagtctggaagcaggatttcttcctgggcaaaccccagtcttttctcttaagtctttcatctgtttggataaggctcacccatattattgaaaataatctgctttactaaaaatctgctgattcaaacattaaacacatctaaaaatattttcatatgaacatcttgactggagattgaccaaaagccaggtaccatggcctagccaagttgatacataaaatgaaacaacataaaaatctagaagtcatccttagtatccttcactcttaccacacatctgattcatcaactctactttcaaaatatatcttgactctgatcacttatcatgtgtgtcattcttagcttcctagtacaagctaccttcatctttacctgctgtcctaaacagtctttttgttctccttgctttcactctgccttctatcctgctggccccctgccctctgagcccactattcaggcagcaatcaaaatgatctatttaatgacctaaatctaattattctactcaacagctcaaaaacctccaatggtccccatgaaactcaaagcaaaacccaaaactttgtattattgttacaatcttatttattctggttctgcctccctcgctctgacttcatttaacatgcaccagtgttttcactcacttgctaatgtccatctgaaggtgtttttgtctctttggtctagaaaactcctagatgtttctatggctccactcagatcattgctcagaaattatttctttaaaattctttcaggattactgtatttcagctaacagtattacatactattcctttatgctaattaatttttcatagaatttattactgtcctgacttgtattatatatgtgtttggtttatgtctgccttctcaatcagaataaagcctccaaaaggacaaggacttatttcctaccaaaccccagggcactagtactaggtctaaggcacagtcatgcacaatcatatttgtcaagtgaatgagtgggaataataatactttagagtgagtattcacggggttgttgagaagattcaatgtcataatgcatgaatgttaaagacttctaattgctttgtaatgtcaattctcacttccttccttactaatataatctccaatttgtatgtgggcacatggctgcctggaatacagacttcctttcttgccctttcagttaggaatggtcttatgactgagttccagctaataaggtgcaagcagaagtgccacattcaacttctgggaagagagctttaaaataggtgggtgggggagtttgttccttttctctttccctgctgactggaattggggcatcataactggaactccagaggctctagatgaaacatgagatgaccctaacagtagaaatcaaccaagaaggatcactaggaacaaaaagcctgggtccttgctaccatggagtgatatatcatgcccagatcgacaactttgaaactttttgaatatgagggaaaaataaactactatcatactaactacctgctatttttgggttttctgttccttgcaatcatatctacttcttgcaattttaacatgtaaattgatcatgacaaatattgacttgtagtaagccctcaataaatatcattgtttgcttcatattcttataactgttttcaattttttctatttctatcttttcttgttaacattgtttttgttgttataggctgtgtactatgtgaagtgctagggataagaatgagaataagatagaaatttcacttaaaggacattgtggtctagggagcatacaaagaaattataatacaacgtgagatgtattttcatggcagcaataaaaccatgctgtggggacacacaggaagtacagaataagtctgccaggggataccagagacagattcattgctgaagatgtagatcttaaatcaagacttaaacatgcctagaagactatcatgaggacaaggggtggagagtgcagagggaaaagcaagggaattgactgcacataggcctccctattaggttcaggaaaaatatgaatcatacccccaacctaaaaaagaaaaaaaaagacttcattgcccctaaggaagctaaggcactccatttttctcgtctcatctgaaacttcattggaaatgtggggttgctgtgtttaaaaagtcattatttccaattctgtgaagaaagtgattggtagcttgatggggatggcattgaatctgtaaattaccttgggcagtatagccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggatttcactcatgatttggctctctgtttgtctgttgttggtgtataagaatgcttgtgatttttgtacattgattttatatcctgagactttgctaaagttgcttatcagctgaaggagattttgggctgagacaatggggttttctagatatacgatcatgtcgcctgcaaacagggacaatttgacttcctcttttcctaattgaataccctttatttccttctcctgcctaattgccctggccagaacttccaacactatgttgaataggagtggtgagagagggcatccctgtcttgtgccagttttcaagggaatgcttccagtttttgcccattcagtatgatattggctgtgggtttgtcatagatagctcttattattttgaaatacgtcccatcaatacctaatttattgagagtttttagcatgaagggtggttgaattttgtcaaagaacttttctgcatctattgagataatcatgtggtttttgtctttggttctgtttatatgctggattacactgattgatttgcatatgttgaaccagccttgcatcccagggatgaagcccacttgatcatggtggataagctttttgatgtgctactggattcgttttgccagtattttattgaggatttttgcatcaatgttcatcaaggatattggtctaaaattctcttttttggttgtgtctctgcccagctttggtatcaggatgatgctggcctcataaaatgagttagggaggattccctctttttctattgattggaatagtttcagaaggaatggtaccagttcctccttgcacctctggtagaaatcagctgtgaatccatctggtcctggactctttttggttggtaagctattgattattgccacaatttcagctcctcttattcgtctattcagagattcaacttcttcctggtttagtcttgggagagtgtatgtgtcaaggaatttatccatttcttctagattttctagtttattttcatagaggtgtttgtagtattctctgatggtagtttgtatttctgtgggatcggtggtgatatccgctctgtcattttttattgcgtctatttgattcttctctctttttttctttattagtcttgctagtggtctatcaattttgttgatcctttcaaaaaaccacctcctggattcattaattttttgaagggttttttgtgtctatttccttcagttctgctctgattttagttatttcttgccttctgctagcttttgaatgtgtttgctcttgcttttctagttcttttagttgtgatgttagggtgtcaattttggatctttcctgctttctcttgtgggcatttagtgccataagtttccctctacacactgctttgaatgcgtcccagagattctggtatgttgtgtctttgttctcgttggtttcaaagaacgtctttatttctgccttcatttcgttatgtacccagtagtcattcaggagcaggttgttcagtttccatgtagttgagcggttttgagtaagattcttaatcctgacctcagccaaaagaacaaagctggaggcatcacactacctgacttcaaactatactacaaggctacagtaaccaaaacagcatggtactggtaccaaaacagagatatagatcaatggaacagaacagagtcctcagaaataacgccgcatatctacaactatctgatctttgacaaacctgagaaaaacaagcaatggggaaaggattccctatttaataaatggtgctgggaaaactggctagccatatgtagaaagctcaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatgttcgcaacctactcatatgacaaagggctaatatccagaatctacaatgaactcaaacaaatttgcaagaaaaaaacaaacaaacccatcaaaaagtgggcgaaggacatgaacagacacttctcaaaagaagacatttatgcagccaaaaaacacatgaaaaaatgctcagcatcactggctatcagagaaatgcaaatcaaaaccacaatgagataccatctcataccacttagaatggcaatcattaaaaagtcaggaaacaacaggttctggagagcatgtggagaaataggaacacttttacactgttggtgggactgtaaactagttcaaccattgtggaagtcagtgtggcgattcctcagggatctagaactagaaataccatttgacccagccatctcattactgggtatatacccaaaggactataaatcatgctgctataaagacacatgcacacgtatgtttactgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactctcacaaggacaaaaaccaaacaccgcatgttctcactcataggtgggaattgaacaatgagaacacttggacacaggaaggggaacatcacactctggggactgttgtggggtgtggggaggggggagggatagcattaggagatatacctcatgctagatgactagttagtgggtgcagcgcaccagcatggcacatgtatacatatgtaactaacctgcacattgtgcacaggtaccctaaaacttaaagtaaaataataataaatttaaaaaaagactaatcccaaaacacattgcaactacaagaaaaaaaaaaagtcattatttctaaatagtctgattacaagaggagttgacttagaaagcaaagaggcgattactatatggaatatacataatcagaattgtccaaagaaagcacaatggcatatcctggatgtgagttttttgggagataggaacacagaaagggagagaggacatgacgggaaagtacatagacagataaaattagggaggtttcccagggaaagggaaccacttacagtacttaaggcaacaatttttgaagtcgtttctaaaaaatgaactgtaagaactccctattctattccttacattgacaggctataagctacttaggataatattcactttacttaatattcagtgcaatgctttgtataaatttcaaaatctttaccctagctgcactagatatgttatgtagtataaggcagagggcaagggaggcaacactaagcaaaataacaatagacaggttagaatttcctccttaagacatcactagtgcaacatcagcagatttgctgactcttaatttgggctctcagtattcttgacattgtccatttaactgcttggaactaaattaaccttaaattttcttctaaactttccctttacttctaacactaagtttaacatttgctcacagcttctctaatactatatttatcttgatactgtctcacattaatgatcattttaaacaaaattttttatgtatctaaaagccaagtgcatttctatgcaaacatgcctctgaaaatataatggagaactgttggaaaacatgtggcctgtaaacgttcgatctacagattttaaatttcaagaaaggctgtataataaaaacaaaataataaaatttaataaacaaaaataaacaaaaaccccacaaagctaccctatagaaattgatttctggggctgaagagaaaaggaaaaatagcacttccttaatattaatctattataatgtatccttcacctcagcttctctttgccacattataaagcagcaacgctttgcattgaccgtataattcaaatctttctttggagaaatatgcaatagttggtaattgtctgcattctgaagcatctcattttacgccccccaaatgcatgattcactttgaatgataaatatggctatgaaatggagtgtttccgacattcacagatcaaatgtaactggggaggaataattcagatgcatcctgatgttttatatttccatgcactaatatttgcttcacaccatatgtcacagtaacacaagagtgtgatcatgtagaacagcccagtggttttctcctccaacatctggtcttctgaggaagtctagcactttagagattcatgtgtaaatcccaagacaggtggtaaaaatcaaatgccttggtgacgggaagtaaaaagaaggctagaaaggctttttcctgtcatcagattggcatcaaggaatgctgtgatcatcttagtggaattaaacaaacagaaccagtagtccactggaccctctctgaaaagccacacactatgtacattcacagggcagtaaagagaaccagttgtcagcaggcgttttaatcggtggcccccctcttcaagtctgctgactcttggctctgttgaaggcatccagccctggaggcactatagcttcgtaaggagcaatggcaacatcatcttcctctggaagctggcttgaccactctccagagaagaagaccaagaccactttaggtgtactgacagcatttacaatacaagctagtctctctaatccttaaaaaaaagagaggagtggggggaataagctttcatatttcctactctcctgcaggcataaattagctagatttattctatttcctcagctcctctttattcttcaggttggtacagtgtggtttctgtccctaccacttcatagaagctacccactgagttcctaaatggctactgtgtaagctaaacttcatttacccttttctaacttcattttgcttcaccacagtgtttaacagggttgactgctctccacttcttggaacactctttttttttttttttttaactgagttagatgttacacttctctgcttttctaactaccctctaaatctttttttgtgattcctttactttcctagactttcaagtttcgatgtttagcaaactgtgctcttacgccttctttttgtctgtttacattgacttctggatgacctaagtccctctcaaaattccaattcctaatcacccctatgctgcaagtactgtcatcctgtgtttgctgctgcctatctattacccacccttctccaccctgccctgggccctgggatggtgatctctaaaagctgcatcatcagactcctcgtattttgaatgatggtttgttttgttaacggcagatagtatcagaaaatgggatggtaggaagaaaaagaggtgggacgttaatttttttttttgtaatttaatagacttttccaaccttgcgtaattaggataaatcccccttggtcatcttgtattattctttttataaactgttagattcaatttgctaacattttgttgaggatttttgcatctattctcatgagagatatttgtctgtagtgttcttttcttatactgcctttgtttggctttggtgttagagtaattctggcctaatggatagagttaggaagtattccctctgcttctatcctctgaaagagattgtagagaattggtataatttctttcttaacgtttggtagaattcaccagtgaactatctgggtctagtgttttctgttttggaatgtaattaactattgatttgcttttaaaaatagatataggcaaattcagattgcttttctcttctggcatgagttttctcttccatacttttaatctgctttttgtgattttaattgagcatttatcgtattttatattctaattctacaagtagtccaattctgcttttaaataaccccataccacttcacaaagctagtactttgtaataacacaatactaattcctccctttcatcccttttgccattgttgtcattcattttccttacatatttgcatacccaagtgtctatgtaatcattgttgctattattattatgaacaaactgttttctgtttactaaattaaaaataagaaaaaacaaatgttttcattttgctttcccttcttcctttttatgtattgatccaagcttctggcttatatataataactttcctcctccctaaagaacttcttctaataattcttgcaaggtatgctgtcaataaattccatcaatttttgtttgtctgagaaagtatttatttcttctttattttcgatggataattttacaagacatgtaattctaggtgtttccccgccccccccccctcagcactttaaatatttcacttcattctctttttacttttatggtttctgaggagaaatcagatttaattcttaccttcgttcctctgtaggtaaggcttttttttttttcttctggtttctttcagaacattttttttaatctttgatttttctgtagtttgaatatagaatgcctatgcatagtttttagtttttggttttgttttttcgcatttatactgattggtgttctcagaacttcttggatctgtggtttggtatctgacattaacttgggggaagttctcagtcattacctcaaatatttcttctatacttccctctctttcttctctttctgttattcccattatacatacattccatcttttgtagttgtcccatcgttcttggatattatgttcttctttttcagtcttttttgtttgtttgtttgcttgcttgcttttcagttttggaagcttctattgagatttcaagttcagagactctttcttcagttgtgtccagtctactaataagctcatcaaaagtaatggtcgtttctgctttagttgcttttgatctctggaatttcttttcagttctttcttggaatttccatctctctgtttgcattgctgatctgttcttgcatgctgtctactttattcattagagcctttagcatcttaaccatagttgttttaaattcccagttgaataattgcaacatctttgctatatttgagctctggtgctgatgctagatttatctcctcaaactgttttttgcctttcagtatccctcataacgttttcttgataactggacacgttgtactgagtaaaacaaatttttacaaatataggtctttagtaatgtggtagtaaactgtgtggggagggaaaatattctatagtcctatgattgggcattagtcttctagtgatgctgtgctcctggactatgaacttcacaagggcctctcagtcccttgccccttagttgggacaggttggctagagtggactggagttggctagagtgggctgcagttggatatttcctctcctccacatggaagctagaggggactgcagttgagtattttccttccccaaggtcaattagattctgataaaaccccagcaggtttagatctagtgaaacagtttcacctaaggataggcaatacatttctgtttaagcctcccagttcatggtctttgttacagcagccctagcagaagaatacagcaggaatcatgtctgccttgattactgtgatataccaagtttctagcatgtgtcaaacatttatggtaggaattctagacatatctattgaatgattgattaaattcctataattactgtgaagtaaaatgacatattgggaaagtaattaaaccaatttggtaatgggacataattattgaaatacaaggttatcacgttaaaacctgatcccacatctgaaaatagaagaaaaatgttttaatcagtccacaccacatttaatattaattaatcaagtaggaaaacggagaatattttctatcagggaaagtaataaaataaatactaaagatcactactcagaataataacttatttttaaaatgctatatcaggttttcttacctcaattcacgagccctttagattttacgtttctaagtaatagtctttattgtcaatagagtcttaagcacagggagtgaaggagtttgagtgggtcctttgtcatttttacttatatcagaggcaagaggcgaaggagattgtttagttgctactttctgagtttatctcttcataattcaaacctgagaatttcaactcccccaacaaggtacttacaggctgaagttaagaaaccctttaaaaattttgtggaccagaataaaattatcagttcattcaactttccataacgcttccaaggtagaggtgattcagctaagagacagcatgtggatttcttaatgaatagtaaactttgtaagtttgtatgtaccctaaaaagtttttgccttaacccaatcacatatgttaaagtcagacaatatcttagaaacaaagaccttccttccattcccaaatgacaagttggcatttcacaaatacctctttagttaaataatggggtggtcataatgatgaagtggtgaatataatttgaactaaaatatattctgaatgctcatgtgtagaaaaataagcagcctaataaaacatattagtagtgactttgtactagatgtcatcaatgatatcttctaatcctgagtcttcaaatgtagtcacaaacatgccattggtacattcttatgagatatcaccaaggaacggagagtacttgaatttagccactttaatttccttcttactaacttctattttccacatctacagcaggaatcaagattttaaatgtatttgattttgtcatattatactcatacaactctgtaaccccagttaagtcctccacaaagagaaactaagtgaccaaaatcttgcatgcactttctttaaataataaatctgctccatatcatgtggccaactttcaaacagagaagacctgatacactggtacattcttggactatatcccaaactcaattgcctcattgaactttaattcttcctaacatgttattggaaccatcgttttattgagcactccagccctagatctgatgatcaacaatgactttctgctatcactcttgacttctccccaagccaagccctacagcataccctcattttgtattaccctttggctagccatgcaaattttacactaccttgaaccattcagatcttaatactttaccatgtcattgatcatgtaggcacagatttccacagtcctgaagtggaaaaccaaataattatgaaagacgtacattttgcctttgttactagttcaaggctcccttttctatacccatagtctcttacaatcttggttcataaactcttagagatatgtcgatgtcatgatggttgctctatagactccttctgcctaaatcagagatgtacaatttttgtaaaagcttatagatgtcacagaatacttcctccctcagtgaaatattttatagtatgcttcctgtgttcgtcttcttccatcaccatggtgattaaaggactgatcagtaccacggctacctggaacacaaactcagacataattgctctggaacttctcctgtagttcaatcgttgcttgagccagcagaaatttgattttatgttacttgcaaataaaagatgcctagcatctaattcagtctttcgtctcagggaactgcttattctactttaagactttaggagacaggggaagaagacaataggagacaggggaagaagacaagggcagcatgtgacaagagcaaaaaatcaatttgatggactaacataacaaatcttgtgttctctgaaacaacggggccagcttaacagacttcacaagattgtcatgatgaacatattcagcaactcactgctcaggcagtgtttcaggaagcttgtccaggtatctatgagacaatcatcaaatcgttgagtctaatcagcatgaaataaaatggttgcttttaaatattcttaaatactctcagttctgagcctttggcacttttaaaatacatgcaaagaataagtttttcttgagttttgatatgaattatgagaactgagaatttgacactgacctaaattactaacaaaaggctttaaatatcaatgaataaaagtggaacagaagaaaaatgttcattttaatttttaaagaaaacattttcattttattaatctttctaacaaaaatataattatcttcaaatgaaagagcaagattattaataattttcacttttagaagaacttgaaagagaatagaaacattttctagtggagtgaatcttttaaatgcaggtggccgggcgtggtggctcatgcctataatcctagcactttgggaggctgaggtgggcgaatcacttgaggtcaggagttcaagaccagactggccaacatggtgaaaccctgtgtctactaagaatacaaaaattagctgggcgtagtggcgggtgcctgtaatcccagttactcaagaggctgaggcaggagaatcgcttgaacccaggaggtggaaattgcaatgaggcaagattgtgccactgcactccagcctgggcaacagagtgaaactctgtctcaaaaaataaataaataaaaataaataaataaataaaataaaatgcaggtaaatgtgatctagtgaagacattatgaactcaggccttttattactaagtaaatataattcaatgtttaccctttaaaaaatattgaaatctggctgacaaaatgcatcataagtggaattccatttaggggaagaaaagtcaggcctttccatggtttctttaggtcagcattggaataattatacactagcatataagcaaaaaataagctaaatatatataacttgatctgatataaaattcaaatgtcttctcatggctcagttcgtcaacatttttctcaattttaaagaaaaaaagcacaagaaacacaagcaattttctctttcatgttgacttccaaaataatgtctgcatgaagcctgcagggaagcttgggaattagaatcctttttcaattagcaaaggaaaatctaagaaaatttccagtagtgactcaattaatccaactacagcagggagtatatactaatagttagaataagaaatggagagaaggtgcctcaaacacccttctaattccaaagcctgaaaacggagttgccaaaggcaattctacttgcctgcctgtccttcagatttccccattgtaaaaataaacaaatgaaatttaatctagttcaatcatagggcaatgtttatagaatacttacaagttttactaacagtgttcatagagcagggccaagaaagggtctagagactgacaaggctattaattgctagttacgtcctacattaagtttgtgttcctcacatcttccttgacgatgagaatattttcacatttgtcttcattctcagatagttctacttttctggatggggagacattttgtcagtgtaactgagacagctttaatagaatcaatttcaattttaaatctctcttgagaggcactcacatcttgtaggttcacctaggctgattccaatgatgtctcttgagtaactatcctcgggccatatgcatgcattttggcttctagctgagattccgctgaattaatagttgattaaaattgttttaagaaaaatgtcactgaatggcaaaatgccaaataacaactgaattcatttgtgaggcacaaagacgagtgttactatctccaccccatctcccacaggccaatggcagtcctgacaaagtacaaagtgaagctctcgtctcaaagaaaagacacaaaatccccagcagccccatcccagagaggatatgacagcagagctccaggggggacacagctcatgataacagtggatttctcttgcttccccttgatatgatatcataccttttattttttccaatcaaaatgtagattaaatttcataatgcactgcaaagtgttttcaaaatgcaaactcgttacaaaaacccattgagtaatattattaatttatgtttattgctatatagaaagaatcttgctgcttttctgtttttgactatttgcacatgctctttcctctgtttggaatgcctttctcattttccgcttggagaaagcccaacccaccaggagaaaaaccttccttggcaaacttgccactaccccagagcctcttgtgactcctatgggttcccagagcctactgtgacccctcttacttcttagctcttggcatgctctaatataatgttagattaatatagctcttctggctgctagacagtgactgtcctgaaagtagaggaaagagagcatcatgttggtatctggtgggtgtttaagaacaatgcctagtacaaaggtgtactaaaataaacatgttttttgaattaatgtaactagtgctgcccagtaataaatgctttcaataagcaacataatttagatttctgtatcctatggagttacctcagtactttcaaaacacacactagcaatgtaggtaatgggttatcattaaagtcttacttttttttaggttgactgctgactcaaatgtgctttattttgtagccataatttgttcacatttgtcttctttattaccccataggctctttgataaaagagatggtgccccaattcttgtgcctagcaggcacaaaaagaaatacatttgaataagtaaataatcaaatatggaaagatgacttatggtgcccatggctaggcagagggtgtaggtattgtggattgattcaatagctacacaatcaaatagagatgataactggagttaagatgtaacattggatctgggacagggagagtttaggaaactaacaataaaatccttccataaactaaagaacgctcgccactatcaggatgaaaaaatatgtcctatggaaagatgttgccatagaaatagggtatatgaccctacaatgcagaagagttaaaactggtactgatgaaagaggtttgttattcatctgagaattagtaaaataatgtctagctatcccaactccataaatggcctaaaggaaaggactgtaacaagcagttttccagaaaaaaggacaagttgcttggacatagagcaaaggggaaaatatgaggacatgatcgattccatccatggacaactgcctgagaatcagggaggaatgaggttggaaaatccccctttattttttttccgcataggtgtgttcatttccaagcagtttggcttctttcaatcctggccttcttcctgctgaatacagaatcatttcaggggcccaatagtttaccaatacctagtccagatgcactgacaattctggcatgcctctccattttatcaaagcacccagacatcagagcatctgtattgcaccagctggaggccagcccctttatcctcatgcttatgtgttcttaggatacataagcacttggaaaaccacttagagggattaccagccaaggtaccacataatgcagctagccactattaccaacagagacctaacaccagtacatgttttgttgagaaaaattaaaaagctactcagctgtaaaagccatttcccactcaattgttggcagcctcaaattgcagttatgtggacccaagcaagcagtaacacacacgcatacccttcagttaaagctcaagagccacatgatttagctttgagtcccagcaaataactagaaaggttttcctttctttttcttcttccagttggtcgacaggtataacaagttgactgggtctgcagtcagctccatcagagagtgtgaataacagagcaaaaggcagaaagattttatgtgtctggcgaacagagcatccccagggaaatcttcagaggttgaaaacatttttcggaattactgcaatatactacctttgtcaaaggtgcttacagtgattgaaacatattaattaagtttccttcctgacctttgggattgggactgtaaagtagcattaaagcagatttgtagaagataacaaaggggctgttatccaaccagtgctgacccaatcatgcatgcatagggtctccttatcaccatgcttttttctccacagtctgtatagccagagagaagtcaggctaggcttatattcaggtactttcttccgctctctaaagtttgaaggatattgtaaagcttatagtagggtggggaaagggggtcttcaaagacatgaaatggcaaaaaagaaatatgaaatttggagaggagcagtatagtgaaaattgctcatggcttttcttaccaattggtttttagcaatgatgatctctacaaatagtgttctcagtcattttgaatggagagatgaactaatacaattcatttttaatcagtatttaggaaaactgccagattgcaggaagccaaaattggttgactgttagtctttcccctggattaacaatcatctctaaatggataacttccttgtc

SEQ ID NO: 605 - DNA, 307212 bp, Homo sapiens
acttttacacattttttgtattaaagttagtgaataataagatgggtagcataaacaccaaaaatctaaatctatttgctgccctcaaatttatgttcgtttagagctcttttatatcaaatctggtagatattcaaagcaagctctaggaaaagtcagggctgctaaaaattcagtacttctatgtctccaaaatagttttcatgttattagcagtaacttataccattatagtaaattataatataagagaaaaataaggatctatgtcttattttatttttacctttaccctcaatatcaccaggtatgttgtaattgctcaattaatttttaaataaattaactcagataattgagaccaaaagatcaaatatgtacatgagaaaaactttctaagtacaacactcataagcctcatctcaagtataagacaccttcacatcgcctcacagtactgcctatcccaatctcctcccactcttacattcacgggattaactgttgctagaaaaaattattcgtaaaggctcagattgttaattactattcagccaggtattgttaggggtttcatgtgctatgcttcctcagcaccttacaaacctttaatacagcactttcacattgcatttcaaatgttcaggcttccttctgagtatcatattataagctccttgaagaatcgcattaggtttggttcatatttttatgcccagcaaatagcacattgtcagttcatcataggtgtgaaataaactacaaatgaatatatgaaaaagtgtatcgataattgcttagtgacacttgaaagtgtgcttaaaaattcagatcacaagaaataggccaacatagtattcgaaggggctcgattaaggatccctattgtgtccataagatttgtagcctctcagatgtcaatagcatgatctgcctattgtaggttaaatttcacggtaaaattgtacacaatggtctgctgagccctgtaaagtagactctaaaatgaactttttggctgactcaactctgttcagtgggaggactgagaaggatcccctctggtgccaactgctttaacactaattatcagacatacaccagattaaatgcagaatagaatgtccagatcaggcaatctacttaaactttaatagaagttaattattcattgatcaaactcatttatatctaattaaagttttcctgcattagaaggtacaagctaacatggtctacgttctactccttggaggagagtacctgatgcaaaaataaatggaaaatggtgacatttgtgtgatacaaatacatatttgacaactgaattatcaacttcaggcctaatccatttaggtgactttgctatgtaaatatcgtctccaaaatgcttccagaatttggtaatttttggagccagaagaacatagcctgtcaaggaacaaagcctgtgtatgcttaaaagaaatctcagggtctgaattttatgtaggtaactatttcagtttcatgaagcataattaattgtgctctttaccataaatatttacgacaataaaaatataaaatcttgaggcttagtatggaaatgccattttataatctatttttatgccattctctctgaaagcccacaaaatggcaggattttctatggagtggaaaagactggatgctttttgctggaaaaagaacatatgtttatgctaaaaaaaagtttcctgtgcattttacttttaactgtcatcagttacaatatgctgcttgaaatatgttgctttcttttatggagtgttttctaatattgaacatatttcaaagttgtagatttttgctttggggatataatttcttatctaaaggcatatctttgaattttgtgttcttttatgatagcaagattgacagttttatttcctaataccatgcatcctcaattaaaaccactgtgtaaaaacatctattgccataaataacccattataaataaatttcatatgagtcctaagtttccaaggctaaatgttaaatctctctttaaatccataaaattgctttccaactttgttatcactttttattcatcgtgattactatcaatctaagatttgagatgcagtgttcatgttcagtatacacaaaatgtccccactccttggacttataaatacagtaagtgggtgtgctttacacgcatgttttactttttcttggggaaaacaaaagattatttctttaaatcaaatttttggaagggatttaggcagaacaggacctcctcatgttcacacgttactgatttgggtatttcatatatttcatatagttttctagaattaaactgcactataattgtcggtttatgtttgtcttcccaccaaactgtaagatgtgtgttttacttttctttgcacccagaaactaacaaaaactcctgtgcatagaaagctttcaatgttggtttgttgagtaagtaaaataacaaatgaatggatggatggatggatggatggatggatgaatggacagatggatggatggatggatggatagatggatggatggatggatggatagatggatggatggacggatggatggatggacggatggatggatggatggatggatgaacagacgaatggatggatggacagacggatggatggacggacggatggatggacggacagacggacggacggacggacggacggacggacggatggatggatggatggatggatggatggacggacggacagatggatggatggatggatggaggggcagatggattgatggatggatggacagatggatggacagacggatggacggacagatggatggatggatggatggatgaataagtgcatgaagtttccacgacatgccacctgttgccatttgcatgttaactgacagatattgggccatccagccctattcccttttcgaagataagtaatggcctaaaattaacttttaaaggatgtgactatatgtgctacttgaaaaccttcaagatatcttctgaaatcttccttgagcaacccaaaacactttccctggaggagacaaatggccattgttgtttctcctaatgaagttttataatcttgaagacaagtaactttcctgtacataagcacaaattgcaatgccagagagtcatcagcattttttcgacgttggtatctaaatacaccagaactggccagataaggttaattacttgaggttaagaaaatgtcatgttggggtctttcaaatgcttatgagccacacaagagatatgtttcaaatgcacaggaaagatgcagatcaaatcacttagctctcaggtagccaatctactggtctgaaatcgcttccgcttgtggatggagactgcactaccttaatgcctttcctatacaattatttcttcttcactggactccagacaaaaataaaagagctttcagattgatacctatgagccacagtctgccttattgtatcattagctcattttaaagttccttttaccagggaacacagacaacaccaacttagaatccagcctgagctgcctccctgaagaagacaagcaggaaagttgtacagtatttttcccccttttgaaagctaatcaaccttattttgaaatagtttcagcttgtccaataggcagcattaaagaaaatatttccttttagggctttttaaaagacaaaaagagtattaatttttaatgatttggtaaagaaaaggaaaaggaccttcttaactagaaaaggattagatatttaggctttaaggaagaaacgcaagtgcataatggcatgaaagccccatcctatcacgagaattggcaatcagtgcccaattttggaagaagtaaaggcacaataattggcagccactgcagatatttttgtttgccagctaacatctcatgtatctttcgttaaatggattaaagccagctgctgtacatccaaaaacagaactttttcacacacagaagcagaatggtaatagagatgtttacccagtataaaagagacatgcaccacattcgtgtttatcactaacatttagaaaatgttttttattattaagattaactgagattgacctgtcaggaattttccaatcattaaagtatgaacacaaatacactctaacatgaggcgcagtgggaggtgtccacaaagcccatcggatggtgcccactggcacatgtggaggggtgagcactgctcccatcaggccctgtgcaggcgcagaggaaggtcaagctactgcagccactgacttttcactaaggatccttctagacatccaagttgtccctaaaaataccagcatctccactttcaagggcgtgagggtttacattatattttcactgattcttaaaacttctgttgaggctgctttttagataagttctttttctttttagcttgttccccagttttaaataaatgtagtgtttgcattccctatgtgttctccactccccccagcattcctccaagcccagaatatcccctgtgtgatattctttgctgggaaatccatggacatctttaacatagttgttgaaaaggagaatttcactgacattgtagatgctataggataaactgggcaacattgctaaatattctgctggtataggtcaaacagtcatttcaacagctagagatcatcatccctgtaaattatctgctcttcttccgttccaggtcatctcattccataaagcaaaaaagaagtgaaacagaaaataaccccattgtgtcttatgtcttaaatgtgcttttaaaaaagcagtacagttggaagcacgtacttcatacagcctaaagtggccctctaatattatcaaggaaatcatatcataggtttcactgtcacccttaattggacataattatactgttgccttctgataaacaccaagttttaaattattttaaatatcttttggaaaactgtcataatatggcaaggtcactagcatgttattcttcctaatcgcttattagccttaacacagtgaaagactcccttcttctgaactttacacggcagcccatgctcaggtaactttccactctccagctctttctcagtgttcattgatgatatgttctctgtttcaccatgaaactttggccacactcagccctcagacctcagtctttctcttctcaccctgtgctttcacaacccaagcttcctcctccttaaacctgtcccctcaatgccctcatcaaagtagatgaatcctccatccacccaggtgcttgcgtaagaaactaggtagccagcaacaacattctctctcagttcaagaaactaatagatgttctctcaaacctgtccagactctgccagcttctaactctgccaattagccccatgtacagttctgccctacatcctaatcctctcgcctggatcatgcccatggtccccaaatgactttctgtagccgcccctgttctcctgaatctcctccctggatgccatcctctcacttggctgactaccttcctcaatagtgttgttcacactagcataaaagtttccagaaaccagacattgcatcttgattctactcatcatgtgtagcttgtatgtgtcaggggcacccatccaacacgttctccaagtcatctgcctattcaggtttctttcattcagctaattgcacctttcctggcaccctggccatgtgtgttattcagctcaactctttcggtacatcccttaaagcaatgttattgaataataattgtcgatgatacaccataatataaaacaaacattaaactaatagaatgcatttgagcctgaaaactgcctaccccaccaaaatctcactatttttcatttctttcaccccactcataatggatgaaaaggcaggaggattcagatcacatcttcccgatggtctttgctgcaccttctggtttctagttctaagacttcgtttgattcattggcccttctttttttcctttttgtttttcttttgttgttgttgttgttttaatgtaaaagcattgtatcattcttattaggagcattttttctctttttcaggtataaaaaataatgatgcatcttgtaatctgtggagtattacataataattaaatattgtaaatgcccaggttttaaaattactattatcctactattctaaatactttaatgtactctctttacaacaagtacattttcccataaaattcagtatcattactgtatatcagaaagttaaagatacttccatgatgccatctaaaacccaatcacattcagattattccaattgtcctaagaatatcttacgtagtttgtttctccttaaccagtagtcaattaatttacatgtattgaatttgactataaatggtaatattattaatactgtgtacctgctactcactagaaaaaattattttaataaaaaaatattttataggcattgctgtcgatttcattctcatcctatttttgtcttttgggcctcattttaaaaacaaccttattgaagcatgttttacatatcagaaaattcatctatttcaagtaaaaattcaatgacttttagtaactttaccaagtggaattatttacttaggagggatcaacacctgacctaaagtgggattcagattggtgagggggttcagtatgactgggctctatgccccaatacttggtataatattaagatttcgggtctagacagataggtagagttagagacatagagatgatagagatggagatagagatggagatagagtattagggttctctagaaagacagaactaatagaatatatatatatatatatatatatatatatatatatatatatatatatgagtttattaagaagtattgactcacatgataacaaggtgaagtcccacaataggccgtccgcaagctgaggagcaaggaagccagtcagaatcgcaaaacctcaaaagtagggaagctgacagtgcagacttcagactgtggctcaaggcctgagagcccctggcaaaccactggtgtaagtccaagagtccaaaagctgaagaacttggaaactgatgttcgagggcaggaagcatccagtatgggagaaagatggatgccagaaggctcagcaagtctagcccttccatgttcttctgcctgctttttttgtttgtttgtttttttacggagtcttgctctatcatcaggctggagggcagtggtgcgatcttggatcactgcaaactctgcctcccgggttcaagcaattctcctccctcagcctcccgagtagctaggactcctggcgtgcgccaccatgaccagttaatttttgtatttttcatagaaatggggtttcaccatgttggccatcttctgcctgcttttattctgcagctgattagattgtgccaacccagattgagagtgggtttgcttctcccagaccactgactcaaatgttaatctcctttggcaacaccctcaaacacacacccagaatcaatactttgcatccttcaatccaatcaagttgatactcaatattaaccattagagatagagagagagagagagagagagagagagagatacagatgcagagagatagagatatagaagtacacagttccatctctcgttctcttcagtgcttgactcatttcctttggttatctttattcttaggcagcctctctgaacatagtgacaatctagttatcttatgaacttacaaaacaaagaaaaatccttaattgatcaaaaatgccattatcaaaggtcctgaattggcccaaagtaaacaaagcgtcccttccttaactctaattgtccaaggtagggacaggtgcctattcctggagctggagcagaactggaccaatcaaagaacatggactgggatgcaggaggttggttccaaagggaaaacaggagctattaccagaaaaagaaaaattggatgctggacaggggaaaatggtacccttccactacaatcctctgtatcagagcagacaaacattttctggaaaggtccaagtagtaagtattttaggctttgctgaccatgcagtctgtgtcataactattcaactctgacactacagtgcagaaggagccatagacactatgcaaaggaatgaatacagccatgttccaaaaatactttatttacaaaaacttgcagcaatcccagtttggccgacaagctgtagtttgacaattcttgctctgtgtcatcaacaggactgctatgatctgaatatttgtgtcatcccaaaattcatatgttgaaatcttaacccccaaggtaatggtattagaagatgggggctttgggatgtaattggagccctaataaaagaggtccaaggaagttcatttacccactccactgggaggacacagagaaaaggcaccatccgtccaccagaaagtgggccctcatcaaacatcgaatctgccagtcccttaatctaggaattcccagcctctagactaagaaataaattcctgttgtttataagcttcctggtttgtggtattttgttatagcagcccaaaaggactaagacaagaacccatatccagtgacaagagacatggttgtagctgtctgctagacaatctgccatatgcttttaaatagcgtatcttagccatacggtgttttaaaagccaactcaaagttctccttcaaatattatcaagaaactgaattcccactaatgaccagttactatgaatataataacaatgataaatctcaaattaaaagtattatcagaagctaaagggaattataagaatctttgtttttgtgacgatttaaacacgacaaaaattagatgatattgaaataatctaatatttcattgcaaatattcatacttcactatatctaattaaatttctgacagttgttaaaattgtcaagcatcaatatttcttttatctaggcaaaccacatttttcctgccttactaaataagaaagctaatacttatagagacatatgaacaattttgtccctcacatctaacatttaaaatcaaatttaatagctcatatctctaagacttttataacaaaattatagtagtagagttgttaaactatataaaactctagagttcaaaagttgtataattatgacaataaatacaaattgttcatggtctgttatttgttttttatagcttgaatacatttgcaaacatgatctttctttattacggtttttgtactggcactacttaattatatttttactgtattcatttttcatctcctcctatatctctaaatttaacttttattgtattggtatcataatttaccaaacatgcataatgagcaccattcccaatccacacagtttaattaattcccttccaacatctgtgtcataattatgtcagtgtttccgattacttctgttaaataaaaaactttagacaaattacatttagcagagtttatttgagcaaataactactcataaattgggcagcaccctaaccaagcagaggtccagatagctccatttaggattgtgggttggtcatatttataaacggaaaagggaagtgacatcgggaagcagcttgattggcaatagctccagcatttgccttatatggacatggtctgatcagttggcaggctgtacttggctgaagctcagctgctgtgattagctgaaactcaaatatttgttacaaaaatatactcttcagttagcattttttttacatactcaggttgcagttcactatgtacagaggcagctttacgccaaattcaatttaatttaacacccccagggtgatatcatttggatctgtgtccctacccaaatttcatatcagattataatcctcaatgctggaggtagggcctggtgggaggagactcgatcatgggggcagtttctaattgcttagcaccatcccactaatgctgttctcattactgagttctcacaatagctggttgtttaaaagtgtgtagtgcctcttcacccttcctcttgctctagcataaagacgcctgctcccactttgtcttccaccctgagcaaaactccctgaggcctccccagaagcagatggttccatgttttctgtacagcctgtggaaccatgtacagaaccaatttaaccactcttctttataaattacccattctcaagtattgctttataatagtgcaagaataaactgatacaaaaaattagtactgaggagtggagcattcctaaaaagattcctgaaaatgtggaagtgatgttggaactgggtaacaagcagaagttggaagagagtggagggcacagaagaagacaggaagatgagggaaactttggaacttcctagagacttgttaaattgttgtgaccaaaatgctgttagtgacacagacaatgaagttcaggctgtttaggtatcagatggagatgagaaacttattgggaactggaataaaggtaacttttgttgtggattattcaagagcctggctgcatcgtttccctcctttacagatctgtggaactttgaacttgacagtgataatttagggtatctggtggaagaaatttctaagcagcaaagcattcaagatgtgacctggctgcttctaactgcctgtgctcatatgcataagcaaataaatggcctgaaactggaacttatatttaacaaggaagcagagggtaaatgtttggaaaagttgcagcccagccatgtggcagaaaataaacctgttttcaggggaagaattcaatctagctgcagaaatttgcataagtaaagatgagctgaattttagtagccaagagaatggagagacctcaaacgcatttcagaaatcttggtggcagctcttcccatcatatttccagatggctaggagggaagaatggtttcatgggccatccccagggctctactgacctgtgcagccttgggacattgctcctgacatacagggtgttccagcttcagccttggctaactggagcccaggtacagctagggccactgctccagagtgtgcaaaccataagccttggcagcttctgcatggtgttaagcctgtaggtggatagagtgcaagatgtgaggcttgttagcctctgcccagatttcacaggatgtatggaaaagtctggatattcaggctgaagcctgctgcagggtcattgccctcatggaaaacatctactagggcagtgtaggggtgaaatgtgggattggattccccacaaagagtccccactggggcaccatctagtggagctctgagaagaaggccaccatcctccagactacagaatggtagatccactggctgaagcctgctgcagggtcattgccctcatggaaaacatctactagggcagtctaggggtgaaatgtgggattggattccccacaaagagtccccactggggcaccatctagtggagctctgagaagaaggccaccatcctccagactacagaatggtagatccactggcagcttgtaccctgtgcctggaaaagccataggcattcaatgccagcccaagagaacagccatgggggctgaaccctgcaaagtcacaggggtgtgtgaagctgcccaaggctttgggagcccaccccttacaacagcgtgccctggatgtgggacatgagtcaaagaaggtcattttgaagcattaagatttaatgactgccctgttgggtttaggacttgcacatagcctgtagcccctttcttttggccaatttcccccttttggaatgggagtatttacacaatgcttataccctcattgtattttggaagtaactaccttgtttttttattttacaggctcataggcagaagggactagccttgactaagatgagagtttgtactgtgaacttttgagttaataatggaatgagttaagactttgggggacagttgggaaggcatgattgtatcttgcaacatgagaagaacatgagattttggaggggacaggggcagaatgatatggtttggatctgtgtctccacccaaatctcatgtcaaattgtaatccccagtgttggagatagggtctggtagaaggcaattgggtgctgtttctaatggtttagctatctccctaatgctgttcttgctatagttctcacaatatttggttgtttaaacatgtgtagcacctccctactccttcctcttgctctggccatgtgaagttcctgctcccactttgccttccaccatgagtaaaactctctgaggcctgcaaagaagcagatgtttccaggcttcttgtgcagactgtggaatcatgagccaattacatctcttttctttatcaattacccggacttgcatatctctttatagcagtgcaagaatgcactgaaaaactgggacagaaaatatccctcagaataagggaatttcttatttaggtgacattaaaagacaaaaatgaaagtggcaattttggtaaaatgtgatattgttttcatggaaatagggacaaaataaacactttaatttgcaaacagagtagtgggttctaccagacagataaagtctccagtgaagttaagtaatctggtccaaatcaaacagcttatagtggagtgggtgtgtttgtctcggacctcaggaactacccatccttttataccctgtggtctaatcaacgtgttagttatcagagttgtggaaagttgtttttcctttgtttttattttgtagaactgttgtatgctataattaataccccagagaacatcaacattgtagttatttgtgttttgtgtatttgggtaacttcgtcacccctataaagtgaacactcttgcatgaattctttgctcctgtggaaagcctggtgcagagatgtagagatgttggcatccagtttttcttctggtctttacccaacaaataactgctcaagttggtaagctgttctgaaattcggtgatgtggttaggctttgtttccctacccaaatctcatcttgaattataatccccataatcctcatgtgtcaacggagaaaccaggtggaggtaattgaatcatggggtcatgggggtggttctcatgatagtgagtgagttcttacaagatctgatggttttataggagctcttcctgcttctcttggcacttgtccttcctgcctccttgtgaagaagatgccttgcttccccttcgccattggccatgattgtaagtttcctgaggcctccagggccatgctgaagagtgaattaattaaacctctttcctttataaattacccagtctcaagcagttctttacaggagtataaaaacagactaatacactgtttcttttgtatcccctctgtagattacatatgaaaagttctggataaatagtagttcatttttatttgaaattgtaccttgtatgcagcagataggacaatgtgagtagtgttatgaggtacaaagaagcataagccacagtctttataaacaggaagactgccaatttaattgaagaaattagacacataaacatgatataaacaatgctaccaatcatcataaactaatggtacaatacgtacctctgcacagagttttccaaggtgtgaaacagaaatcccttttgtgggtctacacaatcaaacctgaactcaaaagcaaatctaaaactctggacatagtagatcccacttgagtattctaaatgcagattaggatataaaagtgctgagaaatcctgtggtaaataaatctaattcatataaatcagcaattcccagtatatttgaccacttacccctgttttaatgaagaaaaaacatcataaaacccctagctgagtgttctttagaccatgtttgtaaaatgccaccccagaagctgcaagatgaatgagggcctgatgaatgggcatgatgttcctggggaggcagaatacaatgggagagggcgagaggtaaggcaagaagcagcctttccaagtctgagatgacacagagactgtgggctcttaataggtggagtgactcccacacactcatgtacatcaaaatggcgtcttcaccatggtggttcttcaatgtatgtttgacgaactaacttcacagaattagaaaactgaaattcctatttggagggtagagagtaaaccaaactgagtacagcagagaagcagaactaaggctgggaaggaaagggaaggaaagatcccagaagaagagaaaatcaacacctagggttgggcacggtggctcatgcctgtaatctcagcactttgggaggccgaggctggtggatcacttgaggccaggagttcaagaccagcctagccaacatggcaaaaccccatgtctactaaaaatacaaagtaagccgggcatggggtggcgcatgcgtataatcccagctactcaggaggctgaggcaagagaatcgctagaacccgggaggcagaggttgcagtgagccaagatcgtgccactgcactccagcctgcatgacagaaagagactacacctcaaaaacgaaaaaaagaaaatcaacacctaactgagaataacgtgtgggatctgtgctgcaggtatttcataccctgtctcattgaactctgacaattacctaaggcagagaaggattatatttagagagaaagacagaggtaacaaagaaagggaagaaattctgaacagcaaagaaatagaaatggcaaagcaaaagatggccatggccggccggggctggaatcacatgcaggcaagagtgcaaatgaaggagaggggaagcaacttcctccagaaacattattaccaacgtctaaaaactgatggattttacttttcatagctctaacagactccagatttctgaactattttatcttactattttctataacattaataagaattacacttttaggataattaccatggttattctttccttttaaaaaagatgtattctacttcctattttctgatgctctgataccttcccaggtctctattttcatactttaaaaataatctttagtagttgaatatgttccttagttaattcacctgcagcaccacatttaatgccatctggaaccactaattttattttgtttaaattatccaagtatgctcttacctgaatttcaacagcaggtattttcacaaagtctttattattttataattttccagaatcgtatttctttcctttccagcactttacaaggaataattaaggcactagaagaacagaagccctgtgaaatgtgctactttgagatttctcaattttaacaacaaatgtcagtaagaaatggttgaaacaatagattttcacttgttaattttcttccacatgctcaattaaaagcatcttccaagattattttaaaagctttcattttcaaatcagcaggatactgatttaatctgctttgaaagatatttaataaagcacagtcataaacaattatttcaatatctaatggagcacaggtgggcttataagactggaaagggaagcagcgaggactgtattcataaaggagtgggtcctttccagaatgatctacactagaggatttaaccccatgctctcaggtgctgcccagtcctactgtatttgactccagacaccaggctcccattggaagatcaaccttcacccagtctacaccatccctgactcagaaaaatttaaagagctcaaaaatctagcacttagtgtctaacaattttcacctcaaagtcctctccagtcttgcaacccagtttactacctggcttctgtctttctccttatgcctatgttttgtttaagtcagcttcgcagtaacactggccttctgggactaggatcccatcttgctttgaacatccaccagccgccacagctttcccatcgtctacctcatatctacctgcacctggactctgcctaagactgagctccactgtttaaggatagactttcccaatgtctgctgctttttgatataaacttctacatgtcacttggtttagagtcctcactatgtccttctgcctgcagctaggacatctccctacctcatgtcgtccaccacactggctttttggctgaatttacactcaccaattttcccatcctttgcagtgcatgcactaagtgtacattcacagtccctccagatggccatgccagggatcaaagctcttttggtcctgatctctcacactttcgtttattttagtaacaacctgccaggttgatatagtctgagctctaaaatcatctatgatatctagattaaaatgcaactgacaaggagcagcaaatgaccagccagtgtggtcaccatcataaagaatttagattttcctcttgagaaatcttctccataaaaatattgagcaaagaaaaaaaaaatagaatctgatttttaaatgatgaagaccatacaggcagcaactggtgagtaataggtgctctctgtcttccatgtctttcctctacatttttgtttcaatctcctctagctttcttatcatgaaccacagttaagatattgtttactcaacctcctagctgtaatggaaaagagaaataaaattcagccaaacttgaatactctaggaggtgagaaagaggtgagactagaggcagggaggccaggaggatggctggaaccttgcatttggcaacgaatcaattgatgtaataacaaaagcacaagtaacaaaagaaaaaatagataaattagactttatcaaaactgaaaacttttatgcatcaagggacattttcaagaaaataaaagacaatctacataatagaggaaagtatccacaaatcgtttacctaataagggtctagtatccagaatatataaagaactcgtacaactaaacagtaacaaagacgcaacccaatttaaaataaacaaaggactcatataaacattttttcaaagaaaaagatataaatgtccaatgagcgcataaaaagatgctcactctcattagtaattagggaaatgcaaatcaaaaccacaaagaggtaccagctcatacccactaagatagctatactaaacagaattaattctaattttaatttggaaaacagaaaataacaagtgttgaggatgtggagaaaatggaacattaatatataactgctagaatgtaaaatgattcagcgatgtggaaaagtttggcagttccttacaaagttaagcatagaattctcatatgatccagcaatttcactctgaggtaaagacaccacgccaccctctgccaaaattgaaaacagatacttatacaaatacatgtaggtgcaaattcataacaacagtattcacaatagctaaaagatggaaacagctcaaatgcccatcaacagatgagtggattcacaaactgttgcatataaataaattaaaattgtattcaaagtctaaaataaatgagtcctgatacacgctacaatgtagatgaacctagaaaatactatgttaagtgaaagaagccagacaaaaaagctcccatattgtttacttacatagaaatatccataatagataaagcatatcaataataggtaaatctgcagagacagaatttaccaaggctagaggaaggaagaacaggcagtgactgcttaataggtatggggtttccttttgaggtgatgaaaatgtttctgaactagataaaggtgatgattgtgtaacactgtgactgtagtaaatgccaccgaatttcttactttaaaaaggttaagtttatgtccatttcatttcaaatagaaagaaaataacacaattttcctcatttctattattgatctgagtctccatttctatttggtgattaaaatattagataccctcaacagccgtttgtggtttcaagctcgatgtcttgtgataaatagtcttttcaggattttcaggttgatctttatttaaaccatcattctttcagtgatccctccactttttcctattttagggatggttctcaccatattaatatggtgtgactggggggtgcgggcagggtggctatggttgcttcttccctggttatcatctaacatcattcgtttttgaaattataagtagtctatcctccctgcttggataatgtgtgctgattaccctgctggatgatgatgggccattaactggttctgagaggtcccagaagcacctctgttcttacacccagctgaatggctgcccacagccttagctgggaggaggccctcacctcaaacacttacaaccctggttgggcactcagagacatttggttattgtacatgctacccttgggcatgcaggaaaagtcagggccatgtctgtgtccttctagatgctggaaacaccagggtgttatcactcttgccctaccctcctgctttggccagtggagaaaccttcagggctgctgctttcaatggtggatccacagttatgttagtcaggattctccagacagacagaacgtgtgtgtgtgtgtgtgtatgtgtatgtgtctgtgtgtaacacagagagagagagagagactgattttgagaaattggctcaaaactgtgggtgctgacaagtttaaaatctgtagagtaagctggcaaactggagatttaggtaagagtggattttacagtctttattccaaaggctagaaattcaggtagaatttctctttggtagtctagaggtaggatcccttcttcttcgacaaattttagcctttgcgtttaaggttttcaactaaataggtgatgcctactcacattgtggagaatgatacggttttacttaaagtcaaatgattataaatgttaatcatatctaaaacacacttttacagcaacattcagatgggtggtagaccaaataactgggtaccatgtcccgccaaattgaaatataaaattaaatatcacagccacatagagggaacctgggtcctgacctatgagtcttccaagccagctctggacagtccacctgtgggcatttgtatgagggagaatgcaattctgctttattgtgcccattattttttcctgttacatttttttttttttgcctgaattctaatggatgtctactcccttatccttgttacagtaattggatacagcatcctgcctctcttctcctgggaaatctaaggggctagagaaagagaagtgactcctagttcccctttcatctccaaaatgtgtcatgcaaaactcttttctctctctgacagcctggagttcattggtataatatttagcatgtggtctgaaaagcctcttctagttcaccagttgtctccagtcttcttggtctgccatgggcagagtgtgtcatctgagcttcaccgggatgtgctggttgtgaggaaggaagaggaaactgcacgtttttgtctcaggtgttcgggccaatgctctccaggccatcctgcctcactctgttccatgccagccacattcacagatggagggactcagtaacgtgattccaaactcctagaggagcaaatttgttaccccatatggagttcttgcctgctcctggtccatgttattctccacaatgtgagtaggcatcatctatttagttgaaccaggatcagttcttgcctgcagctgagacaggaaggaaggggatacatggccccctccacagggagatgcaattttagatccctcgtgcatgtgcagacataaatcgcctttctaaaatgacataccggtgtgcatgtgagggcacgcgcatgtaagtttgcaggtaacaggaactagacaactgtttgacactttctgaagaccagaaaatgacttactgggaattattgagaatgaaattagaaatgtgaacagcaggtttgtactcataaaataatatgctatgtaaggatttcttataactatttttgctaatccttagtcaattttccgggagaatagagatgaggatgattcttccttctttccttgcatattctctgtacccactcctcccttaccctgtatgtctgctcctgatatcagcattctgattacttgctcctccaaagtattaacctcacttcatccacttgatcaaagaatagtcctggtaaaaagttatttaactcagacgctgttgcctccccgcatcacgttctctgcaaagtgctggctgccactttactagtcaacagaaatgactgtgcatggctgtagttctttgctctgagccagtattttctgccaaactagcagctttctatgccagtatcaatcttctctacttcatagtgatgggagaaggatataaacctcttttttgtgggaagacttactgctaattgcagtggtaatggaaaaattgtcctactcccacccattgaatatgtttcatcatccttttaatttcaaattgtatattgagaaggggagtttctgtatctgtaaaagtcacatagtgagatgtttaactcttcatttattaacttaatagaggatcttatgcagtttctatagtttgcatgtttgttccacaaacctcatgttgaaatttgatccccaatgttggaagtgaggcctaatgagagttgtctaggttatgagggtgagtccctcatgagtagatgaacgccctctctttggggtgactgagttctcgctctcttagtttctgagagttggatgttgaaaggagcctggcacctctcccctgacctttgctgcctctccctccatgtggtctctgcacatgccagctccccttctcctcccaccatgagtggaagcttcctgaggcctcgccagaagccaagcagatgctggtgccatgcttcctgtacagcctgcagaaccatgagccaaataaactttttttctttataattcacccagtctcaggtatttccttataggaacacaagtggactaagacaacagtcttccctaagcttcacagggatgcagagtcaagggctctctttagtagcaaggaccttattaaaataattttcccctcattttaaattgagtgtattatcgattatatatgatcattttctaatgaataaatgagaccaactatagccagcatccaaactccaccacaggcccctttagcaactgaaggcaccaagggctctttgtctgtcagcgccacctgtggtggcctcatcactcttggtttcttgccagcatagctgccacatttttgcattaagtatcagtcatggtcctggctgcagacagaagatccactcaaatgggattactaaagtttgataaagggaccttttataaaactgtgtggaagttaaaggaagccagcaagggatggtgaggcaccctgtgacttacaacagtggaagcctttgtcactccggacctgatgcagggaagtgattatcaggaccctgagagagccttgtgcctctaagagacagctatggagacaggctgtgatgccctccatgaccctgcatggaggggccagagagggaaatgaacactgggaccttgggctccagtctcctcctggtgggtctcatcagccaagcccagagtgcctcgcagggtgccatggatctggtctatgcagatcggcctcctgaggctcaaagcagggcacagaaggagtagagagtgcctcaggagcagcaaacagaaatgctgggtgtggatgagggatggccatttcagccaggtctctgagtcttcctgccctgccctgctgtctggatgattcccaggctcatttatagcctctcatccatatcataatgaccatgctccatgatgaccaaatccctcctcacaggaaaaaactagtggggagaaaagatcaaagccaatagggtctgctcattcttgttgctcctttaaagagttgctaagggtgcctaaagatctgaaactgactcttggtcatggttacatacccaactgccaattctggtgtgttcagtgactattatacagtcaccaactgtttattgagataatacatgaaagaataaataaaaatggtcttttctccccaaagtagcttcatctacagtaactatatgtcttagaacttctataacatcctcatttcaaatattcttacccagtgttcccctataattacagttatatttgatagaccaattgccctggttgtcagctctgaatacatagtcactgtagctatccagatctggttttagcatgccaaatataggtgctgagggcagaaatggcaactgatagattgcagagttcatgtactggagttatcaatatccttgctcaatggcacattgtaatacaccagccctgaaaccaattttgtgtgtttaaatgaaagtacaaaaatcaattactagagaaggattatttttgtattgcaacctcttgccttccagagtaattcaaaaatcattatagaccaacatattcagagaaacacacttttttacctctttcctgacagattttctcttacaaaaaagggagaacatgacaacctgtttattgaaaggtaaggaaagtctttgttttactgttatttctacttgaatccacagtgattctctacttcaatcattacaaactaagttgtcaaatatagtcagtttaaaagataaggagaaactagcatcctcatgcagactgttataaaaccatttttgttttattcgtcacattagcattctattgccctttaaatgccacaagttcaagagcacagctgtataaatcctgaaaatatttcttctcattaaaataaaacatgaggatacaatttcctaggacatagatgacagagaaacggcaaaataagaatcaaaacaagttgggtacgattacacataagaggctgggtgattttccaatcaaagctttgtcactgttctatcactaagctaatcaggaaagggtttaatttgtttgttagcacctgctacttttcttttatcatataaaccataattagaaaaatggaatttattcactgaggtgtgttgaaatagaagttgtgccacttcattctaaaggaaggattcacgtcataatgtatatgctattcttctttcagaagtgcttgctacctgtgaacaaactggatatcatttccaaagctacattatcatagttacagaggagtgtgcatttaccaaatcaccactacctcaaaactcacagtaagctaaagcaatcacagtagattgatctaaaaattagaataggaaaagagcaaagaataaatgaattctgatttttgtcaatgtctcatatccatgttttagaccatgtaacataagggataaaatgtaattttcaccaatattctcaatgatttatctccaagaacacacaaaaagaagatttcgtgctttatcctactctccttatcacaaatcttggcattttctgcagttttaaattcttacttcatctttcttttttcatctatatccaggtcctttgaacgcgccttccaaaatccttctttaaactttcttctttcatttttcccatttctcatgactgttctggtttgttacatatccaacttacctccagccttccagctcttttccctgtcttctaatccctccctattttttctgctgcactgtgatcaaaattagctctatgacatgtaaatgcaggtatgtgtttctcttgataaatcatactccacttctcactcttgtctataacagtgattcccagtgagaaaatctattatataataaatttaattatatattatatattaattatatattatgtattaataatgtataattatatataatatatgatatataacattatatattaatgttaaatattatattataaatataaatatattaatattacataatatataataaaatgtataattgatatattaattatatatcatatgctatatattaataatgtacaattaatatctatattatatatttagatatcggtctactgttttcttgtctgtctgggtttgatatttgatatcagggtaataactagccttatagaatgaattgcgaagtatttcctctttttctattttttgggtagcttttgaaagatatgtattaaatttgctttaaatgtttgtggaattcaccactaaaactaactagggctgagtttttccttgttgtaagattcttttttttttttttttttttttctgagacagggtctcactctcttgcccaggctgggctcaagcaatccacccatctcagcctcccaaagtgctacgattacaggtgtgagcctccgtgctcagcctgttgtgacatttttatttaccaattcaatctccttgcttattatagatctcgtctcattatcaatttctttttgagtcagttttggtagttttcatcctactgagaatcagttaatttcatgtaatctatctaatttgttagcatactttgttcctagtactactcccttataatctttcttatttctggaaggtcagtagtgatgtcccatcattcattcctgattttagtaatttgagtattttctcttactttctacaccagcctagctaaatgtcattaatcttgttggagaaaaaaatagttaaaatgaaaaataacgtatttatgtagtcttctgtatttacctgcctttttgtttttgttttttttttttcttttgagacggagtctcgctccgtcgcccaggctggagtgcagtggcgccatctccattcactgcaagctccgcctcccggttacctaagtatttacctttactagtgtagtgctctttgtttatgtggatttgaattactgttttgtatcctttaatttcagcctgcaagactccctgcagaatttcttgtagagcaggtttgctagtgacaaattttctctgtttttatttttctgggtattacttaatttcttcttgttttttcaaaacagttttgctgaatctagaatttttagtagactgtctttttctttttgcactttgactatgtaaacccactgccttatgccttccagggtttctagtcatttttctcttgatactttcaagggttttttttttttttctttgtctttgactattgacagattggctatgatatgtcaaagtctggatctctgagtttatttcactgagagtttattgtacttgatttgttctacttagaatttgagtgtgtaggttaatattcttcaacaaatttgagaattttttagatgttgtttttattaagtactctttcggactctttatcttcctcatattactagaattcctattatgcatacgctgatatacttggtggtgtcccacaaggctctgaagctctgtttatctttcttcactcttttttctttacattcctcagactgtgtaatctctattgacagatctctgagttcaccagttttctcctgctagttcaaatctgttgctcagcccatctagtgttgttttcatttcagttatttacttttcctctccaaaatttctatttggttcttttttgtatatgtaatttccatctctttatcactattttccacttggtgagacgttattatcacactttctttaattctttacatattctttatctactaatctgagaccccttaaggacatttttctgttgactgcttttttactgctaatgtggcaaaattttgtttcttctcatatctcaaacttttttgttggaacctggacattttagttaatatattgtgacaatactggtattagattccttcacacatatgcacacacctaagatctgtttccattgctggttttatttttcttgctgcagcttgcttgttagctactttcctatactaagtctgtaggttctatatattgaaatatgcggcagttgaattctctgcttacccttttcaaaaaatatacttgttcttatttttaacactagcttcctaggaatcacacctggatcactataatttagtgggcaaccaatgatggttggaagacttccttttgtgttgcctgtatgtcttctactctttgccagtggatgtgtatgggaaggcatgcctgcaaacttcaggcagtttgcaagacagccttagcttttacatcctgccaagcataacctcagtcagccagaggtgaatgactgggacctgctcctttccagtgtctttcctggtaatgccccaactcatgctcacacatccctgcccatgcatgcagccttttaagtcacagagaatatttcagagtgtttcacggttccttgttagtgtctaggtttcctttaaaaagccctcccaggggcttctttgccttcactgaaatcacaggcttacacaactgagatattgccagcagtttgctattattttggtggtgaccaataagattaaccatttagacaaaattagaaaatgtctaaaaaagcaaaacttttcaggacatattcaaataaaaatagaaaacctgaatagcactattaaaattaaagtaagtaaacacacaattaaaactttctcaaaacaaaaactctggttccagagagcattgccaatgaattcttcaaatttttaaggaagaaataaggacaatctcatacaaagtcttctgaagaatagtaaaaaaaatctgaatcttgacaacaaaacctaagaacattacaagaaaggaaactaagatcaatatcactcatgaacatagatgcaaaattctaaacaacatattagcaaatcgaatcaagcagaaaataaaaagagtaatacatcgagatatatcgaaatgattctaaaagcaaggtcattttaatattgagaatcaatgtaattcatcaaatcaataaaataggtaggggaatttataaaattaaatcaatacactcagaaaacatttttataatatacctatgataaaaatctttcagcaaactagcaatagaaagtgataatctgataaagagtctaaaaatacgtcagcaaaacacattcaatagcaaaatgttgagaggtttccctctgatgtggaatatgttaaaggttacctaccaacaaaattatatacaaatcttagacaatggagtaatggaaggaacagaaatgaaattatatgaataaaaatatcttctacattgagttttttaaatttgactatgatgtatctagatctacatctctttgattttgttctattagagttcattcatagagattgaatctgtagaattcaaattaaacttgtggaagtaaatctaaaattatttacaagaagtataactatgtattggaaaattcaaaagaacctatgaataatgtattagaattaataagtatgtttagtaaggaacctatctaggaactttgctacaaatataaaaatataaaagtaaaaatgccaaatttaaaaacatttttcataccagcaacaaacaataacaaaatgtgaaaaggtacctattcccttttactttcttttccttcctagacaattcagtactaaagccgtcatgtatggcagagcaacattgctgtctgcttggggaaggggtggcttggtgcggaatctgggaaccagagcagcaggaggaagaaagagacccataggaagcatccaccatgtggcctcaggcctctgcagaggaggaggcctggtgggcggctcagagtacaagcaaggtgcagagggtgtccaagcattgtggtgacataaagtgggacatcagagcccaggtgtagtaaacaggttaagcagagaagccaggcagacagataggctggcccatgggacccgaacctgcagggaccctaaataggatgaggaaggcacctatgcaaagggtaaagggtgctgggcagaataggatattagttacagctggggatggaccaaataagtaaatcaattcaaaagaatggcagtgggttttgtaatgtcgcaaaatgaatgaacaaatatggaaaaagagaagaaagctaaaataacactgtaatgttggatcagaattagaaatgtcagtgcatactaatatatttcaatctataaagatagagatgtgcgcacacacatatatacatacatgcataaataaacttctacatattccctaactttgcccattgcaggcctaggagtggccatattcccagtggtgcacagatcttacattatcaatatacattttaatactattaatatacattttaatactattatctacaaaaaggaatgatggatccttggataaagtgctgattcttaggtcggtgcaggagaagtaaaaaatgtcccatgaatatcttgttatgtactcttgaaagcaaaaaggctctcaaacaatgaatgtatcgaaagaaccattttgaaggtatacctgttggccaaattgaggacaatttgagcatcaaaataaattaaataagtaaatggaattctaatccactaggtaaaagagaaaactatgaatcttcaatgatgtgcatctctaaatacatacagacaagatatttacctcatttgaaaatacctccccatagaaaacactcattaattactaagggaaaaaagaataacttcacagtggataagcctggcagacaccacattcatcaagtaatcaaggcagtaatcattagtaatagaacaaatcaaaattgcaagcctcctgatagaatacaaaagaacaacagagcatcactacagttttatttctgatgaaatacgaatcctgaatccatttctgaagaaatatcagacaaatcccaatgaggaacattctacaaaaccactgggccatgatccacaaaagtgccaagttaatgaaagtcaataactaaggatctctttctgacaactgaatgcgacatgtaaatctcagctcgattactttgctgtaggatgttattgggagaactagacacgtaaataggatctgaggactaaatattattactatgccaatgttagttttctgattttgatagctgtaggagattttgtgtttatgtaggagaacatcattgttcacaggaaatgaacactgaactatttaggggtaatgggacatcaggtaagcaaactactttcataagattctgagaataaaatatctttctttcgaacttttctataactttattattgattcaaatgttttaaaaaatgaacaaaataccaaaatagcattttaaaataatgtgtatttctattaaaaatgggcaagacaccgtcatgttaatcacatgtcaattttctatacagaaaaatatataacatcaataaaataaatggaaatggaaatatatgcaatgatgttagttctttcccatattgttaggtagataacatgaagccctaatagagtttccagaaaattaatattttggtggaaattcacaagttgtttccagaatgtatataaatgaaaatggccaacattaagataagctactgggttttgagaagtttacaaagtcatagtaattaagagaacacgttattgatacaaggatagatagaaatagaacagaacagggtaagaggccagaaatagagcctcttataagtggacacttttattacaacaaagtttgtaccacagagcagtagagaaggagcagtgttttcaaaaaattatgcctggtcaactggatatccacttggggaaaagcaaaatgactcctggcttaccaccaagcaatctgtaccttgtgcattgccaatctaaatgtgagaggaaaacccttcttacagagccccttgagcagtgttgcctgatagaatttgtgtggtgatggaaatgcttcacatctgcaccctccacgagggtagccacagccatatattggttttgagcatgtgaaatatggctagtgtaactcaaccactgaatttttactttatttttattttacctcatttatgtttaaatatccacatgtggctagtggctgctatattaaacagtacagttctagataataatggaagagaatatctttatgtccttggggtaggcagatatttcttgatagaacacaaaagcgttttccataaaggaaaaaactggcaaataagaacttcttctcattagaaaacatcaagaaactgaacgtaaaccaacacgtaggagttattgcaacacacatagctaacaagttctcagtcctgaatcaatcccataatcattagaaacttactaaagaaaatgagtgtggaattaatggacaaatggcttgaacaagcacttcacaaaaaggatagccaatgaagtagtgctttatatcagtgtcatcagggcacttctaattgaaaccaccattaaatatcactacacacccaccagaaaggctaaaatttgtaagactcacaggacatggggcagggttgtggagggacagtcgcactccagtggtggtaaatcggaacccactttataaaacaggtattatccactaaaattaaatgtatgcaagccttatgaacagcaattccactctaatggatatgtccaatgtaaacgcatgcacatgtgtgccaagagtcttcagcaagatgtgtagaatgttcctcaacttgggtttagctgatattttctcatgataaaaaaaaatcatggtatgtggtaataaactgtgaaatacaatgagtattacaaagtaatgaaaaaaaaatcactgcatacaaaaacctgaataaaacctgcaaacataatattcagtgacagaacaggatacaaaggatacattcaaatggttcctttggtgtcatcttcaaaacaggtggtacctgcccatcatagtcaaggagggtaggctgtaactatgagaggaccggaaggggcctccaaggtgagcagagtgtgcagtttcaggcccgggtagtggatacctgggtttcctcccacgtgatcattcattcggatgcatgcttatgattgcttactgccttttggttggttacagggcaatacaaattgtaacatcattactgtaaattcctaatcatatatttataacatttacatgctgtgtgatttcttcccataagccagctatcctaagcctagttttatgacattgctactcctgccagttttttcaagagcatggttgaatgtttccatgatcctcaaaattaaatttgttcttttgaaataaaaaaataaacttggtattatgatttcagtgacactgagaatattacaacattccataataattcattcttttattttttttccacagagaatttgactctgcatcccctaaaatagtggtaggcactgctttaaaagaatgaaatggcttattctgtcaaatggtgatcgaacccattttaactttgcaggatgaattttatggtgctgacaacttttataaatgatttctgggctaaaatattgaattagtattattatccttcagtgcgtcattagatgtttaatgaatgtttttaacacagataacaatggacactgttatcctggtagacatataaaagaaaccattatctcaccactttaatgtccttctttgctttagttctcttaaaatccttccaaaagaaaaatgtgtctacctctcttcattcttcatgcctctccggggcttgcattagttgctaattgcagtttcatgttttatctcttttggtccacagggatcacagacctttttgtgacttcttctctgtaataccagccataacttgttatttattttcaacatatataatgtgccaccactgccaagggaaactttctcttagatgaaaaaatttccataaaaatggatgtttgcattttaattgtaggtgatatggctactcttattcttatctatgccagagctagaaaataaaagcaacaaaataaaaatgcgataggaaaaggctaaaccacagctcatacacactctctcctggtgtaagctgcaataactgaccgcagcatgagacattagcagtgagttagatcaaaatgatattttttctaacattaatagctcagagtagccctcatataaaatccaaagacttgagtgttttttgaattatgatttctctggaaaactttgccttaaatttcatttgtggcattttgaaatatattccaatgaaacctggaaagaattgtattttccacacactttcgcaccttcctagtctttctcattccctcttgctatacaacctccctcttgcttacaaaatggactctttttttttttttacaaattgggtatttctggtctatcagaacaacagatttaaaaaaatgaaaagatatttccactaaacagcccactgctgatacagtatagagagttttgtcatacttcagaaacctcacaaaagaattacctgtttctcttgcagaaactaattgcgtccttttggtagagtttcaacttcctggaatagcaagaaaaccgacaaatcactccttggcagaattgttcctacattgtgccatctgatacaatccattaatgccattggagagctgtcacaaccagcacttatgatgtgcgtgtgtgtgttttctttatattttagaggaaaataagaaaaggaatttctcctcttctaattagtaaaaaataaacaatattttctttgaatattcttcaaacttttttccatcattggaactaaagaagtaggaaaaaatgtgtatttcttgtagctttttttttttttttttttttttttgagacggagtctctctctgtcgcccaggctggagtgcagtgcagtggcgcgatctcagctcactgcaggctccgcctcaagggttcaggccattctcctgcctcagcctcctgagtagctgggactacaggcgcccgttgccacactcggctatttttttttttttttttgtatttttagtagaaacggggtttcaccgtgttagccaggatggtctcaatctcctgacctcgtgatccacccgcctcggcctcccaaagtgctgggattacaggcgtgagccaccgcgcctggtcttcttgtagcattttttaatggagacactggaatcattgtgatttctacagtgcactaagctgaagcttttaacgcaccactctaaacagaaactttatatttttgctttttttcttctgccatgtcttcacctctctgaattttcatacttggtaaagttgaagaagaaaaaggaaaagtaattgcacctcgaagtttacctctttgctgaatttctttagttattatttcagctatttgtgctttgaaagagttttcctcccacatgaaatgacttttccatctgcctgaacttctggagataaaaagtgaaaaaagtgccacagatttcatatcagaactgtagtgtggggcctgtgaggctcacgtgtgtaggaaataatgaggcttcttttgttttgtttttgtttttgttgctgctgctttcgcacagttgaatccaagtagaaaatagagataaaaaaggaaatgcaagtcaaaggtaattgggggttcactttgtgtcatgagatatttgttagcccttttccaaagctgatgtaattgttaggtttttacctgtctgtttagtaaaaagacacaaaaatagttgaaataacaataaattaacatcgatttaaaatccgggtccttcagttggaaattcagaaagattccctaggactccttatttattaaagatttttaaaatttaaaagtctagccattaatctttctgaacatgacacttttcagccatgtcagatttttcaggctgccactaaagaaatcaaacaagggtcagaacacagtaaacacagaaactgtgaaagaagaaaacctatgcgtcgcaatagagaatatcgaaaagctacagcacctgttttccagctgggacttagttttgcaatctgaattttatcaacaagcccagccatatccaggctgccaacagagatcttctgaaagcagaaagaaaccaaagtctgcatgggaataatctcaagctctaaaatgaaatcttaaactctatcaagacattttagcctctgagtttgttttttttattttgtgtttgagaaacaagaccatgcatttctccttacagatgaaattaggcatggctgacctcagtgggtagcaactgtgcccttcttatcaaaaaaactacatgtgccaggcactagcaggcaagaggctgctcactgtcatctggtagatgatgggatggaaagaacacgtctgatttgaaagccaggctgatatgccagtgcctcagcaattatcatgcccatctgctccttagcttccaagcttctgtgcctacacctatgctgagagagagagagagaaacaaacacagagagagagacagagagagagagagagacccttcaggcatctcactggcatttagcatacaggaaatttaaagctttggatataccttatatgaaatcaactggggaaggcccttttaaaaagcatgactccttaatagataattaacttaatgcatatatttcattgtccctgagcacttcatatactggtgatctcagctctgcgaaatatacttatttggcatattcagaagaaatttcaataattgctcagctatcttttttcctgtgcttatcaaattgtacatgatagctattatctgaacctattctagctcatgactatgtatatggatatgatacagaaaattcaccagccaaaattattcaggaaaacatccttgggaaattacccaagtttattcaatagaaactaataatgcattcgaacagtttttgaaatgcataatatttataaagaactaaatatgtatatattacatatatgagtcagtcattctaatcagtagctaattcacatatgtattgagcatttattttgtgcaagaccctgtgaaaaatatactagacataaaatataagtaaaacttgcttcctgccttcaaggaactcacattttagcaggaaagataaagaaaatgcattaacaaccctaaagcatgatagaatatagtaagatcaaggagtatgatgagtgtatggtgaattataagtggaaaacctattctgaatcatgctttaggttggcactccaaaggctatggtcaggcatgttaaagggtccaatgatgcaaaaagaaaggaaacctaagaatttatcactgctactcaaaaggaatttcccagtcggatagatgaatggagattgtacttagctagtaatagaaacccttactagccttcctttaaaatgcaaagaataggttcatttcatgtaacaagtttaatatttttctaatttcttaattatgtttaattaacatttttatggccatttgaacaaaactagagaaagtggtaaaatgaacctatatcccaattttttaaatgtctaagacttttacctcaattctttcaatacactgtctactgtggttttggaaagggagcaaatccagactattttaaagcaaattcagacaacatgtcattttaactgtttgaaatgtgtgatggcattgggttgtttttcctgttgactttcccactgttatgaactgaactgtgtacccacaaaattatatatgcatgccctaacccccagtaccttagaatgtgactgcatttggagataaggctcgagtgggtaattaagtttaaatagacagatgataaggatggcggcttaaactaacatgagtgatgtccttataagaaaatggagatactccagggatgcccagataaaaggccatgtaaggacgcacagagaaggtggccacctgcaatcccaggagagaaatctcaggagaaaccaagcctgctggcaccttgatcttgatcttggacttccagcctccagaatgtaagacaataaatgtctgtgttttaaagttatccatcctgtggtattttgttatggcagccctggtatatgaatacccctacattctggatatgacatgtttctctgtgtcctgtattttctgctaactgattgtggaagatgctgaagtgacctccaagtgcagtgatcaccccggctgccatgagtaatggttgacaaaggctcgtggttgtccccttttctggagaaccacccagaacctgtagaagaacccacttcacacctgttgccctaaagccaatgactgcctgacttgggggcataaaacactggcccatttgacccatgggtggagtgaaggcaagtctctggtgtgatccaatccccagagcaccgtgtgtccagccaaggtgcggctgtggttgagagtggctcactcagctcttgcccctgccctgtcttgcttcacaacctcaactttttcctgaagagcagcctctcaataaggcacatgcactgtgtactttattaggaactgcactcaaatgcagctggtgacagtggaagtcctaagacaaaactcccaggctgcaattttagactcagatcctggacagacctggaagtaaggaagtgtctgtgcctggcagtagctggagcatggacagcacctagcaagcacccctgtaattattcaggtttcacctgttatcatctggaggccgatccacacagaaggtgtttaccaggaactattcacacacctgctcttggagtttctcttgtcttaaaaaaatatatggggaaatgaaattatgaggagtgagggtttgagtggatattgctaagagctgtggattacttaaaaagagtaagccacagggtcagaatattaattacaatttacagcataatgtgtaggtcagtaaatttccttgatagtatttaaatagatgatcactcctgcagccagaggcaaacagagataaaaaccaagcagagaacctaattttaacaatggaaaaactccaagggaggctacactagtggtctttgatggcttctgtgctttctggcacaaaaaagtttccaaagcttatactgcccatagacctagaatcagccattgctctaaggagccctcatctctttcagtggaaaatggtatttcacatcttcaatctggatttaaggctactctgaatttggatgggagtgtaagtccaatggtcagacaaaattagttattttttttaaaaaagtattgcttgttaatgcagaaggggaagcaaacacatcctttttcacatggtagcagcaaggagaagtgccaagcacaaggggaaaagccccctataaaaacatcagatctcatgagaactcactcactatcatgagaacagcatgagggtaatagccaccatgattaaattacctcccaccgggtccttcccacaacacgtggggattatggcaactacaattcaagataagatttggatggtgacacagccaaaccttatcattccaccctgggcccctcccaaatctcatgccctcacattttaaaacacaatcatgccttcaacagtcccccaaagtcttagctcattccagcattaacccaaaagtccaacagcaaagtgtcatctgagacaaggcaaccccttccgcctataagtctgtaaaatcaaaagcaagttcattagttcctagatacaatgtggatacaggcattgggtaaatatacctgttccaaatgggagaaattggccaaaacacaggtgctataggccccatacaagttcacaatccaatagggcagtcattaaaccttaaagttccaaaatgatctcatttgactccacgtctcatatccagggcatgatgatggaagaaggggctcccatgatcttgggcaactctgcccctgtggctttgcagggtacagcctccttcctggctgctttcatgggctggcattgtgtgtctgtggcttttccagatgcacagtgcaagctgtcagtggatctactgttctgtggtttggaggatgatggccctcttttcacagctccactaggcagtgccccagtggggaccctgtgtcggctctgaccccacatttcccttccacgttactctagcagaagttctccatgagggctctgcccctgcagcaaacttctgcctggacattcaggcatttccatacatcttctgaaatctagagggaggttcctaaaacctcaattcttgacttctgtgcacccacagactcaacaccacatgcaagctgccaaggcttggggctcacatcatctgaagcaatggttggaactgtacattggccacttttagccacagcaagaggtgaagcagcttggacagaggccatcatgccctaaggctgcatagagcaggggggccctggacccagcgcattgaatcatttttccctcctaggcctccaggcctgtgattggaggggctgccatgaagctctctgacatgccctggagacattttccccattgttttggtgattaacactctgctccttgttacttatgcaaatttctgcagcaggcttgaatttctccccagaaaaagggtttttctttttttatcatattttcaggctgcaaatttcctgaacttttattatctgcatcctcttgaatgctttttcacttagaaatttctcctgtgagataccctaaataatctctcttgagttcaatgttccacagatatctagggcagaggcaaaatgccaccagtctctttgcatagcaagagtgacctgtactccagttccaaagttcctcatctccatctgggaccatctcagtctggacttcgttgtccatatcactatcagcattttggtcaaagccattcaaggaagttgaagttccagactttcccacgttttccaaatgtgtaattccaaattttcccacattttcctatctttttctgagccctctgaactgttccaacttctgcttattactcagttccaaggtcatttccatatttttgtgtatctttacagcagcactccactctttgctgtaccaatttactgtactagtccattctcatgttgctatgaagagataccagagactgggtaatttataaagaaaagagatttaattgactcacagttccacagagctgggggggcctcaggaaacttacaatcatggcagaaggagaagcaaacacatcatttttcacatggcagcaggaaggagaaatgttgagcaaaagggggaaaagtcccttataaaaccatcagatctcataagaactcactcactatcatgagaacagcatggagttaatcacctgcatgattcaattaccacccaccaggttcctcccactgtacatgggcattctgggaaccacaattcaagatgagatttgggtggatacacagccaaaccatatcagtattaaagtagcatcattggggtaatactcaaggatcgttgtctcacgccaaagaaatcagggacacagacacacaaggagtgaggttaggaacagaggtttaatagtcataagaaagagaaaagctctctcctacagagaggggtcctgagtgagttttctggtccatggcaaatgcaaggagttttatagatgagcttgaggaggcagtgtctgatttacatagggtatgaaagattggtcagtccaggtgtgccatttgcataaggtgtgaaaaactggccacccacaccctaatcttttattatgcagactggttctttacctggccagtgccatgttacctgttcctttactgtgcacatggtgacaaagaaaagggaagatggagactccatgttgaacacacctggcccccatgtagcccttttctattggcacagctaccagcattcacccttgcaagcttccagctttcttatctatgtctgcagcgtgatttttcaggctgctcttgttaaaaaagaaatatttgagaggctgctttttgctaaaagggaaattctgccaaggactcttttaccctcactatctgcctaaatattttttctatttcctgtatcagtatcatatcaaatgacttccaatacctacataaacttaaaagcataattaaattggaaaacccagaaatgtatcccttataaatctttcatcaaatatttaaaactctatgtatccatggcaaatcaatttcaagaattaaataatgaaaggtgcaagagatgcaatgatataaaccaaagtaacaggatggaaaacataggcattctatttacagttcatatgtgataaaatattgtccttaatcaaattctttgttgaccatgtactacttctagtattttctttacaatttgtacaaaaatattcatagtgttcaatgtattaaggaccacctcacagtgaaagagaaggaaatataaattataaaactcagtgttgaaagaaaacttagaaatgaactaccatgactgtgtggtccatggtcctaattacacatggggcttactacagaggttacagggagttcacaatattatcccctacacccaactttgcactagaacaacttaaaatcacaatgcatgagaaaaaaatatgtgtattttaaaaacatgacagaacataaaatatgaaagcatatgaaattagttctggtaaaatgcaaatcactattccattggctctgcaaaggtataaaatttataaatattattattaagatagaaaatatccataaagaaaaattaaaggtgtaaacctgtggacgaatgccccactatcacagcggatgtgcccccagtgccaactccttgtaactccactggcaaaaccacattatttatcaagatgccgaagagtttgtctcccaacggtcacctatccttcgcttcaatatttgttgaaccctttatttgttgggtacaactaattctttcttctaatggtctttctcaacatagccccacccaaacctcctcattccccaccccatctctctaccaccagcttagcactgtggacgtaaccatctgccatttcaagatatagacttatttttcttaacaaactttatttttgatcacatgtttaaagtttattcacagttcaatttattcctttttgtgaaaaaaatacataatttgtcaaattaagttgtattaagttatttcttagttacagctctacttagcacttttagtcttcatctttcttttaactataagtaactcacaactctcaatgtgtttatggccagaagtcaagatactttttagatttcttaactaaagctagaagactgacaatgaagttcaatcctggatcaatgtccagcaacatcatataacaggaggaaaaccttgggacactgactccagctaaagtttaaaagacaaaaaccaagactttaatatcctaaaattaaagtaatgacactcaatttaaggacacaacttagtagacatgggtgggttgactatgtgtgtgtgtacatgtgtgtatgtgtgtgtacatgtgtgtatgtgtgtgtgtacctgtgtgtatgcatgtgtgtatatgtacttatgagacaaaagtactcaaaatgtacaaaaatatctatgtacgcaactggatttctgttgtagataatgatcaaatattgatgtaggaaagagctattaataaattattgatttagatgagtaagtttattgtatgtgggtttatttcaaggtgaattttcttaggatttaatttcctaatgagaggcgtaagacattcaagcaatagctggatttcacacttattaagaaatccaatgtgtataaaatgcatatataataaattatacatactaacagatgctaatgagagaaaccaacacacctgttgtgtaaacaaacaatttgcattaggaaatgaacctctgtgaaacatctgtactgggtgggtgattgagcaaaggaacagaaaaattcacatgattttattgctcctggtttcatcactctattctgaattcctgatgctttttctagcttaagcttattcatcaaagatttgataaggtcctactatatgctttactgtattaagtgctttgaggaaaatccatatgaaaattaggtcccttccctcaagaagacttctacaagttgcaataatccaaggcaaatgcaatatgtgatacagtggaagtacgtacaaaatactaagaatataaatgcagagagagtgatatcaaaggcattctatgaagcttaatataggcagattcactgtgatagggggattaaggagggtttccagaaagattttacgtggagtgagttcttcaagctcagacaggattggaggaaaggatactgcagataaaaaggcagaaagagcaaaattatagatcatgtttagggaatgaaaaatgttgcagtattacaggcttttttatgtttatctgtaccctatatttttttgtcatgaaatatttcgctttctgaatgtgtttagaaactagggactgtggattaaggttttaataaggaatgaaacagcagaggccagactgtgaaagacggcaaaggaaatccgggtaagataatttattttatcatgtaataagataatatcaaagttctcagaacagagagtaattagatcaagcctgcttggaggcagggagaagagaagggagtattgcaagcagcttagacaccatctctgaggtacagcattgctgtcacacagtgagcacgtaaccacatgccaggactgtaccatggaccgccccttaaatcccctcaacagccatgtgtcagcaggactataagcattagcctgcttttcagatggaactgaagcactaaggggatactgaggggtagagagaacaagttatctgttggtctaacatgatgagcatatgtagctcatgccttcaaaacctgtgctgcttccaaggggagataagtgattatgagcatcaaggtctactcaaatattggaccttatgatcttgagtccctctaaattgcctctcaccatatttccattagccacttcaccaacctccagtccatcctcattataacaaaaattacctcagtctctcagtgctgggttgttctccccagcaaacttcccagtggaggcactgctcatcatgccgttgtttggttcacagatccttactgccttgatctttttcccatgccaacccatcaaatccattcccttcaccctctctgaacatgagcccgccactctacgtaaagggctatgaaaatcttcaatgtcctgcagacatcactcaatcaactgttatttcctcagtagtaactgaatgctcaaaactgtgctaaaatagaaaaaagagaaataaaacctaagaggccaggcgtggtggctcatgcctgtagtcctaacactttgggaggccaaggcaggcagatcacttgaggtcgggagttcgagaccagcctgaccaacatggagaaacctggtctctactaaaaatacaaaactagccaggcttggtggtgcatgtctgtaatcccagctactcaggagactgaggcaggaaaatctcttgaacctgggaggtggaggttgcggtgagccgagattgcactccagggcaacaagagtgaaactccgtctcaaaaaacaaacaaacaaacaaacaaccctatggaacagatgttgccttttgaacagttttattccattcattagaaagatagctatgtgtattagtctgttcttgcactgctataaagacatacctgtgactgggtaatttacaatgataagagatttaattgactcactgtactgcaggctgtacaggacgcatggctggggagtcctgaggaaacttttaattatggcagaaaggaaaggggaagcaggcacatcttcacatagctggttgaggaggaagagagggagggaagaggtgccacagacttttaaacagccagatcttgtgataacacaatcactagcagaagaacagcaccaaaaaggaaatctgccccgatgatccaatcacttcccactagtctctacgttcaacattggggattacaatctgacatgagatttagttggggacacagacccaaactatatcactacgtttgtaagatgagcacaagaaggaagacaaatatgtctctgtgtgtgtcttcattcctatgtgagttttaactaccaagcctgttctcaaagccctcttcattcataaatgtctgaacattaacaggatggatatagtgggcaaatgaatattttgaattcctaaataaaagattgtcgatagataaagtcaactccagatagtagattctgcctagccctaagaccaatatggctaggtgctatgaaatgttagagtgaggatagaagatataggtgtgaattgtttaagatggaacatatggaataatctaatggttagagacatcaagagaggcgcttcctaagtgttttctggaaacaaagaaaactttaggagttctctgaagtatatgttctttgcaaaaatatctgtaatgccttgcctgttttaagcgaattaatggtagcctaatatttcacctctcccaaaagagttaactttttttctaagataaacaatgagattaacaatgtgaaaatgtgacgactgggttcagtggctcatgcctgtaatcccaacacttcgggaggccaaggcagacagatccctggagcccaggagttggaaaccagtctgggcaacatggtgaaatcccatctctactaaaaatacaaaaagttagcctggcatggtggcacatgcctgtagacccagctactctggagtgtgaggtgggagaatcacctgagcctaggaagtcgagactgcagtgagccataatctcaccattatactccagcctgagcaacaggagtgagaccctgcctcaaaaaaaaagtttaaaagtctgtcttatatttctgagtgtttatgtggatttaaacttgcttaatcatttcaagccccacttcaaagagcagatactagagctcttcagattcacaggcctatctcacctcttatatgtggaagcactgaagaaggtctcacacaacaatcactcagtagggaagtagaggtcacaaaactaaggacaatctaaagactggcttgttgtttaataagaaacactaaaagaatgtagtattgatatgaaaaacaatgctctcctaatattggctttatcactaagcatctctaatattttcagtacacattttcatatggactttttatagcctttatatttttagaacagttttggtttcacaacaaaattgaaagtataaaattatcctatgtacccccaaatggacttctaaaaagcctaaataaataatttttcagtgtagaattttcataattgagttaaacggaaggtatatcccagtcattattcttagttgcacacaacataatccactccatatgcttttaacagaaatgttttaaagatatgaaagtgggcatagaggttaacgtaaaatagagagttcggaatagagtcaagaaataaactcagacatgtataaaaattttgccaagataaatgaatgtgtaaaagaaagccttttcaacaaatgctgctgaaacatctggagacatgtaaaaagagagagaggaggagaaggaggaagaggaggagaaggaaggggagggagaggaggaggagaaggaggatgaagggaggaagggaagaaagaaagagaagaaaggaaatctcaacttttgcctcactttgtaatctaaagttaaaatgtatcatagaactaaatgtcagacctaaatctacaacgtttttagaaaaaaagataaaaacaatttatgatcatgggctaagaataaatttctaagacaataagcaaaaagcacaacacagatggttgaagatttgctttccacaaattcaaatattttgctctttgacaatcatttaaaaatgaaaaaggcaatctgcatacagaagcaaatactttaaagagataaatatttaaatataaatattatttccaataaatatcttgtatccaaaatatagcatatagagaactcttacaaactcaatgatagaagacaaacaaccaaaccgaaaaaaatggacaaaagattaagaccttttttcaaagaaaatataccagtgcctaataagcacaagctgctccacaccagtagttattaggtaaatgcaaactacaattgcagtgatacaccactacatctgcactacgacggctgaaaataaaaagagtgcctgtgttatatgttggcaaagatatgcagcaactagaactctcatacgttgctcgtggttatactaaacagtacaaccacaaccattttggaaaagagtttgacattttcctgcagtgctaagcattcatttactatactttaaacttatttttacacgaaggctattcatagccacaaaaaagtaaatgacccaaaagtccatcaacaggcaaagggacaaacaaaatgtgataaacccatacagtgcaatattattcaacaataaaaaataaaaacctactaaatagaaagcaacatggaaaaaactcaaaaacattacaatgagataccaccagacaaaatagaatagcaaagtcgtagtgacagaaaagatatcagtagttgccaggggtgagggacatgatgtccctcacccctggcaactactgatatcttttcagtaactgaaaggcacagaagggaacgttcggattggtgaaaatgttctatatcatgattatagtggtagttatatgatcaagaatatctacaaaaactcactgaattgtaactaaaaatttctgaatctttttatattcagaaattctgtaacttctgtaacttacacctcactaaagcttaatttacaaaaacaaaatacaaagaaacacacacacacaaagccaaatccatgatttgaaagaaatttacccatttttcctgaagatcttcacttgaagcaccaaaagaagtatgcattcaaacataaattaaataatgtttttcagcatgttaagaatagttatgatttaatctataatctgagtgtatctagaatttcattgtccagtatagcagccaccagtaccttggggtctacttaaatctaaattaattaacaataaaaagaagtcaaaggtcctcagtcatgccctgcacatgtcaagagttcaatggccactgcagaaaggcctaattggatggcatgaatctaaaatgactctcaaggaaagcccatttttttccagatccaaatggaaaaagaggttaattctccattttttccaggcctataccaaatgtaatagaagcagaagtatgtagaactagcatatgtctaggctacggggtgggaactaaaatctctccacgtttcatatctttagagagagagaagtgattgcttcagaggtttctggttagaacacaggcaggtagtcatggaaagtaaccaattctgccatgcggtctgactagagccctgagatgaaggtctgtggagttgtgagcagagtgaatatgcagggagacgtgaaggcagaaggaagggcaggtttggctggatgcttgcaatcccctcaagcatcaggattcattgtcttcttagtagaatttctccataggcaaaaggtcgattcctttccgtttatctctctttctttttaaactatgtgcctaagaactatgacatgctcctaccagagaaatgtgtttactgattctcaattcaatgagttcatggataggaatgctaattatatgaaaataacgtatctcatatggactgtccttggattaaacataaaagcaggcgccagtttgtaataatccttccctttgggacttctaatagtttctactatgtatttctgaagtaaactttatgtacagtgatgatttgaatgttaatgtcttgcccttttatagaatctgttttctaaatttctcatgatgtaaagactgaatattcacatatttttcatttccgaatgttggagctttttctaaaaattgttcaatagttataatgcagttttctgctttaaagagacatataagattattattgtggagaaattctgtgaaacaatggtatgttattgggaaatttttaaattaaatattttattcattttacttcccatgcattcaaatttcaagtggcgcttcttataagtcctcccatcatttatgagatgaagctgccgctgggaaggctgacatttctcaagggttatttatcaagccgttgggtgtgttttccatttttattgctggtcatgctctaatgcctctgtagaagagatagcgaaattgaaattggatgcatcctatctctccagccagctgagagctggcaacctggaaaaaaattgtagtatgtagctctccctcttttaaagcaaagaccagaagtatcttaactcctgggaaacatagactccaccacctatttgcaaatgatagcaggtccaaacttcttaacataccattgaaggacctcggatatctgacttctacataactttctcagctcaactcccactgtgtcaccagcatttcctcaacatccccttttgtgtcctatttactctgcctctgagttgctcctcatactctactctcaacgatttccacctccacttctgctctgcccatggaatttttcaggattaatcttcaatagtcttatctctaatgagtctacttaataaattagcagaaattgtcataaaggaatcatttgctagtgaacatatattcggtcatatataatagagaatatcagttaatgcccctgaaagatgatttactaagcaaatgttctgttccatacacttgctttcagtcacaagtaacaacagtaacaataaaataatcaaacattgattttaaaaataaaagatttatttatctcccacaaataggaatactcggtgcaggctgatacagtggttcagcaatataaaggatttgggctccttttatcttcctgctctgatattttactgtgggactgtggttcctttggcaacaaagttctagtccacctccacacgtctttcttattccaggtaagaaaaatggggaaagggaggcaacattcagaatggtggcataagaacccctgaagatatgctccttcacgaaagcaatgagaacaccagcaaaaatggcaaatcaacgttttaagaactcagcaacattaacacaatctagatggggaggagaaatctgatttcctgagttgccacattgtattatttaaaatttccatttttgatgaaaacaaatacaaaacatgcaaagaaatagtacattatgacacatgtacaggaaaagctagtaagtcgaaactatccctgaggaagaccaaagttcaggcttactaaaaaagaacattaaatcacctggttcaaatatgttcaaaatctaaaagcaaccatgtctaaaaaactaaagtaaaatataagagcactgtttcactaaatagaaattatcttttaagataggaagtagaaaaatgtaccaaatagaaattctagagttatgtacaataacttaactgagatgtttattagaggctcaacattagatttgaggtggcagaagaaaaatcagggaactttaaggtaagtccatcaagattgtccaggcttaggtacaaaactaagaaagaatgggaaaaaatgaacagaactcagagatatctgtgggacaccattaaatctatcaaatgcacttaatggtagtactaggaaaacaggcaagaaaaaaagggacagacagaatatttaaagaaataatgtccaaaaaagtcacaaatttggttaaaaaataatctgaacatctgaacttggagttcaataaactccaagtggaaaatattcagagatcttgacaaatacacatcataatcaacctgtcaaagacaaagagagaaacttaaagcagcaagaaagaagcaaattgccatgtacaagatcgcctcaaaaatattaacagctgatatctcatggagatcagaagataatggaataacacacgcaaagtgctgaaagaaaaagaatgtgaaccaagaattcctaattcagcaaaactatttttcagaatgaagacgaaattaatacatttccagataaaactgagtttgttgctagcatgcatcttttaaggaaatattgaagggaattctttagtgtgaaatgaaaatacacctagacagtaacttaaatccatataaatatatatggtaaaggcaactatgtaggtaaatataaaagacagcataaacagactttttgcttataactattttatcctcttatctaattcaaaagacaactgcacaaaataataataaaattatgttgatttgtttgtaccatataacattaaaattggtattacaacaatattacagcagagagtaaaatccataggagcaaaatttttgcatactaccaaatttaaattgatattaataaaaactaaagtcttataaattaagatattaattgtaactcccaggggaacctataggaattaattcaagaaatatataacagcaacaggggaattaaactgatacactataaaatagttaactcacaccaaaaaagacattaatggagaaacagaaaaacacaaaagatataaactatacagaaaacaaatagtaattacaataattgattttacattacattagtaattatattaaaagtaattggattaaatacttcatttctaggacagagattggtagaatggattaaaagaagatgatccaacaacatgtcaagaggagcactttagatttaaagacgcaagtagcttagaagtaaatgtatggaaaaatatataccatgtatagggtaatgaaagagagctggagtggccaaatgaatatctgaaaaaatatactttattaacatttttcactagaggaagaaaggaaattatataataacaagactaatccatcagagagaaataacaattataaacatatttgtacctgagaacagagtcccaaaatacatgaggcaaaaactaacagaattgaagggtgcaatagacaattcagagataatagttgaagacttctatcccacttttaataatagctagaaaaactagacagaagatcaacaaactagaaaaaagaaattttttttcagcaggttttactggagatatttggtataaacataattataatgatagtcttgttgtattcccaggttatagatggaaaagaaataaattacaacttgcaaacaaatgacatcaataagtagtttatattcactaattataaaatatgagatggtataagtcattcaaaatgagctctgtagaaaaagtcattaaattattttataagtggatgttttgttgcttttcacaattttgtttgaagaggagttcaaattaaattaacaagtatcgaaagagaaaaatagctatcatattgcatgaacatgtaattgagaaacagatgttgcttccatgtatggaaagaatatgacttgaaaaagggattcttatgaccaaagggcaactaggagtgtaaacaatgaggaaaaccaagcttggcttcacctgcaaaaactattggaaaacacgcagctcagctggattccagtgtaaaaccaaggaaaggaagacttgcaaatctgtttaaacaatgaatattctgttcttaaagtcatagtttcaatacattttggtgtgattccaagattttttttttaaccctaggaatagcaacttcatggtaggtttttgagttattgcgtatctaaaaatgtctttaatgtttttctgcataagaagacaacttctctgagcatacagcttttgaataacagccatttaccacacatgcacaaaaatgttgactatatcttgattgtcttctgaaactaggtgcagaggaaacgatggagccaacttaaattttcatacctgtggatgtaaaatagtcagtcttctttaacacctacagaatctttctaaattcttttaactaaaaagaaaaataccatagtgggaaaggctgtgtgtatgtgttgggcggtggcaatataaaaattctctgtactttctgcccaactttcctatgaacctaatactactttaataagtaaagtccatttaaaaagaaagaagaaactaggggtgatggctcatgtctgcaatcacagcactttgggaggctgagatgggaagactgcttgaccccaggagtttgcaaccagcctgggcaacacagtgagactccctatctacaaaatataaaaaggaaattagctgggcattttgacacaagcttacagtcccaactacttcagaggctgaggtgggaggatcacttaagcccgggaagttgaggctgcagtgagccatgattgtgccactgcactccagcctgggtgatagaggaagaccctgtctcaaaaaagaaaagaaaagaatggattttctcaaatccatctgcatggatttgagagtgaatcttcccccacttttaatccgaaaatccagttatcatttggagctctttcacattgccttaattgtactcttaaatttttaaaatttcactgcaactctttaatttatgcatctctgtattaccctactgagatttccagcttctctcttctcttcttatgcattaccaccctggtttcttagacttcattttatcctacagcctatgggggaggttaagcatttttccacattttcttcctatttatagaatacaacagttgcaaagtttgttagatttcctctgtgactcaaggtgttattcacttgctgtgatgattaatgttatgtgtcagcttgattgggagacagtatgtccagatatctggttaaacattacttctgggtgtgtctgtgagatgtttccagaagaatttgagttggtggactgaatgaagcagatggcccttcccaatgtttttgggcatcatccaatccattgggggcctgaatagaagaaaaaggcagacgaaggagaatggatttgtcctccctctgcctgcctgcttgagccaggataccaatcctttcctgccctcagtactcctggttctcaggccttccaacccagactgcaatctacaccattgactctccagctctcaggccttcaaattgcatagctggcctttgtgggtctccagcttgcacacagcatattgtgggacttctcagtcactctacattaccgcatgagccaatatcctataataaatgtcttgattagataaatagatggctacatagatagcctattggctctgtttctctggaaagctctggttaatacacttgccctttttgtatttcatagaaggtgtttgttcgcttgttgttaaaaaaaaaaaaaaaaaaagcaagctctaaccagaatcattgtttcccagcagtcaatatatgtggattccttccgaagcatgccacaatccctttggtgtaatcaaaattcctccttagatactcaggttgatgtgcataattgtatcctatttcctagtgtttacagacattcatatatttcggctttgttgggctatggctggatttcttaatagtttcaaccaacaaagcacaagaccaacctcagattccagtgtgcactgctgtaagggttcctcctcatttccccattgtttgcagtcctttgcctgtgaagtcaacgttcttccctccaccccacctgctttatgccttgttattgtccacaaggatgatttttcaaagcagatgatagaggtaaaaacacagtaaggaagaggaaaagacgctttaattgtaacaataatcagcacgtgaaaataatagaaatgatcccctagtcttggtgctattgatctagcttctctaagactgatggtatatagtggacaaaggccaagtaacgacaatttgtggaagaaacacaaatggctgatagtaatatgtgtgaaactcaatcttggtaataaccagagaaatgcaccttaaaacaagggtacattatatttgtctctgatcttagcaaatattttaaagtgaaaatagtgattgtgtgaatgcacattgttagtgagagtgcaaatcagtgaagggtttttaaaattcttacatcctctgaatcagtaattctacttccaggaatctattgtaaagaaactataataataaaatgtgatacacaacattacttataaaaaaaaccaagacaccaataacaggaaaatggttaaaatgaaatttggtgcagttcctttaggtaattttttaaaaaaaaaaattttaatatttaagaatgtttgttatatcacgttaatccaaaaaaagattcataactctgttatatactccatatcatgcataggaatatccaattttgttctacacatatattttatgtaggcaaatttttcaccatataaacatgtttagatatgcgtctttgcatagacaaattattagaaatatagaatattaataattgtttttgttataatttataaactttttttacttttttctatttctgatggactatgctatgacatttttgtttcttttaaatttggaatagaaacgagtaacattgtaaaaatatatttattacttttagaaaaataatggattaacatgttgatacaaaattggttggttttctttttttgcttgcttccaattgttactggaacctcaaaacattactgagtccatagcacagaatgagacataaccatgctaacataatgatagaaaaagaggtaaaacaattgattgactccactggtgaatcatgcttagaagctgctcaaaggaaactgtactctgtgtgatatgaataaactcagaagacattctggaaccatttatagtagtgaaagaaatactttattaagtggtctccaatgtatggactagaaatgattaatcattcctgacatttactaaggtaaaaatgtcacagataaatagacggatggatggatagataggtagatagagatagatagatagatagatagatagatagatagatagatagatagataatagatatataaagcagttaaactacagacagaacaaaaaaacattcaaggtgaacattttatttagttatttcatttgttgacttatcactattattctgtctcttctacaaagagaaccaggaatcaaaatttctgaaaattcactctctgctcatcatctatgggcacgcattttcaaaaggtgttctaaaaaatgaataccttattgattactagaaattcagcctcaaacctctataatccctgccaatgtggtaatgtgggtcagaccaagaaatcttgattttcccctagcttaaagctcagacaaaaagagattaggtggcttatttctttcttactgtctcctggatccactgggttgatattgcttggctttgtaactcagggttagtaaaaagagggatgggagatgtattttctcactggttaaaggaaattctggcccacatttcatcagcaaccccatggaaatggaattatacaattaaatacgaagttctaaataataaagaaatttaacagggacatggaaaatatgtattctaatcactggtattttccaactcaaagcaccacttactgatagtaggaccaggtgttttccagattccttgacctgactcttcttaccagtgaagaatgggcaactcataactcccattagaggttaatgttctagttacaatcaccaactacttggagtctttcttttaaaatgagtaaaacagctacgattgtgtattttgttatgttcaaggtattacacttattgacttacgttgttatttcaattaatcctaccaaagcctcgacacaccaagtgctacgagttctcaccccctcatgtaagatgaggggactgagattccaacagggcctcacagctggaagatacagagctggaattcttgtccaaatttgtctaagcacagagctttgattcttcacacctctgcaacactgcctggtgaactcattgatttaactaaatcatattgttttaaaatcagtgtagacatcattgtagtgtgctatgctttacttcattccaggtttttagtatgaattttaagatcaaagatgctctaggtatctgtaattagatgttatctgctcatgaatctactgtataaacccagcatttaaacccaatccctctctaaagtacacacgcacccacatgtaagtaacgtctgtggtatacttctttgagatttggaggcaggagtgtgtgtacagcattaaaaaacaaaagctgaccctctgtccttgaaaccatcccttctcttttgactgaattctgctggttcacatcccactctggcagcttcttctccatcttatcttctcctaattatggcaattattccctaaatgatggtatttctcaagattcaatatctgtatctgagactgctagctgaccatcaaccctattttctcatattttagggcacagtcaggcaacttttcccaacttcatgtccaaccagtggagatgactcatctcttccaggtcagacacataaacatgttctatgcatgatcccccatgctctttacagaggtgtgggcaagcacagtgactcagagtgaatttcaaagtggtaatgatttggcagcctggcgcgggcccctggataaaatgcaagacacagaactccctgcttctgccccctctgaattggaccctataagggaaatagctgtgctttagtcaggagtaggctgaggcagccttccagcacagcatgactcagcgggtttggagcacaggggcacaatcccacacattatgtaaccatgccatgtgaggcgcattaggtgatcacccacgtgagctcgtgcttggcttggagccactgttgtctgtaaaaggtatcattaccctgctaacactgtacctatggctcactcatacccagagagagtaaagtcatgtcaaaactgtctatgattcctcgagtgtttttctagctacccgccactctccctcaggcctccattagaacctgacagacccataagatttggttaaatgagcaagaaagaagtcacctctttgtgaaactgatgaaaattgggcatttgttgttttatgatcactagcccatattagccaatatagaaattagtatcttgaagtgggtactgccctgatgaaactctcaaatacgtggcattgttttagcaggcaggaagaggtggcaaggaaaactgattcaggctggagaactgaaaagcctggttattctatggcaaaatacttggaaaaccgtcttccacattaatgtggtaggcagatcaccttccagccaagcctgtagcattggggcatcaggtggaaagagttagagctttgctgcgtttggtgactttaggctaccattagcttgggatgaaataagcttagacaaaatgtaatggtttggaaacagaaattaaagtaaatatagaacatctgaaaataagggacttttggggttagaaaaggcaagtgcttctggctccaaacagaaggaaataaaaccgatgagagccttgagcaacaaaggcttaccagacttctcagttgaacaaaatgacttggacctgcattaaataccaagccccattgccaaatctgttatttaagatagctttaaaatagccaccagtaaattgagagaaagaagcatgttaggagcaagcaaacataaaaggcatgtgcaggaatgagcttgggcatggctcttcccccatggaactgactggactagaaataaataggtcagaaacccatctgtttctgagcaaagggtgttgcccaagaaaacatgagcctggtctataaaagccctacaactgtgaggtgagccttgaaacaaccttcaggagctaacatttaccaagcaggaagcaggcagcaagtgatttaactacaaggagagcccactccccacagctgacttcagtgtagccatggaaaaggaaaagaaaataaaacctctcaaatgcacatctatttgatactcatataaaacaaattatcccccaaacatagcaactttaaaaacatttattaccttacacaatttctgtgggttaagaatcaaggagcaatttagccaggggattctggctcaggatcccccaggaggttgcagtcttgttgttggctgtggctgcagccagctaagggcttgactggtgctccaagatcagcttccaaagtggctcagtctcagacccagcaggttagtgcaggtggttggcagaggcatcggtttctcaccaagtgcacctctccactgggctgctcatgcacccccatgacacagcagccattcccctctacagagggtgatccaggaggggtcaggatggaagtcacatgctgtcgttccacaatatgctactgtttgcccaggccagccctgccccatgtgagagaggactacacaaaagacttgcattagggctgcggaaacagaagaccacagggtgggtggcttaaaaccacattctatcacagctctggaggcaggaagtccaaaaccgagtgtcatagggttggtccattctgggggctctgcgggacaacctcttccatgcttctctcctagtatgtgtggttgccagcattgctgggccacccttgacctcccatctctgcctctgtcttcacatggcctgctcctctctgtctctgtctgtctccaaatctccctctatttgtagaaaaccagttagtgaatttacagaccaccaaacccagtagtaccttatcttaacttgactacatctgcaaaaacccgctttccaaataaagtcactgaggttccaggtggacatgaattttggagggacactattcaaccccacacagaccagaatgccagtagctgcctgtcatctggggccatcgcggaggctcaggacaacagctgtgacctttgggcttctactgttgctgctgtcattgtggctgttaagctgttgtcctacctacactatgcattccctcctcctttcaccccgcaattcccctttgtccattcagcctattcctgtggttccaacttgtgctactgagctgatgaaataacaaactgtcattttgaacggccttctgagttccaaaaccacattttgattgtcctgcttaaaactgtgatgcaaaatttccaaaccctagagacatcttctaaacagaatttaccatctaatccctacagacacataacaagctacacccactcagatacatcatgaacgcctctcccaacccccacgccatcaattatgaaatccttttctttgcgccactcctatctcattgctgtcactgcccacattcaaagccagaaccggaggcccctccttcagcatctgccagttccaagcctatgctactgacagtccccacccctgggagtgtttgcacagatatcgagcaaagcacagtgcttctttattataaaatactcagtagtttcctatttcagactttttatactcgtttgtgaaagccccacagtctgatgaagctgtttttcctaacatgatcagtccattgcctttttttactcaatgtgtttcttctgcatgaattgtccttcttaattcctgcatctttaaaaatacccctccagttccattttcttcaagaagctattccaggtctccacagataaaactggtctctctcttccttcactctcagtactagatcctgccttacttattgtatagctacatcagaatgaaattcttaacacaggtacctggatccctagaaaaaggaaagattcttggtcatcttgttgactctagggcctgtcagaggagaccctgcacattgtaagagtttgataaatacttcttgaatatatgtagaataaattactattgagctattttatattctaaaatgatatgaattaaaaaacaaatatttaattagatgcacttttgacaatgaaaatgcagttaatgtgtcatttcctatccttttcattttaagggttgtgaatgatcacctcctcagtttacaatgtcaacagtcaactcaatggtgagagagagagaaaacagcttactgtccaataatcagaggaagatgttgattctaaattttcacaaaaaccaatgctgtttctcagaagaaactaaaaactattaaacaggggtttgatctgatttaatctggttacttttcttctaaaaataatcattggtagaagatgtttgggggattacagaaaggaatgtgtttcactgggtctctctcaggtttcccttttgcaggtggacccacatctcacagagtaagatgtattctttccttcatccaaggagaacatcttggaccacacaacctgaatgtatatcagacactggcccagagcagagacagagatgttttattcattttccctgttacatttttgcaggaaaaaaatatattttttcaccagagccagaagccacaggactggacttgaactatgaattagggaagttcatatgtgcaagttacttaactgcctgtgctctgcaacattatattcacaactttgtagttcccgaagctataagaaatttatcaactcgttaactcactgtctttttgcaggccagagttcataaagtagaaactcactctaaggaacaatggaaaagaaaatcttcaagaatttgcagtattttctacggaaaacgaggggtccatggggaccattgatgctgccacgggtaagcttgtggtcacttactcacacttgatgtgtggccctggcctgtgaggtcacccaagccacaatagtcctggcaaagtggttaacaggatgtggctggcaaggtggctgtggcctcccctggtgcccgacacccccatctggggcatctgggaccctcacactcggcacctggccctcccctgactcccacccaggcttgtctctccaggctgccacacactgggagctttagtctctctacaataggaggctccctaagggcaggacgtctgaccctttcttcactggcaccccggccctggaagaggctggaatcactgcacagacccatgcaccctcgatgaatcgtgcatctggagccctcagctgggagtgagatagaatcgaggagcagagctgccccgtggccttggccagaggtgccaggagctcaggtggaggggggctaccgggcaggatgccctggccactggcctccagtgccctggggtggggttgctgcagggtggcatagttgctgctccccctgccacattctgagagcttccctgctactggtagactttgcagtcagtggaagccttcaaggaaaatataagaagtcctttaactctgtgcttttctaaaatacacagtctcaaagatcttattctgtatgaaaacaatgtagacattctttgcggcaggagagctaattgttatcaatgacaagtccaaaagatttaccatgaatgaaggaaatgcactggcatttctgctaaggtgtggtatttcctctcttatacccgcatgctggtggctgtttgtacagggagcagggagtgagcacctgttaaagaaaacgctatctccctgccccaaacatgttgacagagggctatcttgctctgggagattttctttcttcctcttaaaaaacaatatgaagaatatttttcttcttaaaaaatgcacagagaacagtattgcaaataaagaaaatacaccacatagagtggtactggagagctcaaatgtcatgaaaagatacttagtaaatacacttagcaacattaaatcagcattagagtaactactacagtaaaataaaaatatacctaacagaaaagaatggaccaccctgctaagcccatgaggcacaagcccacatgcagatgaacactgcaagatgttctaagtgctggcctttaatgcttagagttaaaacatgatgggcacctggaggccacaggtcttaagaaagtcaatgaatttctcagtactttcaggaaatatgtattaaagatcccccaagagaaattcgtatgtgctgtaagcccagcaataaatgtacttagcacatgtggaaatcaaggccattctgaagaactctgtgacttctcatttgtagaaacactgggtgtaaatcaacggtgcagtagattttcagggcaaacacaagaccatgagtcccttgagggtaaacccactggacatccctagcaatctccatccccaagataaacactggcttatttccttgcttttttattgagttgataaagaaatttgacgctcatatggaaatctgaaatctgagctactgggttatgaattaagtagatgattttctaaaatatcttctttatattctatataaataaatagtaatgagtaaataaatacagtttaacgtctcagccaatggaacaatgtctgctacagccaggcccagcttcacggaatagaactaggaacaaacaaatggcctctgagattttcagtatgtttgctgatgagagatgtataattctataaaccagggctggttcgaggttttgttttgttttgtttcacctccttctcctctccctccttctcttccgcctccatatttcccttcatctcccagctcccctccgttttcaagccccctcctaatggagaagatgaggagggtgagtccaggcatccaggttctaactgtgagagcagggctggggtctgcaatgatgaatggtgggtgccaaggtggctgagaattcccctttactgagaccaccatgtgccaggcactgggctggggtgtcccacgcctcatttaccatatacaaacaggaagctgagaacctaagtaacacagattactttaaggtaacctaaagtcacagctaatcctaatcctaggtcttcccttctgtattcagagcctgagcacagctttgattcctgtctcctgcttcctaactgtgtgccctggggatgtgtactcaaccactgtgtgcttccttggggatgatagtgatagctacctcaagatgattgtgaggactaaatgaggcaatccatgcaataggcagtgtatctatccatttcttctagtagtctattaaaatctctcctatgaaagtagctttgtaaatgatttttataatccaccctccttttcctgttgctttattttgaggccatggtgttacataaataagggacatgatattaatatcttcttgattgctttatccgtaagaaatgtccttccttatccttcttaatgcttttcaccataacttttttttcatatagctaattgagctttctttaagataacatctttgtggtttatccttctgccctcactatattttctatcttctgtgtctttgtgttttaggtaaatactcttgtaaacaacatgcagccggacttttaaaatgcaatctgaaaatatttgccttttaatagatgaattttatagatcgtttaattagtttaaattattaaatctattcctaagtatgttatctcttttgttactgttataaataaggtattctgttccattatattctaactggttattttttctgcatatgaaagctattgatttttgtgtgtaaagtttatatcctattaccctgattaatgattttattgtttgagttagttttattattgcttctctagggatttttaaatatgctattatttcacctattaatcatggttttacttcttattcttttcttctgattgttctcttttgctcaatttcattggtttcccataacacgattaatagtaataaagagtgcagtcatccttgccttgttcctgatcatgacaggaatgcctctagtctctccattaagagtgtggctttaaaaataagatatttgtatgttatgatattaaggaaatattcatccatagcattctttgaaagttttaaatagaatgtgtgttgaattttggcaaagtatttttaaacacatttggagatcatcccatgatctttctttttagacccattaatatgggacattatattaatagattctctaatgttacattagacttgcataaatgctataaattccatttagtcgtgatgtaatttttggttaatgtggttctccaacctgtgtactaaattattataattaagatttttgtatcaaaattcataagcaacattgatgtatattttccttttcttgtattaactggtgtcaaagttaatcttgacttgtaaaatgaatgtagaagtttgtactcattttctatgccctgaaatgacttttttttaactttggaattatctgtttttttcatattttggtagaattcctctgtgatagcatctgtgcctgattcatttgtgtaagataatgccttgacaaattttttcttcttctatgggaattaatgtaagttttttatttattgagatcaattttgacaaattttacttttctaaaaattacttgcatacaggtataacaatgtcttatattcttttaaattctctctgtatctatagatattttgtatatttatgtttcatctcatttttcttcatgaacttggccatagattttttcgtatcttcaaagaaccaaaattttcaactatttgttgaatctaatattttcctgttctatacctcactatttttttcctttacctttattattttcttattgtgttttcatcatgtttactttgttgttctttgaataacttcttaagttggaaatttaactcatttattttcactcttttgttttcactgacagagagccatttaaggctatgaattttcctctagtcagtgctttgaatctatcccattgattctcatatggattattattattattttccagaaattctgaaatttcaagttatatttcccccctcttcaagagttgtttaataaaaggtcttaaatttcctttgaaataattttggaagttttgttttaataatcccttttaaaattgtgtggttttgtatgtgtttttatcaaagagttttgtttgtaatatatttactatatagaattgaccagtgctctcttggtgatgaaatatatagtcaacatatattctttgtgaattgtctctgtgcaattgtgtgaaaagtatatttcctattttaagggtctagtatgatatgacagatataaagatacatataaagatatatatacgcacatatctactttactctagaggttattttatattctttatattcatatttatatgtgtacttgacccatcttttaccaagagcagtatgttaaagttttctattattagtgtgtctatatctatttatccttgcacctatgttttctgttttatgtggttagttgctatttgatgcatagtcataactgttaaagcctcactgtgagtttcagcattataaattcttcttgtttttgctgtttttgctcaaattctattgtgtctaaaatcagaattgtaacaccaattttctcattgtttccatttgcctagtatatactttgctcatccccttatctttagtcttttttaaatcagtatgtcttaggtctgtttttgtttccattatggctttgggtttactttatttgccactgtgaaaataattttcatttaatatatgagttaaccctattcaccttttttgatattagtctcaaaactgtcatataattttgtgataataactggtttcattatgtcatatttactgtttctttttttatatgatgacacattgtaattattttaaaaattctttaggtatttttggaaagcttatacttttgttctagttgttaatgtatatttacaccttttgtgataccagagttctctattttattcttgcttaaccatccactaccttgtctgtgaatttaaataatatccttcgatttacatccattttctatgtattgattaatgatctcattgtactttcctttttgtctcttcctttacttgccattgtttgtttatgtcttcgttgtctgaatgcatacattcttattttaatgtagcacaacaattaaaagaatcaagttattaccatcagttctatactacagattccccagttatctctccctcagttgggcaatgcacatcttctggcagctgtctgaggagggccctgaggcactgagttccctgcgctcttgggcacatttagtgttgttcttgtaaagccttgatacttgggaaacagcttggttttaagcatgcataattcatttaaccatataagtcatttgttacatttttctgaaggttccaatgaatacttttattagactatgtttcaaaattagtaatttccattcagtcttcccagaaaaacaatatcctctttcaatttatcagttgaagtgtttttattttttctagaaaatttacttggattactactttaaatattggtagtttttctttattttgtgctgcttcttcaagggctccatttatatctattttggaccattttttcctgtcttctgtttcaaccagcttccctctgaccaactttacttttgtttactttaatcttcttcattgttatgtttttccacaatgttcttcattaaattttcattttaattatttaccctaaggcccctaataatttttctcttcactttggatattgttttcatcttttgcttccatatttttcttgatttctattaactttggtaaatatatatatttatatatgttacatatatgcatgtgtgtatgtacattatatatatgaaaattatatatattcaaattatatatacatatatacatacagattttatatatgtattcagagttttaatatatattcagacaatgtctattcagggtatatttgtatacatttagcttatatacatataattatgtttggagtgtttagtctgttagttttcttctgtttcatattgcttttggaggtgaaagaattttcatcagcggaaatgttataatttgccttttttcagagaatctttatatgaagtcgctttgattttttcccactcataggcatttgtggacaggattcctagttcaaaaacctcttctccatcagtttagtaaaccacagtttattaaatggtgatgctggtattggtaaaaggggagaggttggtgtgttgtgtctgaaaattaggcacttcttcctataccttctttctctgcctgacacatctctgacaggtaccactccttgtcaatatgaatctttccaagaagcagtgtttcctggaagctacaaaatccagtgctgctcacttttaaattgccaccctgtggccactcacagcccaacatttagcagattagactcagtgttggagttttcttagagtgattgctctacacttcattttagtttcttactcttctcttctatttttcctggaatctctgaagactcaactatcctgttctccaaagctaatggcttgcaatggtgatagacgctcctttggaatttggtatttacttctttgtctttacgtaattgaaatgttttgtattctctaccctgagcaatgaggatggtggggacatgtgggacttagactcttttgtgatggtgatatagtttcctgggaagatttttgacaagattccagtgcagttcattgccattatccgctgaaaacaatccactcatctactccaccaccttacaacatttacctcagaagagtagacattcccattgccattcctttgtagacagtctgccttttctctttggtagctgcagttttttgataatgtgcctatgagtaaatttgtttttatttgtcatgaatgagactttctgtgctttttcaaagtgaagattcatgtcttttttccaaaaaatcatagaaaaatattagtcatcatatttttaaatattacttcttctgcattacttcattatctctttctgtaccttatttgatacatgttggaacttcaatttcaatcccaaatgtcctttttttcttgctagtaacaaaatttcaatttcttttttttacacttgggaccatggccatgccagtaatgcagaaccatggaaaaccattacatttctgtcagcagttacactaatttattatgaggaattcataatagaggaagattaaagggtcacttatttccaaaattatcattttatataagataatttcaagtgttagtggcagatactgcattagcatttcttcacatcatactgaacattaccttctatagcaatccatacaacaacgtggaaaaacatcaattaatactgttcataatcgagatgacaatatcatgcaaagtcagagatttagggaaatcattctgggttggagacagcagatcttatattttctccttaccctgccatttcctatttatacagtcttaacaaattcaattaattcttttctttggtttctctaattcctaagtggggacaattatttcaatagaatgaatattataaatgtctgacacagtgcctgaaacaaaatatttttgaatttgaagtactgcctctgaaaaaattaaataattgtcctgtgtgattcttttattatctttaattcatcaaacttttaaaatccctacactgtagtgatgacactaggatatgcaaacattggcaacgttagaactctgggaattttagcaccattgactgcaacacagaatgaggaaaatgaaacaaagttagtggcaggaaaaaaaaaaaaaagcagtgacaagcccaggtttcctgagttccttccttggcattctttccattaccctacactgccccaaccatgctggctgtgatggttaatactgagtgtcaacttgattggattgaaggatgcaaaatattgatcctaggtgtgtctgttgagggtgttgccaaagcaggttaacatttgagtcagtgggctgggaaaggcccatctatccttaatctgggtgggcaccatctaatcagctgccagcatggcaagaatataaagcaggcagaaaaacgtgaagagactagactggcttaacctcccagcttaaatctttctcccatgctgaatgattcctgccctcgaacatcagacttcaacttcttcagctttgggattcggactggcttccctgctcctcagcttgcggatggcctattgtaagaccttacgatcgtgtgagttaatactccttaataaactctcatatttgtatatattatatatatatatatatgtatcccctattagttctgtccctctagagaaccctgactgatacagattttggtaccaggagtggttctagaggaacagaatattaaggatggagttctttcattgttttttgggtttctggatttggccgcttaatatgattagacccaaaaatgctaaggactctacttctaatagtatggagaacactgatagtccttggcgtgaattgtttatagttatgcaaaatgaatgcatttgacactcctgattcagtgcttatgagaagcaaggagtttagtgacgctacacataatacctttgactgtatgtggagaaccagggaacataatgaagctggttggttgctcttaagttcactggacaatgtgatgaaagaaaatgatgaacccaaggattctaactctcggcttcagaaaccgatactgagcttcaaatctgctaagattgccctgagtgattcttatttcctgtaaagaaagagctgaaattgtggaaaaagagacacaagctcttatcatgcaagtgggtgacctgcaatgaaaggtgcatgcacagcctcgccagatgtctgctgttaaaatgagggcattgattggaaaagaatgggaccctgcaacttggaatggggacctgtggaaggatcatgatgaagctggggacactgagtttgtgaactctgatgaatcttttttgccagaaggaacagcttccccatccccagtagtggcaacatcccctctccgacccatgctgccatcagcctttccacctttgtctgggaagataaaccctgcactgcctgaggcaacagtgatgtccttccctgagacagttgccaggcaaaataatgttgattctcctgaggagccacccccaacacccctgtttgcttctagacctaacactagactaaagtcctggcaggcacctagatgtgaggttgagagtgtgacccatgaaaaggtgcactacacttgaaaagaactgcttgagttctgtaatttatataaacagaaatctgtaatttatataaacagcatgggaatggatattaagggtgtgggataatggtggaaggaacatagagttggatcaggctgaatttattgatttgggcccactaagtagggactctgcatttaatgttgtagcttggagagtttaaaaaagctctaatagtttatttgcttggttagctgaaataaaatggcccaccatgagcagatagaaatgtctgatctcccttggtttaatgtagaggaagggatccaaaggttagggagattgggatggtggagtggagcagtcactttagacctactcatcccagctgggagggtccagaagatatacgcttgaccagtgccttgcaaaatagatttgtgaagacagcacctgcatctttgaagagccctgtaattgcttttctctgtatgtcagatttaacagtgagaaccgcagtcactcaactacaaaatttaaatacaatggaaatattggatcccgaggtggcagggagcaaatggcagcactcaactgtcaaaggtaaggtgggcataactaccgtaatggacagcagaggcaaatcagcaatcagaatagtctgactcatgtagagctgtgacactggctaattaatgatggtgttcctagaagtgaaattgataggaagcctactatattcctatattaattgatataatcagaaaacttccaggttgaatgaacaaaagactaatttgaattataaaaacagagaatcatggcccctcaatcagtttcctgacttgagacagtttatagacccagaaccccttgaatgaaagggaggctggatctccttgaggaagaacccactacactactgacattttatgctgttaatctttctcccgtccttccccaaggagacctccggtcttttgccaggttaaccgtgcactggggaaagggaaatgattagacactttggggacaactagacaatagctctgagctgacactgattcctaaggacccaaaacgtcattgtggtcctccagttaaagtagggacttatggaagtcaggtaattaatggagttttagctcagatcctacttacagtaggtccatgggtctccagactcatcctgtggtcatttccccagtgccagaatgcataaatagcatagacatacttagcagctcacagaaaccccacaccatcccagaataggtactcaccttaaaaacctagtgtttcaggccgggcgcggtggttcacgcctgtaatcccagcactctggaaggccaagatgggtggatcacttgaggtcaggagtttgagaccagtctggccaacatggtgaaaccctgtctctactaaaaatacaaaaattacctgggcatggtggtgcatgcctgtaatcccagctactgaggaggctgatgcaggagaatcacttgaactcaggaggtgggggttgcagtgagccaagatcccaccactgcactccagcctgagcaacagagtgagactctgtctcaaaaaaaaaaaaaaaaaacacaacacaaaaacctagtgtttcaaagtggttttctatgtgttatattttaaatatcaaatgggtttaattcttctgttatcttgatttgctttgtgaaattcatgtaggaaacatatataaatgcttagttggtccccacataaatatatgccacattaggaagtattcatcctcattagcaagagctgcctgtataaattcaacaaaaagggaaagccagcagatctccatgacatttaagatggaatagatttcttttttattttattgtatcaaactcactgttgctgtcaatatcctactttactttgaaacagcagcattattttgaaaatagcacacattctgcttgagtcttcaagctagaatgtggtggagccaaggacatgaaatgagaacagctctgttcttgtttgccagaacatttacaatttttactattattccttttcctggtttagaatctcttgtgcagttctcctctcattccaaaatggatacttcacaaatagaaaattaatgggcaatagataagaacctggtaattttgtgactgttaggtgtaatattagaagcctgtaatttaaagcaatcactgactaagctttctaattcataaaggacaggaaaagaaaagagtgcatttgtactgatgaaatcttttttagtcctcatttgctgttatcgatagacgacagatttctgttgcaaatatatgtcttaactattaaaatatgcatgcatatttagttaagaattagtcattagtataaaactaggatacatagagagcaaaatgctacaatattgtaatgtaattataatattgtaagcaaagttgcatggaatgttagatttttctgatcaggaatggtcccaaaaagctgtttggtttgaccttcatatgcactatagctaattcactttgtagcaggatcttgtctctgacttctgctataaaatgtttctcttattctcaattctggaggatgaagggcatttaacaaaagctctggggaaacgatttaaactaatcctgtcttccacaagccaggccagctgactatagcacagaatgccaatatactagtttataatggtaataaaacagacaatttttaaatgaccagcatacctatgctttatctctaaggaaacctatgactctgaaacagacaagagacagaattgagcatattactcaatacacacaaatgataattaacaaatattgtgtttttgaagataataaataaacataagtgtatatctttaaagggcatttttaacatgctcataaaaacactgccatataaaaagagaaactgtaagatatattggtgttaaagttcatgattggacactgaaatgtcaacagcagactgttgtaaaaaaaagcttcattaaaaagaaaatatctgaaaatcaaataaaaagaagtttattagtaaattgtatggaatcccagtaaagattaacctaaagcagaaaaaaaaatacagtatttttctctttatttttcctatttttccaacatctctgccaccaaaaccgtgtaggacattgtattttgaaaaattcgacacagaactacaacaatatgttttccttaaatttgagtattcttggtatcttactgacatattaccatcagaaaagtccgtgagcaaccaagaagttgaatcaaaagtcatttatataattaaatagaaaatattactctggaaaaaccacaaatgcctagaacatacggaaatacaatttattgaataatatatctttgctcaatgatttgaagcaccatttgaatatacatttcactctcttatatgtctaaatcttcatgaatccatggcgttttgcatatgtatcttcctagtgcatctcctgaactgtgtaggaacagggaatcttacggctgcactggggcagccttatgagtactcctggggctgtctagatatctggtcctgacccttcgccaaaacgaggatgagatgggagggctaatgagttacaatgtgctgttcaaagtctgaaattttcttggagatgtgcactgttggtttgtttacctcgtttaggaataaattgataggtgattttcacctactttaattggtcacacattctagcattagctgcatgtccagcaggatacaaaagatgcctcaggattcttcggcctgaactccctggtgtctacttctagactatagatattgcattgggttctatttctcagttgtttgtgaagcaaatcctgtgaaagtgagaaaggatgggggcttgggtggcagctgcacctgaacaagtgtgaaccactttatgattatgattacctgtacttcctcctgtttgttgcatgctttatcattatgtatgtgagtgctccctctggagtttgtgagtcctttcaattatcctaccctgagtaccccatgcaatgttttataaggctgtgtccccattattaatttacaacaaacagctttcttctcatgcacttccaccttatgtacttcagaaacagactggtcgaattctgaaaggaaaagcattaaggctttggttggaattttgctaaatatatagataaaattattgagtcagaatcaacaactttacatttctcccctcctggcatgcctttcagttcgaaggagaatgagcacatacactagcataaacgagaaaaacaatgcaacagggcatgcatacaagtaagaatatggagagggaaatgccggcagttacaaagactggaaattttcagaagaaattgaaatcctaaatagaccaataatgattttcaaagttgaatcagtaacttaaaaacctaccaacaaagaaagacctggaccagaaagactcatggccaaattatcccagacatacaaagagctgttaccaatcctactgaaagtattacaaaaaatcaaggaggagggactctttcctaactcattttatgaggccagcctcattctgttaccaaaacctggcagaagcacaatgaaaaaagaaaacttcaggccaatatccctgatgaacacagatgtaaaaatcctcaacaaaatactagcagactaaacccagcagcacatcaaaaagctaatccaccacgatcaagtaggctttattccctggatgcaaggctggttcaacatatgaaaaccagtaaatgtgattcatcacacaaacagaactaaaaccaaaaaccacatgatcatctcaatagatggagaaaaggctttcaataaaattcaacatctcttcatgttaaaaaccctcaacaaactaggcactgaaagaacatacctcaaaataataagagtcatctaaaacaaacccacagacaatatcatactgaatgggcaaaagctggaagcattcaccttgagaacaggaacaagacaaggataccctctcttaccactcccagggaacatagtactgaaagtcctaaccagagcaatcaggcaagagaaagaaataaaaggcacccaaataggaagagatgaagtcaaaccatctctcttcacaggtaataagattctgtatgtagaaaacccctgagtctctgtccaaaagctcctgggactaataaacaacttcagtaaattttcaggatacaaaatcaatgtaaaaaaatagtagcatttctgtacaccaataacatccaagctgagaaccaaatcaagaacgcaatccaattcacaataaccagaagaataaaatacctaaaaatacagccaaccagaaaagtaactaaaaaaagtctctacaataagaattataaaacactgttgaaagaaatcagagacaacaaaaacaaatggaaaagcattccatactcatggataggaagaatcaatattgtaaaaatggctgtactgcccaaagcactttgcagattcaatgctattgctatcaaactaccaatgtcatttttcacagaactagaaacaactactctaaaagtgatatggaaccaaaaaagagcctgaatagctaaagcactcctaagcaaaaagaacaaagccagaggcaccacactacccgatttccaactatacgacatggctacagtaactaaaacagcatgagactggtacaaaaacaaacaggtagaccaatgtaacacattcgagaaaccaaacagaaagccatacacctacaaccagctgatattcaacaaggtggacaaaacaagcaatgggaaaatgactccctattcaataaatggtgctgggagaactggctagccatatgcagaagatggaaacttgaccccttcctttcaccatatacaaaattcaactcaagatggattaaagacttaaatgtaaaacctaatactattaaaaacctggaagaaaatctaggaaataccattctagacataaaatcatacgcaatgattttatgacgaagtccccaaaagcaattacaacaaaaacaaaaatttacaagtgagacctaattaaactacagagcttctgcacaacagaagaaactatcaacaaagtaaacagacaacctacagaataggattaaatgttcacaaactatacatccaacaaatgaatctgtaaggaacttaaatcaacaaacaaaaaataaacaatcccattttaaaaaatggtcaaagaacataaatagacctctcgaaagaaggcatatatgcagccaataagcatatgaaaaactgcccaacatcactaatcactagagaaatgcaaatcaaaaccacaatgaagcactatcttacaccagtcagaatggctattattaaaaagtcaaaaataacagatattagtcagcaaggttgcagagaaaagggaacactaatacactgctggtgggagtgtaaattagttcagccactgtggaaaacagttttgagatttctcaaagaacttaaaacagaactgtcattcaacccagtaaccccattactgggtatatacccaaaggaatataaattgttctaccataaagacacatgcacttgtatgttcactgaaacagtattcacactagcaaagatatggaatcaaccaagatgcccatcaacagtggactggataaagagaatgtggtatatatgtactatggaatactatacagccataaaaaaagaatgaaattatgtcctttgcagcaacatggatgcagctggagaccattatcctaagcaaattaaagcaggaatggaaaaccaaataccacatgttctcacttataagtgagagctaaactttgagaacaaatggatgctaggaaaggaatgacacacaccggggcctacttgggggtggggggcggtgggacaggggcaaaaaaaactacctatcaggtactatgctcactacccaggtgataaaatcatttatacaccaaaccccagtaacagacaatctacccatgtgacaaatctgcacaagtatccccctgaaactaaaataaaagttggagaaaaaaaaagagataggtggttttaaggaggctgctagattattttaaaagctaacatttattaaatgcttactacatgcctggaactgttctaacactgcaggcattacttgtttaatccttacaacaatatatggggtatgaatagatgatagatatagatagatggatagatagatagatagatagatagatagatagacagacagacagacagattgatacttagttttagacaagaaaactgatgtctgagaaggtaagtaacttgctcatggtctgtgaggaaaagtaggatttagactcagataatgtatccctggagctggagttcttagccattaatctagacttccaagcaaattagctaatagtagcctgggacatgcaaagttagcatgaagtaattaacaacagagaccccacatctgttgcacccccacttgcttgtgctgttcatgggaggagcaagatttctagatgaaatgacttaattgttcaacaggcagtagatggtgattcaaagcaaagacaagttttaagtcaacgttcccaatcaggacataatcctacataacacattctgctgagtcccttgtggcagagaatacagagagtaaatcagcgccattcagggggctcagcactgagagtggacctgaagcccccctgtctaggagagatgctttagggtgactgctgtgtacccagccctttcagcacatattagcgtattagtctgttctcacaccactataaagaacttccctgagactgggtaatttataaaggaaagaagtttaattgactcatagttctgcatggctggggaagcttcaggaaacttacaaccgtggcagaaaagcaggcaccctcttcccaaggcagcaggagagagagaagagaaagccaagggagaatcatcatggatcatggattggattgaatcatgggtgtggtttcccccatgctgtcctcatgatagtgagtgagtgttcatgagatctggtggtcccttatagaaccatcacctcggccgggtgcagtggctcacggctgtaatcccggggctttgggaggctgaggtgggcggatcaggaggtcaggcgatcgagaccatcctggctaacacggtgaaaccccgtctctactaaaaacacaaaaaaattagccgggtgtagtggcgggtgcctgtagtcccagctactcgggaggctgaggcaggagaatggcatgaacctgggaggtggagcttgcagtgagccgagattgcaccactgcactccagcctgggcaacagagcaagactccatctcaaaaaaaaaaaaaaaaaaaaaaaaagagccatcacctccctccctccctcaacacatggggattacaggtccctccatccacatgtagggattgcaatttgagatgagatttgggtggggacacagccaaaccatatcaattagaatacaaacaccttgacagaaaacagctactaaaacggcatatctaagggattttgaatatgcacctatgcaaaggctagagatgttctccaagtctataagggccctgaaacttcagtgtattgagcatgtgtggggtggcagagggaaagatcaggggaacatgaaagagactgaactggacaagaagcgatgattttcctgcatcagtcaggcagaaactgaggaaaagcaacaactcatgcattattattaggagcaggtgcacccaagcatatctaacatctgtaaagagacacctctgtcattcttaatccagaaaacaggttgtatcatgttcaataagtgctttcttttcttcaggggaaatcaggcctcctcacattttttaaaatggtctggactgggtagactctgcctgtataattacagtcaaaaggtcaaaattgtagtgtctcttgtggataagtccaagttttttatagacagttgctctattcaggctagattgaatatccccagccaaaacctttactatttaaagatttaaacaagcatgagccacaggcaaaggtaagctgctttgtgactcagcaaactggtccaagtgttctcatctctgcttctggaatccagatttctcaggtttagaaaagtcctaattagctgaacttaataacgtttacacaaatctccactgctgtgtaagcctcttacagcctgaggacagaacataatcttacataatcactaatcttatcctacaatgggcctccatctcattagatgcaattgccctgtgttggtggcctggcagaaggcaggcgcttgctctgtgtgaagattccagccagagcctgaattatgtgagctgctggaaagataccttgggaaaacagcataaccacttccataattctctcccagactcagtcacataggccaggattatttactgaggagtaagatttggacccattttccccttgacttacttgtaaatactctgggtgtcttcagagattctttttgtctacaccttcctggacacctccacttgctgtgatccaccacctgtgtcatcaggattcagtggctttgatgccatatggggagcttgggccaaggcatgactaggattctggtctcctgcactgaatgtgtacaggtgttccagtccaagcctcaagcttagaggaacatatccactgtttaccaagccccagcacttcccattctgtagactataagggccatagacaaagagacacaagtttacagaagtattttccatcattatgaatatcataaggtatttttggcattcactttattccaaaagagaatctcattagaacattccttactttaatgaggtcaaaaaggaaagcagaatgggccttatttttcacataaatttatacatcaaatagtcagaggactagaaagagcctcaactctactcagtccccttgcaggcttaggagctccaaggcaggcccaatgaccccacctaccatcactgcactgtggcagaagtcatggtgagtcacttctgaaattaggttacagaagacattgtgattccatcttctctctttctgtctctctctttcacacagacacacacatgcatgcgcacacacacacacacacacacacaccttttctcagatcactcattctagggaaagccagatgccaggtgataagcagccccagccccatggagaggcccacatggtaagcaactgtggctcctgccaatagccccgggatcttccagccccctcaggtcttcaggtgactgaagtctcagccaacagcttgcctgctcatgagaaactgagccagaagtgcccagctatacccagaaccccaccctcacaaaacgtgacagataattcatgggcattgtcttcagctgctaggttttagagcaatgaggtaccaacagacacctcgtacaccaagcttatggggagtataagcaagccatcatcacactccatgtcacgcagcatttgcccaattaactttgccactttgatctccttcactcattgttccctgcccaaatccaagagttctgggggccaaagcattaagaaatattaacggttggtattctccagacacctaagattacctggcaaaatgtattgaattgccatattaaattcttctttctaatttatatgtttctataaataggatacctcgcttttcaaaacaacccagcatttgaacaggttttagttaagcacaccagaacagaaccaaaaagactgaaattctgccacctaaatataattccagaaacagtaattcctagattgatgatgatatggaactagacttaagacttaaggagaactactagactttattttagcttattcctcttgtgtagaaaatactagataagagccttcctccagagggttgcatctcactcaagtgattagttaagcttattcctacttttgatattctttgctatgaaaactcaactgataagccaagatctgagaattggggataaactaaaaccagcattaagtcttcagtcaagagctaactctccttctccatcttaagaatataaaacaaaataaaatctagccaaaatgcttaaaattaaccctgtgccataagaaatggcagtgttggcctgccacaactagaatggcctcaatgtggccatgtggggccgcttctcccagccagggtctgtgtgcctgcttctctttcactgctgctcctagatgatgccatatgaatgtcctaattataaaatctatgtaggtcagcacgcattaaaacccttgtctttctggctggccagcatgttcattctgtcacagaaaagagatcagactaatttgacaagtcttatttttcacaaaactataacatttgtggaggcttttaaactcaatactgatgtttacagacacaaaattttacccatttttaacattataaatatataaaatctaaggtagcaaaaggtggggcagagatggtacttttatggcatgaatataatgaccacatgatttttaagaatttttcatttttatgcctggactagaaacaaaagttattttatacacagatgatagagttttctcctcaaagtgtgatgggctatattagaatcaccagcatcatatccttctaaagagaaaaaaaaataacagcaagaacatgtttgtctaggcccctctgttttctatggtgactaacaatttcatcttcagaaagtgcctataatttgtagggtctgtattatttcagaacctcagcacatactaactacaactggcccttgaacaatgtggagttagggatgccaacctcccacacaccgtcaaaaattcacatataagttttgattcccccaaagttaactattaatagcctacagttgactggaagccttgcctttaatataaacaacaaattaatgcatattttatatgttacatgtattttatactatattcttaccataaagtaagctagagtaaagaacaggttttaaaagtcataaggaagagaaaagtgtttgcgattcatgaagtgaaggtgtatcatcataaaggtctttatccccatcatcctcacgttgagtaggctgaagaggaggagttggtcttgctgtgtcaggagtggcaggggcagaacacacactgaacgtaagtgcgcccgtgcaattcaaacctctgttgttcaagtgtcgactgtattttaaagctactaaaataaccttgtgagatgctggctctgtggccactgtgctgtttgctacacaaaagcaatctcagtctgtacctcacacagttgttctattctgatgttccttatttgaaattggataatctcagtatcctttcagaaatgcaaccattgaatgaactgtggactacttcatgtcttaggattctccttgtctttgagtccctgtggcttcacatgaaccaaattttgccaagctcatgcctccaatctctgcttcatttcagaaattcactgagtcagtggcatgattgtcagctttggtgagctggtggggaaatgaagatggtaatgcatgtaatgtatgaattaggaaaccatcagatattagatactttggacatgatagctaagaaatgaaaaaataataccttcacagagaaagttggaaatggacaggaaaaatcatacacagtaggtcctcaaataatggtgtttcttcaacatccttttgttataacattgatgataaaggaaattgattcttggctggggcctctgtatggagtgaacacattctccccaggtctgcgtgggatttcctccaggtactctggtttccctccacatcccaaaggtgtgcccatgagatgaattcgcaagtctacatggtccctgtcggggtgggggagggtgtatgtggatggccctatgctgctgagataagttctggccacctatgaccctgaattggaataagcaggctgaaaaatgaatggatgaatgaagtgaaactattgtcaatgaaaattcatataaagtatatgataatcatacaaatgcatggtaataaatgatcacatggtgatcctgacatgtttgtgattgttagcttttgaactgtgtggtggtcggtgcttcttatgaattttgatttacaaacatttattctttggtttaacccacgaccactatgaccgctgttactcactgcttcacagaaaatgaggtaaatgtgtatcttgcttatttttattaatttttcttaaatgtatgcataggttacaggtttgttaatgtctaatattagaagagtttggggttttacttagaagtttggtgaagttttgtacccagaaatatgctgtaaaaacttaattcttgttggtaaaaattagcctatgataaattggttttttctacgtggttttgcttaaagttgcagttccgagaacctattgacagcattaaacgaggacttagtgtatgtacttactgttttcccagtgtaaatgatactggacttttggacctgctatcaactacctttgttttcttagaaaactcacttcgcatcactgaaaaccatcttcctcatttttgcagtgctgtcagtcaatttgctctcaaaaatgtgtaatggtttctacggacaggtctgagagctgacaaatgatggataatctatctctggtctttttatggaagaaaagcagcagtgaatccacttttctcccactttttagtgctctctacttcatgccctgccatttccataaagatctaccttactggcccagaactaagctcggcccaccgtgacattattaatattaaaacagaccctcttccaattagcacagcacattgacaaagcatttgtggggctgctccatggcattgcatcaaaaatcctatctatgcaaatttataaaccgattgacaagacactttgtctaacaggttcgttatttgtgtccggagcagtcagctgaaaaggtgcattgtgaaagctccattgagacgcctcaggctcctcaaagtgggcagcttttttttttttatggagcaccgcacacagatgagtaatgaccgatctgaagtgaaccaagtgaggtcatgttcgccgcaacctgggtctgtcaaccagctgctaaaaccatgggttgcatgtcgctcctagcaccaagcaaattggatgggcctattggctgtgtgtgatctggagtcctcaaatgaagggtgacgatgagaacatgacgccatgctctgcggtgtccaatctctacaggtgcaccatcaccacgcaattcaataaagtcttttgcataaaaagatacatatgaagatgatgttgggaatgttgtggtttgtgacatacaaagatgaaacaggccgggcacagtggctcatgcctgtaatcccagcactttgggaggccaaggtgggtagatcacctgagttcaggagtttgagaccagcctggccaacaggcaatatcccatctctactaaaaatacaaaaattagttgggcatggtggcgcatgccagtagtcccagctacttggaaggctgaggcagaagaatcgcttgaacctaggaggcggaggttgcagtgagccgagatcgcatcactgaattccagcctgggtgacagagcgtgactctaactcaaaaaaaaaaaaaaaaaaaaaaaatgatgaaatacaaactatcatctgtcagttggaaagttcagagaattatgggttcttaagcggaaaacacctcgcttcatgaatctgcataaaatccagattcaaaggttgctcaccagacaactgggccagaatcgttagggcacggcacaggacaagctccctggttagcatgttaatctgagggtctgggaaacagtcttagagaagaggaaaggtgagttcccgagatgttttccacccaataatcattaatcaagcagcagaagtaaagccacaatgaaggtctcctgatctcaaacaagtggctcttgttactattttctagcaaacagtgaactgaaagccatgtgggccaaccactctctcctagatattctaaaacgcattccaagacctcaaaaatccagcaaaataccgggtaccaatatcaactttttccaccatagaattactcatacaaaattgtcataaaaagacataagcttctattgattattttttaaaataaacaacttggtggaaactattgcacttctaggcttcccagtaagtagacatctattcccaatgcaagatctgagccaattgagaaataaacaaagaagcaaataggtagaaatccaacatatcatattttaactgataaaataatattaaagactcttcaggccataggattactaagttaaattcacagaatcaagagatgaacccaaccagccatagacaataatgacctggaagcctttcccattattttttgttgcaatgggggttcctatataagggctatcaacttagaggagcaaaggaaagagtgtgtccagcaagctgcccactcgcaaagaggaaactgtgccttccttcacaaattctgccttctaccaaattgcaaggcaactaagggcatggggacaccaggagtgtttctgtgaaaaagcgtcctccacatggagggaaacttcagaagtggaagataaatattccttgtaacaaaactcagttactatcccaaaaatattgttgagaactttgttcattgcattacatagaatataattctttatgaaaatatctgtagtaaattcttacctgatattagcaccagatcagtttcaattataaataatatgaacatatatattgaaaaaagagggagagagagaatttgtcatatgagctgccagaatgtcttaaaactcactcataaaatgtattcaggccttaataaatacactttttggccgggtgtggtggctcacgcctgtaatcccaacactttgggaagccaaggcaggcagatcatgaggtcaggagatcaagaccctcctggccaacatggtgaaactcggtctctactaaaaatacaaaaattagctgagtgtggtggtgcacacctgtagtcccagctacttggcaggctgaggcagaattgcttgaacctgggaggcagaggttgcagtgagccaagatcgcgccactgcactccagcctggcgacagagcaagactctgtctcaaaaaataaaaataaataaatacctacatatgtacatttttccattttttttcttgtctgcaatttgttcccatcttcctcctcttgccatttctttctcctcctgttcttcttcatcgttgtcctcatcaaatcacttaatattctcaaaaattatctacccttgacagctacttgaaatgtttttagtgacgaggtgaaatacaaaataaataaatactgaattaaccttctaaagcatctctaccgtgaccaataatccagcgaagagcattttctaagtgctcaggcacacaacgaaagcgtttcatcttaagagctctaattttcattcaaaatcaaagcaaacatggaacctttccttctgtagtgaaatcatcattgcacaaggtaaccactctccactcttcacatccaagatgtatgagtctgacatatctttccccagctcagaggtcttttgtgatgccagatgccgataaggaacttgtgcctggtgttcacaggcagcacaacgcaacatgccctccgctgaactggctgcttccaccttaatctcttcccacaaaattccctttttagtgatcgtgaaatacacctgccatgcaccctgcagagaaacttgggtcattgtcccagaattttcatgattccccacccctgaatgctgtaaataagcataagtaaacagctgtgtcaacacaacctaggtaagttttcaaaaataaaaatgacaagctctcctcctctgtgttttaaataagactctcctaagatgagtacagcagagagcatttcttaatggtctcctgaagttttgatgcaattggtctaggaccatgtctgggaaccactgctataggcatctggcttgtcatttttaattaaaaaattaatacaagcccctgagtatttttcatgtacataatcatattacctgcaaataaagggctgttttcatttcttcaaaatctatatggatgtatttctttttcctgccttattgagtttagcagtatctcaagaaagacagtctacaaaaatgaaatatacttctgtattttaccaataaataggaaatttcagtttgaaaaaaatggcaattacaataaatctcaagatatgaaatacttagggatacatttatgaaaatatatttaggatctatacactaaaaactatgtaacactgataagagtaattaaagcactaagtcaaaaagaaatattccatattaatgggttggaagcctcaacattgttaagtggacagttctcccaaagttgatatatgaattcaatataaccaaaataaaaatctcagcagatagctgcatataaacggacaagctgcttctaaaatttgccaaaatacaagggacctccaatagccaaagcaattttgtacaatatcaaaggtggagtactcacacaaactgatttcaagacttatataaagctagagtaatcaagaaagtgtggtattaacataaagatagatcaatggaatggaatagagtgtagacaacagatattcaacaaagttgccatggctattcaatggaaaagtacagtctcttcaacaaatggtgctagaatgattgtacatccatagaccaaacaaaaattaaacaccttaaaaaaaaactcaatcctttcctctcactatcacatgattaattcaaaacagtgatcaatccaattgtaaaatggaactataaaaaatctgaagaaaaacattagattaggcaaagatttcttagaaaacacaaaaaagcataaataaaaaaagaaagaaaatggataactgaaaaagtttgctcttcaaaagacactcttaagaaaataaaagacaagcacaaatgggaagaagatattttcaaaacctgtatctagtaaaggacttatatccaaaatattttttaaagtgttacaaaaattccataataagaaaaataaaaatcccaatatgaagtaagctaaagatctgaacagacatttcactaaataagagataaatgaaggtggcaaataagcacatgaaaagatgctcaacatcattagccattagttaaatcgaattttgactgaagattgctatagctattcagggtctttagtggcttcatataaatattaggatttctttccgatttctttttttaaattattatactttaagttctggaatacatgtgcagaatgtgcaggtttgttacataggtatacacatgccatggtggtttgctgcacccatcaacccctcacctatattaggtatttctcctaatgctatccctcccctaaccccccaccccctgacagaccccagtgtgcaatgttcccctccctgtgtccatttgttctcattgttcaactcccacttatgagtgagaacatgtggtgttttgttttctgttcctgtgttagtttgctgagaatgatggtttccagcttcatccatatccctgcaaaggatatgaacccatccttttttatggctgcattgtattccatggtgtatatgtgccatattttctttatccagtctataattgatgggtatatttgggttggttccaagtctttgctattgtgaatagtcctgcaataaatttatttccaatttatgtaaaaaatgtcattagtatttttatgaatgttgcattgaatctataaatctctttaagtaatatgaacatttaaaaaatattaatttttctaatgaacacaggatatgtttccaatcatttgtgtcttcttctattcctttcatcagtgttttatagtttatagtgtacaaatctttcaactcattgcttacatttattcttaagtattttatattatttttcggatgctattgtaaatgggatagtattcttgatttctttttggatagtccattatcagtgtacagaaatgctactgaatttgtaggttgattttatattctacaactttgcttattagttattaataatttacttattagttataacagtttttggtggaatttttcaggttttctatacttatgtatacttatgttgtctgcaaatatagaaaatctatcactttccaatgtgggtgattttctttctttttcttgcctaattgctctagctatggcttctagcactatgttgaatagaagttgagagagtaaacatcctcatcttgttcctgatcttagaggaaaagctttctgcttttcactattgagtatgatgtggacctgtaatatatggcttttattgtgtgaggcacatgtcttctatacctaatttcctgacttttatcatgaaaggatgttgagtttatcagtaacttttaagccaacccactaaaataaggaaagaatagactttcaacaaatggttctaagacaactgaatatccttgtgcaaaagaatgaagttggaccccttacttgcatcatacacataaggagtaaatttgtatgaccttgatttaagcaaagccttcatgtatatgacacaagcaacaaagcactatagatggacctcatcaaaattaaaaactttttttcatcaaataataccatcgaaaaggggaaaagataactcagagaatgggagaaaatgtttgcaaaccatatatgtgataaggaatgtgtatgtaaaacatataaagaactcttacaactcgataataaaaagacaaacagcccaattaaaaataggcaagggatctgaatagacatttctttaaaaatacatacacaatacatacatggtcagtaagcacataaaaagatgctgaatatcattggtcactagggaagtgcaaatcaaaaccataatgaggcactacttcacacccactaggatggacaaaataaaaaaatacagacaataacaagtgccgatgaggatgttcaacccatacccattatttgtgggattgtaaaatggtgcagcggcttaccaaaacagtttggcagttcctaaaaatgttaaacataggctaaccattgaatccaactgtctcagtctggtttgtgccgctacagcaaattatctgaggctgggcaattaatcatgaacagaaatgtatttgcttacagttctagaagctagaaatttcaatatcaaggtaccagctctggtaaaggccttgttggctacatacatcatcgcatgctggaagacaagaaggcaagaaagggcaaaaaatcaaagtcacagccccaagctcttttcgtaacccacattaatccattattgagggctgagctctcaagacccaaatacttcccctttgaccccacttcccaatgctgttgcatggggtattaaatttccaacatgtgctttttgggggacatatttaagtcacagtaccaactattccacccccaaatatatacccaaaagaaataaacatatgtctacacagaaaagtgtacataaatgttcaaagcagtattcattataatatccaaaaagtggaaataattctaagtggtaacatgtatgcaatggaatataatttagcaataaaaggcatgaagcactgatacatgctacgacctggatggaccctgaacacattacgctaactgaaagcagcccgtcacaaaagaccacgtaccagatgattccatttatgtgaaatataaagagtaggtagatccacagagagggaaacggtgtaccaaaggttaggggggtggttcatgggagttgctgctaatgagcatagggtttgggtgggggccaacgaaaatgctctaaaattagattgtagcgatagttgcataactcatgagtacactaaaatgttttattgtacactttaaatgagtgagttgcatggtatatggattatatcttattataactatagaaaaagttgtatgtggtgcttatttttatactttccaaaatatagattatgaaaaataaaagtaaaaggggctgtctactctcctaccaccctcatgctctatgctgttctgattgttcctccagagagaatgagagacagaaacagagacagagaaatggatagacagaggtgtaggcacataattcgatgtagatatttacatgcagatatataaataaaatgtaaagaattttgctcattctttactatccactactgtccagattttgccctttgttcctcataatctaggtatgagctcccccttctcatgcagaccccagcacacctgctgactccccgataaaaatgcaaatgtgaaaagcactggccaaaaagaaaacaaacattatacaaatttagtgaaaagggggcaatgttaacaacatagaggaggcaatgtaaagaaataaaaaagccttagacatttctcttgatctaaaatctctctgtgccaaactatcacaaaaggaatagggaagatttgagaaaaagggacaaaaatgagaaggggattttatttcttatcattcctctgtggagcacccccagttatgaccccatttttagattttcccttgaaaatttcgtttattatccatttattttgaaatgcagcctccctcttcctttgaaaaccagatgggagacacctgaagatgtccttgttcttattcatatttatatccacatagcccaaatacatggggccccaaagtatcaaatggttgctgaatgaatgtgtgaatgaaaaaacgaatgtgtggaaagactgtgtaatcttaaaatggtcaaaataaaataaccacttgtccattttcatgctgctgataaagacatatccaagactgggcaatttacaaaacaaagaggtttattggtcttacagttccatacggctgggcaggcctcaaaaccatggaggaaggtgaaaggcacatctcacatggtggcaggcagacaagagaagagagtttgcgtggggaaactcctgtttttatataaccatcagatctcgtgagacttattcactatcatgagaacagcccgggaaagtcatgctccaatgatcccattacctcccattggatccctcccacaacacgtgggaattcaagatgagatttgggtgcggacacagccaaaccatatcatcactctagagtggagagtgaaacaatgacagattttatattgttatttctactagtttgacatgagctggataaaaaatattttcataagtaatgaacattcattcattatctcttgaaagtaggaatctatcatccattttctttatatactcagtatctgatacagtgtctggcctatagaaggtacataacaaatgttttttcaactgaagtactacttaatcattatctcagtatcccacgaaaatcgcaaaaacattaaagtccagatggtcagatgacctctgcttgtagaggaagatccacatattgttaatgaaatacgctgtgataaaatatgaatttttccttgtgaattaagtagatgatctcaggtcaaaaacagagtggctacttattatttctgtcctatagcaagttttatttttattgtttaaagtatcatgtcaataggtggtgatgatctagctggaaataagacaaacattaaaaattattttggaaaagaagacaatttacagattctaaaaactgaatacttttatatagtgtttttagtgtttatatatagtgtttatgatcatatacctagacagtaaaaaaatgtagcataagagagacaaacacttttaagtttaacccaatctcctctaaatacatcatttgtttatttttttattttttattttttacaatatcacatataatttccattccatataattctttttaaaaaatattatatagtactttctttattatgatatgtattttttattttattattattatactttatgttgtctttatccagggttgtcctcagtaaaaactgagaaataggaagactgtacttgaatagagggagctggggtttcctgctcccttcttatggtaacctgcgctggaacagtcactcactaagcctgtcctcttcaagtctggcatccttccataagcatgaaatcttgtgaacctcatccttcttttcactgcttactcatcctctgtctcaccctttggggaccttctaggattgctttgctttccaaaatgatgactagcttctgctttgtgttcagatatcgtttgagaataatggctcatatgttataatatgttaatacattatataatatggcattacattaaatagccgcaatgcttgcaatcacagcaacagtgcagcctcctgctatcataaatcacatttattcagcttcttttggagctggtccagtggcaagaggaaaaaaatctaggaatagaaaaaggtggcaaaaaacactcttaaaacgattgtctgatatatgcttcttcaaacattgtttgacccatgcaatggccaaattcttttctaagattttgcatttgcttcatattggtggtggctataagaaactttttaatatgtgtctcaaacggtagataaaaagaaattgagtcagaattattatctgcaataaaagcagctcagggtgaggagggctctgtagctggtgaatatcgcagctgcctgagtaagcacataggatagcaaattcttttagagacctcctaaaatgctgttacatcacatggtgcatttgttcttgtgaccaggtcagttttcagttcaagtaattatattttgtggacctaatattcctgatgccattccagttttagaatgtactgttggcttcttcaccttcaggaaaactcctagcagacagctgtgctgtactgttgacaccacgggctgatcttcataactgcagtgctcagacaatgagcagttcatcaagacacagagactgctttcctttgcaagtcatacacataggaaatatgaataattgccaccggaagaatttgtttccgtcttatttctaaagcaaagcattttctgtgttttcgctgtttgtatacatttgctgtttactatattaaagtagtttatactgtagcatggggggaaaattaattgatagagatttcagcttggtttttgaccatccaaaattcttaactcagacagacatttcatttttctaaactggacattctgcagagataaatgaagacagatggcatcacctcgaagctggttatcctgatgaaagatctcagggagtcgcagctgtaagcaactgtgaccctttgacatcttacatggagacaggtttggagagagaagggaggcagcatgttcacccagctgcggctctgatatgaatgctgacagcgttgctgggattattttttgtttaaactctgcatcccattagttctgatatgaaaagctgatcttgtgactgtaatgtatgcacgtttctgccaccaggaaaaagcacagtctgattgagcaaggtagaatccaacaccattcagcccaaataacctaaaaccccaaccctgattgtgtcatgtcatatattttaagaacccagtccaggctgttacatcaagtaatatcgaatcaacagacagttaaaataatgacaatggggctatctgaaaaaataaaagccatttggcccctgtaactgtcaggctattaatgtagaaaatgaatgtctggggttgttttcctgacactggagaaacattccaatgagcaatgataaattggaaggtgaggggaaaatctcttatctctacatagactaaaaagcagttgacaactgttcctacattctctgtgtgcagtcagataaagagtgcacgattggtttcccctggaatcttacactgagggtttttgcctcattcggagtgaatatttgctcagagagccaaaataacacagataaacacatggaaatacatttgtgtaaaatatggggagtcgacaagagtgaggtcctttagaaggatttagggaggggactgggaaaaacagggagcacattgtgtggatgttctcatgaattatttttaatggcccagactgggaacacttttgaatatattaggatgggcattaagtagaacagtcaatttctttcaatactgatgcagtttatccatcaacaggtagatgagatttcaatgtgaaatgaatcatgaaagttaaagtaagtaacatatgggatgttaaaattaattatcattctactcattagagtgcatataatgaacaaaacagtcattaaaattatttatcaaattgaatacagaaaataaaatgcacatttactgggtgataatattttcatcaatgttatcaatcaaaatatgtgtcctctcttttgcctagaaaagagtaaaaataacataaatagtataagcctctgtttcatctattaaataagagtaacaatatcgtagatcactgtcatgaaaattagactaattggatttattccaggcatttgtttggtgccctgctatgagtgttccttgtcttgtgccctccagcagacagcatggtccttcccacatcctgagagcctcctggttcctgccatggctccctggctaaccctgacatgtgcaggcgactctcttaccctctcctaacacgagtttgctcagtgatcagatttaagctggcttttaagaaactgtgatattaaacatgttaatctggtcttccaagtcagaatttctaatgaggacaatgggttccaagcactcctcctatgttctaaagagaaacacaagccacagcaaacagggcagggacaagatgaaaaatctcgagctcttctcatcccatgttcaggagattgatcaagaagggaagaaaaacactgatggtgaagattttcatggagagtgttcttaagagtacagcatgtcctctgcccccacccaggctcaggttgtagtcctcctaatccaaaccaggtgaaggagagcatggccttcatcccataaaatttaaaagacacatagactgagtatctgaccctaatgagaaaatatctaaaagcaacaggtggatggagctgtctgtgatgaactgtgagaaaagatgaataccttgacagtggctggccaagtgccccacatgggccagtgtggtcgccatggacagtagcccataaactgtctgccataaagaggccatttcaaaccacagccttccagggagaggtgatatccacagaaagggtccatgtgaagtgcacctcaagatgcagacggtgagaggagctgtcaccttgagaagcagcaaggggatgagctgtcttgaaaggaccacaagtacaccctgcaagtactaaacaccagagcatcaataccagattgcaagggcaccagtcaaccaagaccttgacattctcagaactcttctcctctcccaattcatagcaaaaagataaaagcaaaccataggttcttcctcactataggcttctgggcctgagtcaggccagaagatacactgtataataatccacttaagtatttttaaacagcaactgttgactggctaacactcctgtgagtcagcaatttggacaggtgcagatgggctgctcttctggtcctctctaggctcactcgtgtactagtgctcagctgctgggtcggctggaggcttctggatcttgcatggtcttggctgtggtagctcctctctcctccacacagtctctcatcctccagtgggtagcattatgagggttggatagtaaccccaaagtgctggcagaagcacacttggcctcttgcttcctggactcagaactgaaacaacatcacccctgctgcattccttgagtgagagttagtcacagggtcaagcctgatccatggggtagacaaacagatgtcatctcttcatctcttcatgggaggagcttcgagatcacattgcagagccatgaatccagaacaggcaatatttggggccactcctgacatcagtaccatggttgctgacgcatggtgaacactgtgggagagacgagcaagggcctgaccatttaggggtatgggcctgggaaggagatggagtcttttttctaagtgcagtggaagccactgtacgttagtgtgatttacagttttgaaatattacttagcgatgctacatggggagtaggttgcaaaagggccagagcagaagcataatgataagttgaaagcaattgcactgatacaggcaatgtttatttgacggtgtcttggatgagcagccacagagctggagaaaattcaattaaaggaaatattttataagtagagcaggaaatactttataaagagactcataggactggatgatgtattcactgtaggaggctctggaaagagaggaatccaggaggatacctagagctttatgtgctgggtaagttgtggtacaattcactaagaagtgggaaagcaggaaaggagctgtgggtttagtaaagcaattcgatctctcttttgtacatattaagttcctgatgtctcttattcaaatagcaatgccaagtaagcaattaaacttatgtgtctagaggtcatcagagtgtttagaactagagtcatcagcatactcatattttaaaacacgaaaacgtatttgctgacccatggagagaatgcagatagagaatgaggtccagaccaaactttataaaaaccaaatattcagaggttatctggaagacaagccagcacacgggaccgaggcggacccagtgaactcatcaggcagtcacaaatgaaaggaaaccttggcaccactgacacattgagcaagagaacactttttttgtgaggactccctggcctctacacaccagatgcaggagtactcccttcaccatgagggacaaaaaaaatatgtctttagacatggccaaggcacccctggagggcaaaattataaccactgctctagatgaaagaagttgccaactgcatcagacacgactgaacaatcaactgtgcagtgataagaggagtgaccacaggctctggccatatggccattgtgtccccacagaagctgtttcagtgtcacattgagaaaggcaactggatcagattgggttgcagagtcagtaagaggtgaagaactgaagataaaaatgtaggcagttctttagaaatgacttgctgtgacagagaacaattagagctttagctggaagggcacttgaggtaaggaaaggggcttttcaagggagatgttagaacatgtttgcatctgataggaataattctgcagagaggaataattagtagttcaggagattgtgagtggaatacagagtgcaaaggtcctgaccctggagaggctcctaacacaggtaaaaggggaggaacagaggctgcaggagctgcaggcactgctgtggctccggttgtggcaagatgacggggtcccagcagaccactgctcacaggggacttgtctttaagaggggccagattcactctgagaggctgagtctgcaattcaaggctttcttctaattctccccttctccagctatatctgcagcagtgcagcacgaacagtatctgtccaaatgcacaagtcatttctttaactaactaagctctatggtagctttgaacagctttattcagaaactttctgggctattttcctcatgtttgcagttccccactttacctgctgccacacctttcccctttacaggcatcccttcctaatccacgatcaagctggtaccaccagcccacctgagaatttctcttttattccttctagtgaacactattgactgaaagctgaccgggttagtataatcccccattttacccatacctttcttcatgcaatagcaaacttaaaatttaaataggttagagaaaatgaaatagtagggatattgtatttgccagggctctccagggaaatagagcccctaggatatctggaaagagggttattgtaaggaattggctccacacttagggaggctgacaagtacctctatctgcagttggcaagctggggacccagggctctcacttcagttacagcctgaaggcaggaagggccaatgtcccagctcaaggcaggcaggagaaagaattccctgtttctcatgggaggtgagctttttggatccattcaggcctttgatgaatgaggcccactaccactgggaagggccatctgcttcactcagcccatggattcaaatgttcaactcatccgaaagccccttgacagatctacccagaataatacctgacccaatgtcaaggcaccctatggctcagtcaagttgacataaattaactatgacaggtgttatgggagaaaaggagcaaactggaagggaaacaagcccaggagttgtctttcctagagagatgccccccaattcagtcactggtaccacctgctcagagcttcacctttgcaatggaccaattgtttacggctgcctcaaattcctatgttgaaattctaacccccaagtttgatgatataggaagtgaggcctttgggtggtgattaggtcatgaatggaattagtgtcctcggagaccccatagaacttcctcgctcctttccaccatgtgaggacacagccaaaagtgggacacctatgaaccaggaagtgagtttggccaaagtccaaatctaccagcaccctgatcttggacttcccaggctccagataaatatctgatgtttacagccacccagtctgtggtgttccgttacagcagtccagctagaccaagaccctgtgcaggtccaaggcaggatcatgtcaggacaaagatcctgctcagggcccgtccagcctccattcctgacttactgttccatccaaaatattgcagtgacagcctgtcaatatattattataatcttatgagcctcttcacctgcctataatataagacttatttcacagaaactaatgcttctactcatgtaatatatcaggcaatagctatgacatggacaatatcccaaagcaacaggcatctggaaatataccatccagagtaagtcagagagggccatgggccaccctttagggtctattccacctccgtgtttcaagtttcatgtggttatgatgtgagcatgtgtatgcgtggccatggtccttagctttggggttaaccagacctcttttctacccacctgttctgaaccatggtcttgttcccaccatgctcatgggagtccttgtctcacgacgctctggttccactgataaaacacagactcagtttgtttaacgatccatttggaaatagtccttcaagtgattaatgacagccgacaataagcataagtcaaattaaatgtcccttcaggtcataaaaatgaggttgagagtcacagatattcctcctccacacccaagtccactgggacctataaccaccaggtcaattttaccagtgttcccatcagggaagggaaccctgaaaaccagtagtatatgtgacatgttattcatgccactgaagatggctttgccacctaagccacactttttgcacttttttttgatccactcagtgtcatattacgtattcgggtcatagacattttcctctgtgagaaacaagctggtctatgttagatgaagaccaacaatcatgacagtgttacattagcccacgttctatcccaaagtagttgacaccctgaaaagggaaaatgaggaaaagagaataggtccacatgcacatttcaatgagtcgttcattgcaagtccccagtcacccttcactcctctctctcattcccacatccaaaccatccttccctactttttatgtattttttcatagcgatcgttgtcttttaacatactataatctaggccgggcacggtggctcatgcctgtaatcccagtactttgggaggccaaggcgggcggatcatgaggtcgggagatcaagaccatcctggctaacatggtgaaaccccatctctactaaaaagacaaaaaattagccaggcatggtggcatgcacctgtagtcccagctactcaggaggctgaggcaggagaatggtgtgaacccgggaggcagaggttgcagtgagccaagatggtgccactgcactccagcctgggtgacacagtgagactccgtctcaaaaaaaaaaaacaaactataatctaaatatattatgttttcatccctttgtgtctttaagccactaccacctctattagcatacaaattcctggagggcagcattgtctctctattctcttagctgatgaatctcccatgacaagtactgtgccgggaacacagttacttctccataaagtgttgatcaaatgaatggactggatttttctcaataggtaaacgtttttgggggagaacaaagtaacagaccaattcattcaatctctcttctcttagagagaagcgagaaggccaaggaatttcttctcttacactcttgtttgccttgtcccttctcctaacttctaccttaacatttgcttccaactctagtttgattgggctttagcccagctgtttcctgaggatctatttgctactggtttatattggatgcaattaagttgccttttaaaaattatggtttctgaccttatacccaatttctaactcatccaaaatgtctgttttatgttacattttaatcctcaattctcagtactggccgttcataccttgttcaagtacgacttgagacttcattcgacttcacacagccctgtgagcacttgagtggtaacaaggggtttctgccattcatcctagttgaatcacagctaagtcacaaagccatttggactcattgcaaaacttttttctctaacactgagtggcactgaactgattatgagcatgtactcaccctgaccacatcattacatgattgcaacatcctgaacaaactcattctgcagcaccattgccacgtccacagaagcaagcattgcagccctgtgtgtagaccatactgcactgtgatgtcctgagcccgcactcaagaacctcttctgattcaaacctggaaacacgctgcttccctacctgactgcccgtcactgattttcttgtgtaagtagctttcaactgcacttgtgagatagaaagaaactagagatgatttctcctctgaagacggaaccctcaggattgctgacacgtcattcttacacaccatgtcagcccatatttcccacccctgcaaaggacattgcatatcatctgctatgttaaagtatcccctttttctatcacagtacaaagaaatcgcaaagaaaaaatatatatagattaggaaagtcacaggtactcatctcatgcaacttatttcatctggatggaagtgaactctttcagagtcttccttttcaaatctatcagtctaccatcacagtgccaaagagctctaggaaattaaaaagatattaaacgtggcttttgtcctcaaggatcatacccagctaagagaataaagcatattttcataaaaagttaccttctcataaatagtacaagctaatataccatgactcagagaaaagagaagatgaccttagtctaaagtgaccaggacaaggacaaagagaatagatgagagggggtctgtgccctaaaaatcagctcaaattgaactgatagaatggaggagagtgagcattcagagaacaactgcagagttaggtagcagggatcagtgggcatttgacacacagcatatggctgcttgaggtcagaggttcatcagttcattcattaattaacctattacttcaataaatgtattgaatgtgtttaatacaatagataacatgttaattgggtacaagaaacacaactgtgaaccaaaacgaggtaattactgccctcatggagctgacattttaggggaagaaacagaagccagaccactttgctaattaataaattatatcttgtgttaagtaagtgctggaaaggaatgaagcatgttctataaaattggagggtggcggatggggggacactccaagaggagtgctgggaacagcacactgggaaagggaacagcaaatgtgaagtctctggggagcaaagaactctctgcacctggataatgacagtagactggtgtggcttgcaccgaggagattttgttttctttctttctctccgtttctccctttctccctttctctctttcgtttctcttgctctgtcacccaggctggaatcagtgacacaatcatggcttgttgcagcctgacctcctgggctcaagtgagccttctgcctcagcctcctgagtaactgggactacagcatgcacatgttgcccaggctggtctcatactgcggactcaaaggatcttccctccttggcctcccaaaatgctgggattacaggggttatccaggacacccaataccctagaggaggatttgagaagcacagagtccagggcagcagcaggcacagccctgccccctgccggaacgggactcacacgtgtttttattctaagagtagttagaacactttggactattgtaagtcagaaagtgacataataaatgcatactttaaagagatcattcatgttgataagtgaggaatagaatggagcggcacaaatggaagtcaagaaaccagtcatgtgactagtgccaaaatttggaggacagatgtggactttttgaggtggtttccagaaaaaaggccatcattttgatgttagaagtaattcttgacaacatttcagcataagacaaacccttttatttttctcaagtgatacatctgactgtatctgtagacacagagaaagatcaagtggtgagggaaaattttcaggtaaaagagagacaacaggaaaaactaagagagtaagatcttaaagaagacagagatgccaactggaagggtcagcctttgaaagaggatgcttcctgctttgagaggctgggaaaggaagacagatatcgtctggccaaggaaagaacatgtgagtttgtggtacacccaggaacaaagtttcatgactttcgtgctgcaggacctctatccattttttacctggcatctctggcctgtgacaagggggaggcacctgtgttgtcagagcatgctaaaggtcaacaggccaagtccatccataatttgcagagggtaataaaatcagatgcggaggattgaaacgagaaggactgttaaggaatagtgatgaaatcactttctggaatcacagaggacagccaagagcttgaggacctctcttctccatgtgtctaaaaatgtgaataggagacaccctgtaggaaggagtctccaaagtgggatagcagcatggcctggccgggtttggattgcaagaggagcccaggctacaaagggtagacctgagatgcaaacagagcagctaactcaaagccagactctttccacaaggagacggcgggaagagttcatgccttgggcagtctttgtagtcagcgggcataagtgaattcagggacttgcaaatggtgttagtttcagagcttatatgagtaaaaggagaatttagctaccaaaatttgtgaaatggaccaatcctaaatttctttgaaaaatcactgtaattgcctccataagctctgaccaaggtcacagttgggttactctggcaaggtagaaaataagacaaagcaactaggggttcccagaaccatgctcccagcgcaagctctgtcttcacccacactcaggttcttctgagttctctctcacctcagttctctaagccctcttcccttacatttctatccccaactttactattccctaagaaacgagagctggtgcaccccctctggagagaagccagatcccagagccctccctgctggacggctgcagtagaaaaatagcacaactatgactccgttacatttcgttgacctgaaaacacagtgatctgggggagaaggacttttactgaggccttagctgatcggcactctcagtaacggggcaataaatgggttccattaagatttttgagccaaaacaaaaccttgctgggatagtctgggcttgacattaaggaaatctcagctcagaggcgcaatgcagcaagtggaaggtctcctcacatcctcccggcgagggatttcagggtcagagtcccatttcagcctagtgtacgctttgtttaaatcttttgcagtctcttttgagcttagtcattcttataatattgctattttttcttcattcaatctaaaattgtggctcctctgaaatgttacaagaaagctccaaatcagaatgctacacaggcagtgtggtggttttggcggtatgtggctctattaagtagagtcaatttagtactggatataggaaaagactaaattagaatcgtggttggcagaaatagtctcccatctggcagtgtaattacatactaccttgacctgaacagtccttgctgttccaagtaccaagattcctttggagaggggaagaaagaaaaatagatcaaagtttcgaaagtatattatttagaatacattctatatctttttgagaaataagctgcatatgtctttttctaatatggtcctctcttttataattaaatgaaatttccagtcacttaatgaatgtgaccactttatggccgggataaacagatgagatctgtgtgctcattttcacccatgacatcagacactatttcaactaggacactgattcataccctctttggcgtcctcattcctgagggttttttttcttttttaaagggtcagtcttagttgctgctgacatgcggcattttcaaagactcaaagtggtctttattacaacccttgacttcaccttctatgccaacaggaaattttatacagctgtaacctcctcattagaacagtgccaggaagtggttctggcgtgatttgatgttgccacctactggcaaaatcagtcctgttcgccttcttgctttatttatttatttgtttgtttctgttctaacactcagcatttcctctaaatccataaagatttagattttctctatctactttaaaactacaacaagctggacttataatccaaaaacatcaccatttgaatctctgcaaaccaaaatcttgccacttcggggtgaaatcatcaaggccaggcgcgaacctcatttttactgtcaaatgcaggattgtcacatctatttgcagtgctcccaggccctgccccacatatcccccgatccagattgacagccagggcctcccctctttcatctcagtctccagactatcccagccataaccagaccctgaacgaagccttgtcattcacctcaaagggctactgcgctcacaggcaatcaaatcattggattgcttttaaaaagaaaatgacactgatcgtcaagtgccttatgtacatctcattggaactgcaagctcaaattaggctgtcagaatttcactcttctcagtgcctgtgtgtcaagtgacgcaattagctctggagaataaagaagaggcttgtcagcgcgctcggagcctctcttctcagtcctgtcccttcacacggtgcctgacttaattcaagttcttttcatgcttgaaggtgtgtgtggtgtgtgtgtgtgttacccttcaaacttcaaaatgatcacaccaccgggaagagtcggggtaaaattggtgtatttcttataaggacccaaatgcttttttttttcacttcccttctgcaaatgagaatttatcaaaggctgagtctcagtcctttgtgagtaaaacaaagaatgctgaaaaacagttgtcaaattcatgttgaaacgggaagggtcaaagcttcagtaatagtgacccagcacgactaaatacctacccaacctgatggcttcaggatgaccgagagcaagctcttctcagacggcagcaaagcagacacatgtctatttaatgctgaatgagaatgagggtccccttggcgccatgtcctgccttcgacagaagtgagtgtgacatctgatgctttagagaacagttagacacacactagtccacactgagcgcctggaacagacctaacccaatggagatggggtgtgttttggaaaaaacaaagtacatccactcctgccatgaaaattgggattgtttctgattctaatcccaaggactgctagcaaaactcttccagcattagagaaacgtgcaccacagacagggcagcagacacagggcacaggaaaggggcccactgtttcccagccaggggctgcagctggggcagggagctttggggtgagactcagattctgacctccccaccccagtacatccttccttgtgagtctagggcaccagagaggccctcaaaccagcccagcctgcacctgctcagaggggccaccatggagaagccttgggtggggactgatggtagaggcaaagaaatcttatattctgaataaagaatttgaatttaaactcagcaagaataacttaatctgattgtttattttttagtttgtaacataaacgttgaataaatttgtccatttcacccagatttctggaagccagcactgtggaaggagctcctgtgggcttcgattgctccctggatctgcctcccatggacctgcccagccgaaggggtcacagactcccctcgccaccatttcaccctgaccctacaggcagccacagaaaggtacccaggcaggcttctcagggttggcgtgggcatctgcagggagagcaaggcagcaggtgattcaaagccacagggacacacagccctgcaggcagtgccagccacaagagggatggaagagtggccagggacagagagatgccacccacaggtctgtcccagggctcctcagagaacactcagactccccagcgggcagtctcaatgggtggtccatgagtggcaggtgtattgcagtgaaccggcccccggtgggacaccttcctgcctctgcttccctcctggccaggacagagtgtgatgccaacactctttagtcactattgccccattcaggtagcagatgcttcctaatgggctcatggggctgtggcccagtgggaccaaaatctaagcaacgtatttagctccagagagaaacaccgccagcatccctctgctcagtctaccctctgcggtcatcactaggccccagtgtggcagagaaaggacttcaccccacatggccagccttgcttaaatgccttgagaaaataaaccctgaaattagttgtgcatattggctttttttttttttttttttttttttttttttttttttttttttcagaaccatgagagtctcaggtacaaacagaaaggagcaaagatttcagaattcctgacttggttctgggaacaatgtaatccatgcagttatccaggacacaagggccactggctatgagcagcctgtgctcagggaaaccaagcaagataaactcagtgcacagacacggagcaggccatgcataagacagaacagaccacgggtctcaccctatgaaaccaaggcactctaggatgataaaatggggcattaccccataaaatctctaagtcattattttccatttgggggtaggtagccaatattctctagtatatttccgtttttactttttttattttttatttgtaccttttaacagctttgttgaggtatatttaacatacagaatactgcatctttttaaagtgtacacttcgataattttgacaagtttttatactgccatgtacaaggtttcctcctgcctctttgaaattcttccttcccgtcacttccacttcatcccgtcccaagccaagtgcaaatctgctttcaatcattacagagaagtttgcattttctagaatttgatatcaatgaaagcaagcagcatatataccttttttgttcagcttctttcactctgcgtagttaagattaatccattctgtggcatgcatcactagtttattcctttttattgctgtgtagtattccattacatggatatatcacgttttgtttatatactcatgtattaatggatatttggcttattttcccagtttgggatgactgcaaataaagctgctgtggccatttgtgtataatctttgtatggatgtgtgcctctggttctcttgagtaaatacctaggaatagagtttctggctcatatggaaagtatatgttacagtttttgaggaactgccaaactctttaccaacgtgactgtgccattttacagtcacaccagcaggatgtgtgtgttcaggtctccacagcctgatcaaggttggcacagccattccttttcatgttacactttctaatagtgtgttttactgtggttttaatctgtattttcccaaagtctagcagtgttgaacatcttttcatgtgtttatttgccacggtttcattgatttttctcagtgatccatgtcataatcacacataagtaacacttttagttttgctatcacagtttgtcatttatttgcatattcatctgatacagtttggctgtgttcccacccaaatctcatcttgaattctcacatgttgtgggagggacccggtgagagataactgaatcatgggggacaggtcttttctgtgctgttctcacaatagtgaataaatttcatgagatctgatagttttaaaaagaggagtttccctgcacaagttctctttctctttgcctactgccatccatgtaaaatgtgacttgctcctgtttgccttctgccatgattgtgaggcctccccagccatgtggaactctaagtccgttaaaccctttcccctgtataaattacctggtctcaggtatatctgtatcagcagtgtgaaaatggactaatacagtaaatttgtaccagtagagtggggcactgctaaaaacataccccaaaatgtggaagtgactttggaactgtgtaacagacagaggtgacaacagtttggagagcttagaaaacagaaaaatgtggaaaagtttggaacagcctagagacttgttgaatggctctgacaaaatgctgataatgatttggacaatgaaatccaagctgaggtggtctcagatggaaatgagtaactttttgggaactggagctaagttgactcttcttatattttagcaaagagactggtggccttttacccctggcctagggatttgtgaaactttgtacttgagagagatgatttagggtatctggcagaagaaatttctaagcagcaaagaattcaagaggtgacttgggtgctgttaaaggcattcagttttataagggaagcagaacataaaagtttggaaaatgtgcagcctgacaatgtgatagaaaaaaaaatcccattttctaagaagaaatttaagccagctgaagaaatttgcataaataacaaggagctgaattttaatccccaagacaatggagaaaatgtctccagggcatgttacagcagctccttccatcacaggcccagaggcctaggaggaaacaatggtttcatgggctgggcacagggtccctctcctgtgtgcagtctagcgacttggtatcctgcattccagccccctcagccatggctaaaagaggccaaggtacagctcagacttttgcttcagaggtggaagccccaagccttggcagcttccatgtggtgttgagcctgcaggtgcacagaagtcaagaattgaggtttgggaacttccacctagatttcacaggatctatggaatgcccggatgcccaggcagaagtttgctgaaggggtggggtgctcatggagaacctctattagggcagtgcagaagggaaatgtgggattggagtccccacacagtgcccctactggggcactgcctagtagagctgtgaaaagagggccaccatctaccagaccccagaatggtagatccactgacagcttgcactgtgcatctggaaaagctgcagacaatgccagcccatgaaagcagccaggagaggagctgtaccctgcaaagtcacagggtggagcttccccaaaccacgggaaaccacctcttgcatcagtgtgacccggatgtgagacatggagtcaaaggagatcattttggagctttaagatttgagtgccccactggatttcagacttgcatggggcctgtaacctctttgttttggccaatttctcccatttggaatggctgtatttacccaatatctgtgcccccattgtatctaggaagtaactaacttgctttcgatttcacaggtttataggcagaagggacttgccttgtctcagatgagactttggattgtggatttgtgtgttaatgctgaaatgagttaagactttgggggactgttgggaaggaatgattggttttgaaatatgaggacatgagatttgggaggggcaaagggaggaatgatatggtttggctgtgtccccacccaaatctcatcttgagttctcatgtgttgtgtgagggacccagtgagagataattaaatcatggggacaagtctttcctgtgctgttttcataatagtgtataagtctcacgagatctgatgattatataagggggagtttccctgcccaagttatcttctcttgtctgctgccatatgagatgtgcctttcaccttcggtcatgattgtgaggtctccccagccacgcggaactggctcagatggaaatgagtaactttttgggaactggagctaagttgactcttgttatgtttcagcaaagaggctggtggcattttgcccctggcctagggatttgtgaaactttgaacttgagagagatgatttagggtatctggggaactccccagccacgtaagtccaataatcctctttcttttgtatattgcccagtcttgggtatgtctttatcagcagcatgaaaatggaccaatacatgcccaaagtatgattttctcccaatctcaattatttatgcatggaacacatggcaaattattaataataaatcaattgtaagacaacccttctgggtaaaaattaaccaaaacaaatttttagagttctatatccaaatccatttgagagaaaaactttccacacatcaattaatttgtcagcaaaaaagaagtgctttcatttgagaaatctattttttataaaagtcagtttaatttgataacacttactttaaaattatttgggagaaaagttgagcaacttctatactgcaccttactttaaaacttactttcataaatataatctcaaagttgttaaaaagtgtttaatataaattttatttatttttattttattttagattcagggggtacatgtgcaggtttgttacatggatgtattgtacagtagtgaggtttgggcttcaagggaacccatcatccaaatagtgaccattgtatccaatagataatatttcgatcctcacttccccccaactttttccccttttggagtctccactgtctgtgatctcttctgtatgtctatgtgtacccattgtttagttaacacttatgagaacgtgtggtatttggttttctgtttctgagttatttcacttaagataatggcctctagctccatccatgctgcacaaaggacatgattttatatttttatggataaatagtattcaatggtgtacatacaccatattttctttatggacacttatgttgattccattgatggaactattgatggacacttatgttgagttcatgactttcctattgtgaatagtgctgcagttagcatacaactgcaggtgtctttgatataacaatttttttcctttgggtagatacccagtagtggaattggtggatcaaatggtggttctatttttagttctttgagaaatctccatactgttttccatattgtttttcaatccataagagatgtactaatttacattctcatcaacactgtgtaaacattcctttttctacacatgctcaccagcttctgttattttttgactttttaataatagccattctaactttggtaagatggcatcttactgtggttttaatttgcatttccctgatgattagcaatgttaagtattttttcatatgtttgttggccacttgtatatcttcttttgagaaatttctgtttgtgttctttatccactctttaacagggttacttattttttttcttattaattcaagttccttatggattctggatattagtcctttgtggaatacatagtttgcaaatatttttctcccattctgtaggctgtctgtttactctgtggattgtttcttgtgctgtgcagaagctctttaatttaatgaagtgccgttcatctatttttgttttgttgaatttgcttttgaggtcttagtcataattatttgtctaggttgatgtccagaagaggttttcctaacttttattctaagatttttatagcttcaggtctacatttaagtctttaatccattttgatttaatttttgtatatagtgagagacagaggtccagttttattcttctgttagccagttatcccagtaccatttattgactagggagtcttttccacattgcttatttttgctgactttgtcaaagatcagttggtggtaggtacgttgctttatttctgggttctctgttctgtttcattgatctatgagtccatttttgtaccagtaccattctcttttgattactgtagccttgtagtatactttgaagccaagtaatgtgatgcctttagctttgttctttttgcttatgattgctttggctattcgggctcttttttggttccatattaattttccaattgttttttctaattctgtgaaaaattacattggtaatctaataggaattgcattgaatctgtagattgtttagggcagtatggtcattttaacaacattaattcttgcaatccatgagcatgtgatgtttttccatttgtttgtgtcatctttgattttttttagatcagtgttttgtagttctccttggttaaatgcattcctaggtatttgtgtacgtgtgtggctatcataaagggatagaatccttgatttggttctcagcttgaacaagattgaacattgttgatgtataaaactgcaactgacttttgtacattaattttacaccctgaaactttactgaagtcatttatcaagtctaggagtctcttggaggaatctctaatacagattttttcaaaatacttttctgccaatatttttgctttatctcaccaaagttagcatttttacagtgtttaagtgctgaattttttttttttttttttgagacgaagtcttgctctgtcacccaggctggagtgcagtggcgcgatctcagctcactgcaagctccacctctcaggttcacgccattctcctgcctcagcctcccaagtagctgggaccacaggtgcccgccactactcccggctaattttttttgtatttttagtagagacagggtttcaccatgttagccaggatggtcttgatctcctgacctcgtgatctgcctgcctcggcctcccaagggtgctgcattcttattattcttattaatggcagtgttttcaaaggccaattttatcagaatgtaaaaaggataaataagcaaataccattggataaacatttgaatatatatgtatatagtgtatatacgtatgtgggcatgtaagagaaagagaaagacaaaacaaggtatgttttcttttacaataaataccattacaaatgcataaatccagtaaatgcaactttacacatttggaattttctatcactacattacaccataaaaataaatacgttttccccagccatacataaagtcaaatagacattcctagttgtaagacattccaattatatcaataatctaacaagccacaaataatcacatttctgcaatacgccttttgactaattatcaatcaatcagctgtcgtttctctcatccaaacatgctactttaaaaggtgtgtattgagaacggtgtaagatgtgcgtttactatagccatagtaaatataatgctttcgttatagcaatgcaaaattttctggcaaactagagaaatgaattgttcacaaatttaaaaataaagaagttttcacagcaaagccttgaggctatgatagaacaggggttgcgtgaaaggagagtcagagaacatgattgaaagcaaataaggtgaagggaagtgaagagaggtcaattaggtggaaacacacctatgggaggggagccctacaaagaaaactgtccaagtatatttagaaaattaggcacactgactactaaagggaatttccatcactcaactcttcagttaaagggcaatccctgcccatagcctatttaacatcatttttcatgcagggctactgaaagccaattctcaccgtgttactggtcttcacagagccaagttcttcaggggcatctgagataaagatttcttctgtagaaattaccaaaagcatgtgatagcaagagaattccccaaaacagaagaaaataaaatacacagagaatacaccaaaactaaatattaattagatgtaaatgaaacatgaaaatattagaataatagcttcgggtgacattagtatgcattatcaaacttactaaattgctttgtgtgcaattatgcctggtctagttgaagaaataaaatactttctgccagcaggttaaataattaaaagacataattaatgtttttatagaacaaatacaaaattccctaaaacactaatagagtatgaagatcatgagggaggtaaatctatcattgtccataagcatttatttttaaatagctgaaacttattttctttgacatctctttaatgtcattaaatttttgtcttttgaattcaactcagaaatatagaaagcttaagccttggtttattgttcatgtacattacagataaaatttgtgtctaattctggcttacatttttgtcagagtcattttttttaaattgcagcaaatttggaaaatatagaaaattaagaagaaaaaaaaatttacttataagccattgattgagtcagagatgagagccttactttccaataattacatatttttaaaaccatgatttatagttgcttctcaatattttattgtattaaaaaatagaattgatttaatacacagcttaaaaatgttttgttgcatttcaacaccatccttgcaatgtaagtatgcccatctctgatcgttgtcataaaagaaattcctacaattgaatttacagtcaaagctgtgcatgtttgaatatatattgcaaattgctctccagaaaatgtgtactaatttacatggtcaccagcaacatttgaacatgctctttttaacaccttactagtttgcttaataagatatcttatatacttattgctgctatagctccaaactaagtatatttacacctatacttggaatggcaaatgcatcgcacatgccaccccactcctcacagaaggagagatttctaatcaagcacaaacaaaatcatctgctgttgaaatggagctcaccttccaaatccttcccaaggtgactgattctctagacagccactcccaatcagtgtgagttggtgctaggatgaaactattcaccatccctggtatttgagtcctcagtacttctcatgtgagctgctcccactccattgggagatgaagctgtgagttgatgcagcatgaatcaagctgcgttcacccgctgtctgaacaacttcctcccaatagatccccactacttcacctgaaaacccagagctacatgggacttcaggtttttcactgcactgcccattcagacctggcctccttcactggcgctccatgcccagctccatttgtttagttgacaacactacccctgacttagttactatcactaccagcacttgaccttttagatagaaattaactctaccagttcacattagatattatctaggatgaatggcctgatgtatttatgttttaggaaaggattccaagaactcctagaaataataactaattaccagatctgtaatgtttagtccctgcttgcgtgggtctgggagatgggaatacagtaagtgcctaagctgtccctcgtctgacttaagaaccgtcctctacaggactgctgtctatccggtctgccctctctggaactgactataaggactgtttgtgtcttcctgcttgaggtacatctcctggttgagacagacaagacagacacacgtacaggtataataggcatatgactacactacgtgtatcgtactaactgcatccaacatatttgtaagtacttatacacatgcaagcataattacccaattatgaagcatccgtaatgaataccctggcattaactagcagttctttcttgtaaaaataggaaaaaaaaaaataaacacacaactcctagggcttagggattatggcccaggtcctctctctagcagatgcttctagttctacaacgtcctctggcttctcatcagctgtgaatcccttgaggctttgcatgccagacagtgctgctagcggattcacgccagtccaagatgggtcactttcttatgttggtgggaatatagctctagagagcatttgatctttgtgccatgggcaccagccactctgcaaccttgagtatctacgcagtaacatctctctcaactttttcacgaattcctcaagactctagtttaattgcaaaaagtttggaagcttcagcttcagccacgcctttctccattgtcctagaactccaggaactgcttctgtccaaagaggtcatgaagtagggagggcgtggaggggaggtgttttttcgcacaggctcgcatagtaccagactgtgtttgtgctgctaatgccactgcttcctgctgttgaagtcgggtctgatgttatccacacacttgtcagcccaggatgatcctactggtccataaggcccctccagggaggaaagccccatctcttgagatgctcactctgaggtctcaacagttaagcccaatttcctggtgctggcaggagctccttctggttccatgcagagcatttctcagagcaaaagtgagccctggaaggacaggccaacatcagacatcaagccctcactccacagaggtaatgcgagcttctctttcctctctagtgaccatactccaagaagtagaacatcttttcttttaaatcctcaaaagctaaagtatttggctgcacacctgttcacagtcaattgaaacaacttgcctttctcttccctcctaagaaaaatctattctcatccctaatagggggtttcagtccaggctacatgtcaaggatctggcattctctctgtaaatataagaaaagtacaaatataacctttgcaagtgtgtcccttaggtcagtcaccccactacattagcattaaattttagtctttcagatgcaaatgtaattgtttctattatctgtcgttttagataattcactcatttgttgctcccaaatttgtaaaatatggcctcgttagaaggtctgtaaaggtctccagagaaaacacatcctgaagaatttcttctacgaatcactgtggtgctgttctaagaagtggtatctttttgtctgtaacctctctgacttgcggtgacaggagtagcaacttcttagtcgaatagcagtttttctcactggtatttcttaaagccacgtgctatcagatacccacttcctggctgcaggagctgaggttaaaaattgcagctcatcgctttattttttgtttgtctttgttgtgtgttgttgttgtttactctttcaacatccccttccctctttcatatgagctggagatgaataacctattaccacgcagtagtttctggagtgggggcagcactggctggcagagaggagctgggctgcagttgctctctgttccagagccagcaggaggaataaggccctactatcttccaccctgtcccttccgctgccctcccctcttcttgggggtggcagcaggtgtgaaggaaagaactttgggaacagcaagccagcgatcgatgcattccaaaacagagtttccatgagaatgcagcctcctgaggcaggtactgaagtcctagggacaacagaagttcagtgtctattgaataaagttaggattgcgtgcatctcaaaaattctcattttacaaacagtagtgtctgctgaggcctgcctgtctctccacagatgtttcctggggaatttgcttggtgtttgacgtgaaaaaaattggagtctcacagaagctctctgtgcacagatcttctaatgaacaaggcatggccaggagccccggtcgattggaaggccactgcttcagataccagcacacagtgaagtttgccaggcgcaacatcaaacaattgctgttaggatcataacaatattctaatattgttaggatctagggtggaacatttttaagtggtataaagcaggctgccctgccatcttgtggctaacacagagaagaatttcctgttcaaaatggatacaaacctgatctttatagtttgagtgtccatatttcaaatgaaatgttcccaagaatcagaagagagtggcagaggccttccacttggcccaattcaaccacccccatggtgctcatcagacacttacctggaactcgcagtaaaaattcatgagacacattctgttcatcagatgtactgattcacatatttccagtgtatatagttcaacagcttttgacaaatgcaaacaaaaatgtgaccaccactacaaataacagtttccttcacctcaaaaattcccctcatgcctttggccataaactctcactccctgtgacaacacccctaacttctggcacattttgtttcctgtatgactgctctagaattttctataagttgaatcatacaatattttctctttgcttcctgacttcctttactcaccataatgactgtaagatttatccatgttgttgtatcttaaacgtttataatatttccttgtatagatacatcacaatcctcatccactgaggacatttgggttgttacaatttggggcaaatatgaaaaagtcattctgaatatttgcgtatgagtctttgtgaggacattcatttttcttcatttctgttggcaaatacctatgaagaaattcacacggtcatctgaacatatacctgtatatgataactttttacgaagctgccacatctttttcaaagtggttatatcattttatattcccccagcaacgtacaactattcctgttgcacctcatccatggcaacacttggtaatatcagtctatatcattttagctgataagtacgtgtgctctaatgtctcactctcagtttaatttgcattcccctggttaataatgagaagcaccatttcatatgtgcattggctctatgtatatataatatatattaaatttatgtatacatgtgcctgcaatattaccttttatgaggtttgttcaaatcctttgcccgttatttaatttgctaaattttcttgttattattgatttcttggacttgtttacatattctgaatattagtcctttgtgagacatctgtgttgagagtcttcttctcccagtctgtagattgccattttattttaaacatttaggattgttatgtcatctctatgaactgactccttcattgttaggaaatgcttgttattaattccagcaacaatccttatttaaaattaggtttcatcttatattaacatggccactcccagctttctttttatttttttaattatattttaagttctaggatacatgtgcacaacatgcaggtttgatacataggtatacatgtgccatgttggtttgctgcactcatcaactcatcatttacattaggtatttctcctaatgctatccctccccatgacaggccctgatgtgtgatgttcccctccctgtgtccaagtgttttcattgttcagttcccagctatgagtgagaacatgtggtgtttggttttctgtccttgtgagtttgctgagaatgatggtttccagctttatccgtgtccctgcaaaagacatgaactcatcttttttatggctgtatagtattccatggtgtatatgtgccacattttcttaatccagtctattactgatggacatctgggttggttccaagtctttgctgttgtgaataatgccgcaataaacatacatgtgcatgtgtctttatagtagcataatttataagcctttgggtatacacccagtaatgggattgctggatcaaatagtaattctagttctagatccttgaggaatctccacactgtcttccacaatggttgaactaatttacactcccaccaacagtgtaaaagcattcctatttctccacatcctctccagcatctgttgtttcctgactttttaatgattgccattctaactggcgtgaggtggtatctcattatagtttaggcaataccattcaggacacaggcatgggcaaggacttcatgactaaaacaccaaaagcaatggcaacaaaagccaaaatagacaaatgggttctaattaaactaaagagcttctgcacagcaaaagaaactaccatcagcgtgaacaggcaacctacagaatgggagaaaatctttgcaatctacccatctgacaaaaggctaatatccagaatttacaaagaactcaaacaaatttacaagaaaaaaacaaacaaccccatcagaaagtgggcaaaggatatgaacagacacttctcaaaagaagacatttatgcagccaacagacacatgaaaaaatgctcatcatcactggccatcagagaaatgcaaatcaaatcccagctttctttttaaagtgtttgcatgggatgtcgtcttcccatgtctgtgcatttaaagggggtcactggtagatgacatttggttgagtcttgctctattttatgtctttcagttggaatgtttgggccatatacatttattgtattttcttttttgatgtagtcaggtttacatctaccatcctgctattgactttataattgtcccacatgttctttgttgctgttttgctgttttctgtgcctttatgggatttatattttttaccttcatgttttacatttttagtggtgtctctatggaataaaatatacacctttatataatcacactctaccttcagataatacgatgccacttcgcttacagtgtaaaagccctgaacgcaatgtgcttccacttccctcctattctttgagctcttgtgcttttgtacttctgcaaatatgataaattccacaatatagtgctactatttttgctttaaacagttatcttttaaagaggaaaatacaagagaaaacgaaatgttttttacttagccaaactgtcactatttccagtgttccttgttcctttatatagaagcaatttccatctactgtcactttcttgaccgaaagaacttccttatacatttcatatagtgcagctgagcaataatgagtacttttgtttttgtgtttttgaaaatatttttactttacatagaatactagattgacagggttattttttccttagcattatcagtatttttaagatgctaactgtctctggcttgcatactttctgtcgctaagtctgtaacggttcatatattttgttctctatgtctttttccctccagctcctcataagattttctcttcctcatttatgtcaggcaatgtttttagcttcataaatctgtgaatttacagctttcctcatattttaacaaatttttaccactagtattagtattattttatttatttatttttttgagatggcgtcttgctctgtcacccaggctggagtgtagtagcacaatctcggctcactgcaacctccgcctcccaggttcaagtgattctcctgcctcagcctcccgagtagctgggactacagacatgcaccaccacaccaggctaatttttgtattttgagtagagacagggtgtcaccatgttggccaggctggtctcgaactcctgacctcaggtgatttgcccacctctgcctcccaaagtgttgggattacaggtttgagccaccacacccggccaccattatttctttgactatcttttctcccctcatttcctctggtccttcaattttatggatgttagactgctcgctacaatcgtcccacactgaggttctgttaaggtttcttgtcttagtctatttctgtgtctgcttctatttcaatattttctattgctcatcatcaagtttattggtgtttcattttgtttactatgctgtcatttcatccactggcacactctttttcatctttataaataacattgggttcctttttatgctttttatttctctcagtgttgtactttaattttatgaacatgtctgtaatatttataatacctattttaaggtccttgtcatttctgaacctgtgttaactggtttttctcttttaggtcactgtttgctgtttctttacatgctgataactttctacaggattctggacattgtgaatgttacattattatgtgtttggattgtgttttctcccttttggatgggttttgtttcctcatttgtttgttgttatattttgctctgttttgttttgttttcttttaacggacaattgtaaatccagttgagcctcttaagttttatgattcaggaacgtcagctctagagtagtctttacttttgggcaatttagccctacttctatggtggcactgctatatcaagtggttgccaatggattcaaaagtgtttatactcagctgtgtgaggtttagctgtctcctggccccagccctgtgtgggagatgagaaccactcgccttgcagctccccagctgttgctcttcttgtggctccatagagtcccacgctacccaggtgggcagactggtactcagcacaagctcaaagagtccctgaggtatgttcctggagctggttctctgcataactcccagcaattctgtattgcatcctgcaaattttagcaacttttgtctccccacctaccagtcactgtgtcttcagctttgtaaggttatggactcgtgaccaccctctctgctctaaggaccatctcgctagttcctttctctcagggaacatcatactacactgttgttgactatctgaaagcagttatttcataattttgtccaagtttttatagcagatggggtaaatctaactccagattatccatcaattgataaaagtagaatttcccccagaagttatcttttaatattcagtgaaaatcattgtgtattagctccctgtggcactgcaatgaatttccacaatcttagtttaaaacaatgaaaattgactacctactggttctggaagccagagtctgacacgaaggagctggcaagcctatattcctgcggaggcttcaagggggattctcttatttgccccttcgagcttctggggtatattggccttccttgacttgtgcctgcctcacatggggaaagttctgaaaaccagaattttccacttagattccagtctaacctcctaatttaaaaatatgaatattgaagcccaaaaatatgaagtagacattctcatttggaaagcagatgaaatgcacagattcccaaaccataccatcagaaactctgattcagtaactttggactaagacgggggaatctgaattttccaaaatccaaaaaagatcctgatgcaagcagccagtgaatcacactgagaaagagcattcaaagagctctcacctggtcaacaaacaaggtaaacaaccaagtccacaaaccaaaggaacaagatacaacctccaagtaaagagcttgttaaacctgcaagttcactaccaattcttctagattttgctacattttttcgattccaagagcaggaaatgatacaatgttttttataatacttaattctagcctctctggcaacattatcgttagcggttttgcttgaattcatactgagatggaccccgccttctctaaagcttgactccccagcaagctgataaaatgggaagtcactggcccgtatttgagggtcttttgaacctataaactcaccaagaaatgaggaaactctagttacaagctggtgagcactttctttgtgaaaattgccatctgtaggctgatgaggttctctgaaatatcaacacactcctaggttccctactgacgacaactataaagttgtccccaacacttattctggtcaggggcttcacagggcatatgttcagatattctaatggctttaaagagaggaaagttggggccaggcatggtggctcacgcctgtaatcccagcactttgggaggctgaggcgggcagattacgaggtcaggagatcgagaccatcctggctaacacggtgaaaccccgtctctactaataatacaaaaaattagccgggcctggtggcaggcgcctgtagtcccagctactcgggaggctgaggcaggagaatggtgtgaacccagaagacgaggcttgcaatgagccgagatgccaccattgcactccagcctgggtgacagagtgagactctgtctcaaaaaaaaaaaaaggaatgttgtcaatgtgggagttatcctcttgggagctctttaaggatcattgcattgcagccttggaaatcaactctagagagacatatgacatttgagaatgtagtagactcatagtcctagagacagaggcagggcacaatacctaggaagaactccagggagagaccttgaccaagcaggtgggaaactgagagagtatggaccagtgcataagggtatttaatggggggcagggtggagcacacaagcaaaaggcttgaagggattttactggtgtgtttgagtgtcactaggtcacaaccaggggaggacaggatgggaaggctgtgatggtgaccagccttgtcccactggtgcacctggtctcctgggcccgctgcttacagcttgcttgtggtgatgttgaggcatcaggaaaatagacgattttaaaatctacagtacaagaggagacaaataaaatgttcttaattcagtaacttgtccttcttgaaatcttattttttgttttgtattccatagatcaatagaaaacaagggtgggggagggggagaaaagtggtatgcaatgatgtttaaaatggttaaagtataatatctatgtgaaagtttaaatgactgacattttgagccaaggagcagctggaaaatgatttttgcctgtgtgtcctcagagccaaaaaccatcagtcaatttaatcaatctaaatgaattttcaaaagtcaaacttgttgtattagtctgttctcacactgctatgaagaaataccctagaatgggtaatttataaagaaaagaggtttaattgactcacagttctgcatggctggggaggcctcaggaaacttacaatcatggcagaaggtgcctcttcacagggtggcaagagagagaatgaatacaagcagaggaaatgccagttgcttataaaaccatcagatcttctgagaactcactcactatcatgagaacagcatgggggaaccaccctccctgattcagttacctccacctggtcccccttgacacatggcaattatgtggattacaaatcaagatgagatttaggtggggacacaaagcctaaccgtatctccccttaaagggaaaaccccagtgaatactaaagtttctatttgaacaggttaaatattataaaaacacaaaaaaactaacattaaaagatgaatgtgcagagtgatgtaagaaatctttcttttatccattgaagaaaatgaaaaatatacaaaaatttggtttgaaatcttgtcatttacatttgaatctaaagaaggtaatgtggactaagccatattcatcacagtgtgtagcatatagaagggtcttaactatttgaacaactctattgggatagacatgtttttctggaatggactcagcttttaataaaactgttttattattattattacagaataaatgatgtaaagaatccatgaatattaaaataagttgctgggtgaaatttaatatttctgctgaattccctaaactcctaacctgacaaaattaatagcaataaatgtaccaactcacttatataaatatgtactgcatttcatttacacgtgagacttaagccaatttaaataaaaatacattgatttgtcaaaagtaaacaataacttaggggaaaacttttatcaaaagtgtcatgtagtttacagacatctcattatcttctatggatactcaatttctcttaaatcctctgttctgttccaccccaagcagttacttttattatccattatctccatttgtgtcacttcagtaggtcaccacaaatgtatcacaggcgaattgaacagaaatattcatctgagatgaatatttcaccctttcactataatgatttctttttatcaagtgaagtgtctccatagaaagtcttgagtgaaaaatggtaagtgtaaatggaatgcaaaatggaaaatactttcagctatttttaaatgactggatatgaaaataaaaacatcaagctggaagcagggggtaggcagcatggttggtgtatgtgggaatggcacagaagagtaagcccaaaagagccactatggaagcagctacaacctacagttctcagcagtgatgtttcgcaggagcagatcaacccaacctgtggatcccaagggacacacttgcctgagcttttcattgatgtgtccccctgaattcctaagggctgttacaaaagcctgagaagaggttctggaggcttcatattcatcaagaatacaagcaattctcaacaaatcagaaatctgtaagtaaacagaattccaaatcaatgctagataatatttagacttttgcatgatgcaaatggcttgtcaagattttccaacacctcaagaatgtctttgtataaattacttactcttttgacaaagtatatcagaagccattagtgcagatttaacactggctatatgacataaggaaggaggtcctcttctacctaggatgcagaaaacctggaaagtgttcctgccatcctagctaagaaataaagctaggtaacttccaaatgtaacttttttcttaacccatcacagagctagttcacagagcaagtaagtagcctaaaatcgaagaaaccacatggctctccaaggacaggtgagatagagtactgactcacctgtagcagagcacaggaagaagtgatgctggaaaccacactagcagacaggaaaaattcagcaaaaaattgtaaatgttcctaacagtcgtgtgtgggcaggcatgagatcacagagcctccagaagccatggacacaagaggaggtaacactgactcaaacacttttctttacatatttccactaggtgctcacagaaaggcttcgggtagggttggttgccaaagaagaccctctgcagtggtacagccttgaggaggggttggtttactcttgcaaaaaggcacaaagtagctcctggacttttctttcctatgaaaaaaaggctttatgccattagcggaggagaaaaacgagtcacatccaatatatttatgatgatccattgcagctggggaaagtgtaaaagaaaaaagtcctctatcatgggaaaagtgaagaaaaaactcctgggtccaataccctaagccaatacaatggatgtcttctatcattggaggagaaaaagaaaattcctttcatacaagaccttccacagtcactgagaaagacctccaaaacataaggcatgcctaaggctgaggctaatccaggacaataaggggatgcccctctcctatctctatcaccaggctagcaagcactgagaaacaaatgacacagtctatccctgaaacagggacaagagaatggagagagatatttatctattccaaaaagatatatttaagccctaacgccagtacatttgaatgtgacctcactcagaaataggatctttggagatgtgatcaagttgaggttactgcattcaaatgggctctaatccaatgactggtgtctgtctaagatgggaaaaatttggatgcagacacagagtgaagcacatcttgtgaggacacagagacatagaagacagccacgtgaaggtggagacagagactgggacaatgctgccacaggccaaggaatgcctggggctataagaagctagaggaggcacggagggttcttccttggagatatggaagaaacatggctgtgctgacaccttgatttcaaacatctagtctccagaactgggagagaataaatttctgttgttgtaagctaccactttgtggtaattttttacagtagccatgggaaactagtaacacccttcccctgacacatataagacataagtataaaggaaagactgaaagctgatgatggggaagaaacactgagaaaagcccttcagcataccaaccaccaccataaacacaaggtaacgtagaggaatttgaagccagtggtgcagtgaatgtaaccagaaccataacaaaatgtaaatccagcttagccactggctacattgactccagggcccatactaaaagccttttagatgaaaaggatggaccatttacaagcatcaataccatttacctcagtctttagtggtctacaaatgatgttcagcatttaatcaaaaattagaggacacacattcaagctttaacatatcatcttcaaactgctgaaaatcagaaataaatcttaaaggctaccagaaaaaaggactcatgacctacagaagaacaacaagaattacgaaagatttcttatcagaaactatgcatagtagaatatgatgtcttttttgccatatcatccttatttcaattatttatcattgttgttcttgctctcagattgtctcccaaatatctataaatttcatcatgcattgaacattgagcgtttttctctcttggccctttcacataaaatgtgtatgccatttcaacttttaagattcatgacacctaaacaacagactatttcattctgcctcacgttctccacatgtgtattctccacaggcactaatacagtgctttacacatagtagacatcagtaaatgtgtctggagtttaattgaaattgttcttgtcttatattgattgacttttatttcatcccaatatttttccttccttagtcaatcttttcatagtatttaatcatattcaatgtatgttcattttcacttagattactgaagtcatctaagaaagttctgcaacatgttgtttaattagaaaatattctagtttttttaatcaatcaaatttgctgaggtttacctttttactaggaaaaaataagttgcacatttcaatatattttgttcaattatggggttttgcatgaagagtttgtaattaagctatactagaaaataaaaacctaactaaccatttcagaaaattttatctgaagcgtctgcattttggcaccctcttaagtccatgcactagaggactaattgttgataagttacagaattttttttaatttggtttgatcaaggttacaagattatttcaacttaaagagtgttattataaataatgaacacccatactttgacaactaattcattcctttatcaaatatttattaaataccacattgtcacatgccaggtacacaccaaggcatttgaaatacatcagcaagtaaaacaaacaaacaaacaaacaaagcatgttctcaagaagcttacattctagcagaaagaaggtagaaaataagcaggtaaattatatagtgtgttgggagatgataaatactcaagggaaagaaaataaagcaagagaaagcggatgagaggaggaaggtcacatagcagaatgaaaatgggagaatagagcagagatataaggaatttgttggagaaaaacaatcaacagattaaattgaataatccaaatttagaaatctgttaatatgtgactactgtatctctttgatcttttctaatgattattaactgtgttcagaatttatggttattttacacttcaatttttatattcaacttaaaaagtgttatcataaataattagatttataaataaataaataatctacaaccacatatttgctgttaggcaaaattctagtatgcaaaaatgtatttatgaatatcttcacaacagtgacaagaatttcactggagttgacaagaatttcaactccaatatgtatggaattccattgtcttttcctgcagataattagaaaagggaaacccgaggattgagtgtagagatggaacataaagcagatggcacaacagcagtcaaggttttcacaataaagatttaggaggagaaaatgaggtgaagaagtcatatgatgagacctcttgctctgttgagaaggagaatgtattagtccattctcacgctgctataaagaaatacctgagactgggtaatttataaagaaaagagatttaattggctcatggttctgcaggctacacaggaagcaagatggcttctggggcctcaggaaactttcaatcatagcagaaggcaaaggggaagcagacaagtcttacatggctggagcacaaggaagacagagctggggaggtgctccacactttcagacaaccagatctcatggtaactcactcactatcatgcaaacagcatcaaaggggaaatctccctacacgatcccatcacctcccatcaggcaccacctccaacattagggattacaatttaacatgaaatttgggtggcaacacaaacctaaaccatttttgttccacccctgatccctcccaaatctcatgtttttctaacattgcaaaataccatcatgccttcccaacagtcccccaaagtcttaacttattccagcattaactgaaaagtccaaagcccaacgtcttatctgagacaaggcaatctcttccatctatgagcctataaagtcaaaaacaagttagttacttccaagacacaatagggatataggtatataggtattgggtaaatactccctttccaaaatggataaatcagccaaaagaaaggggctacaggcaccatgcaagactgaaacccagcaggactgtcattaaatcttaaagctccaaaatagtctcccatgattccatgtctcacattcagaccactctgatgcaaggggtgggctcccaatgccttgggcagccccacccctgtgattttgcagggctcagcccccacagctgctctcaagggctggcatttagtgtctgtggctttttcaggcacagggtgcaagctgtcagtgtatctactattctggggtctggaggaaggtggccctcctctcacagctccattaggcagtgccccagtgggtactctgtgtggaggttccaacctcatatttcccctccgcactgtcctagtagaggctctttataagggctctgcctctgcagcaggcttctgcctggacatctaggcttttccatatgtcctctaaaatctaggcagagaattccaagcctcaactctcacactctgtgtacccacaggcttcacaccatgtggaagctaccaaggcttacagcttgcatcctttgagcaaccctagtacctgggcttctttgagctatggctggagctggagtggctgagatgcagggagcagtgccccaaggctgcacaggggagtggggccctgggtcttgctcatgaaaccattcttccctcctaggcctccagacctttcattggaggggcttccatgaaggtctctgaaatgccttcagggcctttttcccattgtcttggctattagtacctgccttccttctagttatgcagatttctgtagcctacttgaagtcctcccctgaaagtgggttttccttttctaccacatggccaggctacaaattttccaaacttttacactctgctccccatttgaatataagttttagttttatgtcatttctttgctcacaaatatgagcataggctgctagaagcagccaggccccatcttgaacactttgctgcttagacatttcttccaccagataccctaaatcatcaccctcaacttcaaagttctacagagcccttgggcagggacacaatgcctccaacttctctgctattgtataacaaaagttacttttgttccagttcccaataagttcctcatccccatttgagaccacctcagtttggacttcattgtctaaattactattagcattttggtcacaacaatttaacaagtctctagaaagttccaaactttccctcatcttcttatcttcctatctccttctgagccctccacactcttcctacctctgcccattaccctgttccacagttacttccacattttcaggtatctttacagcaatacccctctcctggtaccaattttctataatagtccattcttgcattgctataaataaataacccgagaatgggtaatttacttaaaaaaaagaggtttaattggctgatggttttgtaaaaaagaggtttaattggctgatggttctgcaggctctacaggaaacatgctgggaaggcctaagaaaacttattatgcaatcatggccgaagacaaaggggaatcaggtacgtcttacattgccagagcaggaggaagagagagagggggaggtgctacacacttttcaaaaaacagatctcaggataacttacccactatcacaagaacagcaccaaaggggaaatctgcccccattagccaatcatctcccaccaaccatcacctccaacattgggattacaatttgatatgcaatttgggcagggacacagaccaccatatcaaaagaagctaagaaatgtgtaaaaaaaatacataattgtcttattttaaatatctgtgaacatgtctgtctagagcaaacccaccactggctcatgtccaccaacatggaaaagaaacctgcaccaatgaactgagctgaggccaaggccttagtgttgaagctagtggctcttatcataggaagaatgaagtacacctactagttcttttaccccagctttattaaagtatataacagacaaattaaaattgtattcacagtcacgcatcacataaggatgcttcaaagacagaccataagattataatagaactgaaaactttctagcctccagtactgtactaagatttcagtgcaacatattaactgttctgtgtttggatatgtctacgtacacaaatactttgtgttacaactgcctacagtattcagtgcagtaacatgctatacaggtgtgtagcctaacagcaataggctataccatagagcctaggtgtgtagtaggctatgacatttaggtttgtgtcagtacaatctatgatgattgcacaatgacaaaattgcctaccaatgcattttttagaatgtatccctattgctaagcaatgcataactgaatttggtgtacaatgtgatgtcttgatatatgtgcatacattgtaaattgactaaattaagcttgaatatatccatcgcctcatatatttatctttttttgtggtaagaacacttaagatctgccttcttggcaatttttaagtatacattattaacaatggacaccatgctgaaaaataagacctccagaacatagtcctcctgtctacctaaaactttgtacccttttattaacacctccccatctcccaccctgtcctctggcaaccatattttactttgtgcatctatgagtttgactttcttagattccatatgtaagtgagatcatgtgacatttgtgtttctgtgttggacttattttatccaacataatgtctttcatgttcatctgtgttatcacaaataactggatttcattattttccaaggctgaatggtattccatcatttatatagaccacattttctttattcatttatctcttgatagatacttgatagatatagatacctcttgaagacactgattttgtttcattgggatatatacctaggagtggaattgctggatcatatggtagttctattttcagttttttgagaaacctccacgctgttctccatagtggttgtgccaacagtgtatctcctggctctcgtcgtcatgcaatgttgaagaacacagactctggagccagacccatctcacactcatgaacactatgaattcagccatgttgttggcgtcacagtgcttgctctagtgttctttctgtaagatgagaatgacaatggtacctactcttatgggaggtatgaggattaagcagattaacttacatgaggcacttagagcatcagaataggtgttcccaagttcacggtgcccttcactgtttcaggcatggtggacagagtggacaaaacagagttaaatcctggaactcttggagctgacattcaagcaaggggaaacaggcaaaaaactaaataaataagtaaaatatatagattattacataatagatatgttttggggaagaattaagcaggcatgttggatagcagaggtgcggttgtgattttgaataaggtagtcatggaaggcacctctgagcaaacgctcagctcagtcctcaagagagggcctgcagattctagggaggggcagggcagtgtcctgaggcccaagtgtggcagaatgtctgggcaccttagaaaggccactttccttggagtgaaatcaatgaggggacagtggcaggaggaagggccacagagccttcagtgtaggagccctggggagcctggaggcactgtaagaaatttggatggtgatatcatctggctctgtattcccatcaaaatcttatcttgaattgtaattggaattgtaatccccacgtgttgggggaaggtcctcatgggaagtgattagatcgtggggtcagttcccccatgctgttctcatgatagtgagtgatttctcacgagatctgatggttttataggggcttttcccctctttgctctacacacttctctctcctgccgccatgtgaagaagtacacatttgcttccccttctgccatgactgtaagtttcctgaggccttcccagccctacagaactgtgagccaattaaacctctttcctttataaattactcagtctcgggcagttcttcatagcagcatgaaaatggactaatatagctggtctctgaggcagtgggtgtcatggggtggcctcaagttctaggaagacacacagggtgttgaacttgggggaacaaaggaaagaagcaggggactgaaggaggtggcctgtactccaggcaaaatacactgatggctcagcctgcagtagtgccttgaatggcagtgaagttctgaagcttctctgaagataaagcaaatggagctgtgtttagcaggggaaggtaacattagtatccatcatagctgtcttgatgaattcctatcacagaagatgagcagaggtggtgggcagagagagttagcaaccaggctacttctgaccatagccataaggcattttgctggcatggttgctcattctcgaatcctgcagaggtaaatgatctgtaggtctgtgctccatgacattacctatgcatacgggaaaatatattcactaaaagtttaattaacatatttcatatagtttgcaaagtattaacattttctcatagtagagagacctgggaacatacaataagtcaataaggcaaacacctgactgtggctgggcaggctggagagcagctgtggcacccagcctgagtctgcaacagaattctctaaagcccaaccaacaatgcgcctctcactgaagcaatccacccagaaagaagtgtgggatttgtattactgcatccttagtcaagcagatatcatttggattccaattctgggcttcagtttcagtgaaatgtgtaaagatgggagggactctgggatgcgaatcctttcagaattgctacttctcagggatcctcatccagaaagacaattaaaaatagaaactcatcctgggcaacatagcaagactctgtctctacaaaaatgaaaaaattagttgggcatggtggtgtaccctgtagtcccacctactcaggaggctgaggtaggaggaaaacttgagcctgggaggtcgaggctgcagtgagccatgattgtgccactgcactccagcctgggggatagggtgagatccatctcaaataaaaaaactaaaaattaataaaaaattaaaacttatttaaacggcagcaaacatgctgtaggttagatatttagaacaatgtttctagagagaggtgaacatatgtccaaaagaaatattacttttcttggtgaaatttaagaatttctgagggtgtggtggaagaagggatacaaataccaaaatcagaatattcctcttggttagtttcaggaccgatccacacagatgcagaaagtcaagcttgataacaggcaggaaaaaacatgcttctgagaaccctccatatagggtgacagaaggcagcgcagagtctgcggccagaggccaagctgaaccaggcaggagtcagcgtcactgtgctctctgttgagcaataaatacactctgctctaggtgtgctccttttcaaggaagctaatatataaatctgaatttcaaacatatgtcaaataatttcttcatattttaaaatctcattcttttttgtaggaataattacagtcttgagttaaaacagctctacacagtgtaggcaactccggacaattcctgtattttatcaatgtttgtttccccagcactggcctgcacacagtcagcactcagtcaagttttatgaataaatgcttgagtgcatgaaatattaacaatgttctttctgatcagattcttgggtgtgaggaacggaaatccatctgaactggcctaagcaaacaaaggaaggctctgctggccagaactcagacatccaaggcaggggccatgtgaactcagcctggtggggtcaggaaccaacttccaccactcagaggccacatggcatgtccatcccttcctttcctgcttctcatgggctctccttcttcactgtaggtgcagatatggccagcacctacccaggtccctcccctaaccctggatgccatctgcatcttggcgggcagtttccacactctccccctgtcctgtgcctctctgcctgagagctttcccagccacagaggcttgcaggctcatgcagggggatgggagtgatgttgcacccccaggagcacttccttacctccccagccagtggaagacaggcattggttggataattgtcttgacttctgctctgcatgacatggtcatttggggatgtcttacatagtctcttgaggtgccccaggggatcactgcagttattggtgtcttcagaagaacagtctcatcagacttgatcttcaattcgttatcttgagttgtctttaccatcgtttccagtgttgaaatagggagacttgaagcattgaggcaccagaacagaggcaaagtctcacgcggctcagttttctcccgagacccagagtccagccaggcacacagctggggccggaaggtcacatgtatccgcttttgcttcactgatgggaagtttccatcaaacacctggggttcttccttgtactctggatattctgccagtgagaggcaccttagctcaaaagtcatgtgattcacacgccaaggacacttgaaagtgagtgagttaaatgaggacaagacacaccggggactgttgtggggtggggggaggggggagggatagcattaggagatatacctaatgctaaatgacgagttaatgggtgcagcacaccaacatggcacatgtatacatatgtaacaaacctgcacgttgtgcacatgtaccctaaaacttaaagtataataataataaaatttaaaaaaaataaaataaaaataaattttttaaaaaagtcatttatagcctcgcacatcaataaaggaaatacagtggtcaaacaggcttattagaaatgtgaatagtggtgttctaagaaagaatagctaatatttacatttctgaagcaattagatgataaatgttcgtccattttactagagtataaaccaattttatatgtgtgcaaaatccttgatattggaagaaatcaataagagatcagttttactttgctactaaaagaaacttttaccacaattttatcatttctgccaaaaattctaagttcagtatgtgttgaaagcacaggaaaatgtgtagcaaagcattgtcaggagcagagggtaaacctgaattaccttcaatgacccaagaggatttgaaatggaaaagacagtgaagcaaataattaccttcaaatagattttaaatatgcaattgcttataagggtgcaagcatttcagaaaagtctaggatttggtaaaagagaagccaataagaaatccaaataaaatatatacagtcatgcactacataatgacaccttggtcaatgacagaccacatattcaacgatggtcccataaggttataatgctctatttctactttaccttttctatgttgagatatgtttagatacacaaatacttatcattgcattacaattgcctacagtattcagtacagtcacataatgcacaggtttgtagcctaggagcaacaggctataccatccagcctagctgtgtggcaggctttaccacctaggtgtgtataagtacatgccatgatgttcacacacccaggaaatcacctaatgacacttttctcagaatgaatccctatccttaatggctggattcagagatagttttcttaagtaaaaatgaagtatctgaagtcatgtgtaaaaagtcacatccaacatttatttttgaggaaggatgggctagatgggaatctcagagcatgccagtaatggttaattgtgtgtgtccacttaggtgggcagcagtacgcccagctagatccctggcttaatctttccgggtgtgtctgggagggtgtttctccaagagagactgacattgagttggtgaactgaggaaagcagatggcctccaagcatgggtgggccttcagcaacgcaccaccggcctgaaaaggacaaaatagcactgacagggtgactcctctctgcctgggaacttgagctgagacatctgttttctccggtgctcagtgctcctggatctcaggcctcagactctgcctagaatctacaccatgggctctctggctcccaggcctttgaactacaccctggctttcctgggtctcaagcttacatgtgacagatcatgggacttctcagtgtccattattatgtgatccaattccttgtaataaatctctttgtaaatagatatagatacagatgcctctagagacatatatggaatcatttcatattggctcttgttctctacagaaccctaactaatacaacacccctgccctcaatgtgcctgccccaccctgtgggtgtaattggagctggggttagagtggcattcctgtggttaagacttgatatcccctttctttcctccactcagtcatccagcacagacacatggattcctcaccataacaacgtaacacagactgagtgacttacaagtttatgcccttacagttctggaggccaggagtccaaaattaaggtgcaggcagggctgcactcctgctgaggatgctgggaagggatcaggctcctagcttcaggtagctgtagcatggcagtgtcacgtccatcatcacatggcatctgtgtccttttttatgaggacaccagtcatattggattagggtcaccctaacgagtccattttaacctatcatctgcaaagaccctatgtcaagagagaggtcattttctaaggtactggaagttaagacttcatcttttgaagggacacaattcaaaccataacagtcaccaatgcatcaaacatagtgacgatgctgaaggtacagatatgactactctggcctcttcctcaagtggttcccctcctgtccatccaggagtcagtgacacagaaattatatatatatagacacacacatatatatatatgatataaatcacaaatatatatgccatctgtgatgctgcatacacaggaggagctccatggctgctctgggaggataaaggagtttcccagaggatgtggacatctgagctgactcttaaagacaaagcttatttaatgtaggaagaaacaagggaaaagggaagggtgtttgtaggctgaaaaaccttcccgtcaggtcaatgacagaacctgtggttgtctgtacggccaggatgctgggtgctgtgagaaaaagattgagacaggatgcacaggggaactagaaggaaatggtgaacagttttaccaagagtgggtcagtccagtgctacagacaaggccgatgacagcacccatggttagaagtgaggaaggggaacgacaatgacacaaaacactccttaggggaagcttgctagtgagaaggaagcagtgaggggaagaaggtgcttcgggatgctttaggctccaggcagtgaatgccccaactcaacagagcttaagggatgagaaaacatctcgtatggtaaaggaccagaggtaggtggcttggggagaacatgacgagggtcttgactcagtctatgggctagtgccctacttatgcccagttgggcatgtctacatcagcttctagacatccttcctcatatcagttgcctgatagcggtgagcagccactagggcagcctgcctccctgtcatctggaggactccctgtcattctagagcaccccactcccagctgtgcagtgaaagccttctctttgtctgatttggccaatttagttcctattctcattcctagaccaataagaggtgaaggggaatacccacgcccagcttaaacctgcgatcctgaccaaatgctgggaaggatgaggtcaacacagccagcttagtacattagaataactagggaaacttggccagccatggtggctcacacctgtaatcccagcactttgggatgccgaggcaggcagatcacccgaggtcaggagtttgagaccagcctggccaacatggtgaaaccccatctccattaaaaaatataaaaaaatgagccagacatggtggggtacacctttggtcgcagctgcttgggaggccgaggcaggagaattgcttgaacccgggaggcagaggttgcagtgagccaagattgtgccactgcactccagcctgggcaacagagtgagactttgtctcaaaaaaaattgctagtatccaggctccaccaaactcttgatttaattggtctgagttgaggcccaggcatccatattttttcagaagtttcccccatgtcagtctaatgtgcagataaaatagagaaccactgaacagggctaatgtgggctctactcttaaagctagagggaaggtcaggtccgctatgttatgagcctatgacacaggagaggtgggtatttgctaaaataaataaatataaaataagttaacaacacagattcctttaggcaggcagaagtgagtaacgcatgctgggtaggcagccagtactctagaaggataaagccagggaagcttgtggttttccttcctctatgtttgtaagatgaaaacttgggcatgcctgtaacttactaacttaaggcaaaagaccttggggagaaggaaggaaaggatagagtacaatcagtgggacaagggagatgtggaattcacatcaacgtaaatgggcttagaagcctgactaatgtgtgtttggagtcgtttgcaaataagggacagaccctgagatcagggaggagctgctgcttagcaacaggaaggcatcaggcagtgtgtttgtttggtggtgggccttggagagcagatctacgagggtttctctaacagcaagggttgtcattccctctgtctgcgggtagtgcttttccgccggatggttcttcctaggagcacacagtcctgcatcatcagaacatgggaaagctattcagggcggcctgcctctcactattcctagtaagaaagatgcaagcactaatctacaacacacactagcagcgcaatctggaaaagaccttggaactaaagttctcctgttaaactttgcaagaagaaaatccaggttaaatggcatgtccatagaccaaatcaaatggtttttgaggttgcacccatgaacacatctttgaataatatatactttgaatgaatcagatggaagagatttatacacatttgaatataaaacatattttatttaaacacaacaatgaaaaggctggactgagagccacagctgagcaaactttgatgataatgtattagggtcaggtctccacaacagtaataaatggagactgtgaggtcttacagcttactctcaaaaaataatttctcttccttagaatttagttgtacatttgttagtggacccaagagccaactagataatgggaccaaatccaagttaagatcgtatttatttaggatacgaaacataaagtaatatttgaaagtaagtttaacttcttctcactaactctaagttcaaattgggtttataaaaatatttcacaaaaaagatcacggcgtttgattaaagttatcgttatttcactccttctgatgattttatgttttttattaccatttcgaatgagaatatttttatatattgtgttcccagttctctgaaagaaatacatattgggtatgtttgacttaataaattatcctttgagatgaaatattaaattctcaggaatatttttagattctatgcaattttaaacatcaactaaaaccttttcatgtaattatgcttctattctgctagtaatgctttatccttgaacattttttcttttttcatctacttaaagaccagtgtgatggtatgaacatttactaaactccaactgctcatgtcttttgttcttattctgtttcccacagcgcagtgacaggagagggacctacagtattcaggtcaaggtttccctgtgtctatctatgcacacatcccagtagatgctctgaaagagaaggacttactgaggtgggacaatcacttgagcagaagagtttgaggctgcagtaagctatgaaggtgtcattgcattctagcctgggcaatggagtgagaccctgtctcgagaaggagatggagaaggaggagagaaggaagggaggaagggagggagggaaagaggaaggaaggaaggaaggaaggaagatgagttaatattggatgctacttcttagagataggaaatctgctaaacaaatggtctgagatgttagatcatctcaatttcatttctaattattcccttgacttgctatggagccttggacaaatcctttaatctaattgcttttctgttctcaatctgtaaaattagggctttgatttagaatccacaaatgtatagaattggaagagaagtttaaaatgtgatctgatcaaacacttttttctataaacacacatatatatgtactatacatatatataacgtatgcatatattctaaaatataataataaataagtacataatgttacaagtagctatgttttcattctgatgaaaggagcatccaagaagtggtgctaagcaattgcttattattgagaaaagttgacatgggaacatattaaactactgttcaatatggccagataataaggccagatatttattttttctaaaatactgaattaatgtactagaaaggaaaagactggcaggaataagtaaacatgccaaaatatgaatacagacagcttctgggtagacataattatgaacatttttctacttttttaaatcgtcgagtgttttccaaaatttctcagaggagttggtgttacttttatagtgttaaaacacacactctcagaaaataatgtatatattctgaagttttatctttctccatccaggaaaactcaacttccttgtttctaaactagagcagtgtgggactaggtggaaactgtgttagttgcttaatccattttcaaagatttttcaaatggcttaattttatgttacaagtgaataattattgagaggatgaggagctaagccacagatggagagaaaatatttgcaaaagatatatctgataaaggactgtaacccaaaatatacaaagaactcttaaaattcaacaataaggaatgaacaacccaattttaaaatggtcatttatctgaacagaagtttcaccgaagaagacacagatggcaaataagcatatgaaatgatgctcaacattacatgttcttaggggattgcaaattaaaattaaaagaacaatgaaatactactgcacacctattagaatggccaaaatgtaaaaaaagaaaaaaaaaagacaacatcaaatgctgatgaggaagtgaggcaacaggaacactcattcattgctaatggtaatgagaaatggcacacccactttgtaagactggcaatttcttacaaacacactcttaccatatgatccggcaatcatagttcttggcacttacccaaaggaattaaaagcttgtgttcacacaaaaacctgcataaaatgtttacatcaactttattcattattgtcaaaccttggaagcaaccaaaatgtccttcaatacgtggatggatggataaattaactgtggcaaattcagacaatggaatattattcagcgatagaaaagaaatgaactattatactataaaaacaagtggaggaaaagtaagtgaatgcaattaagcaaaaaaaaaaaacaatctgaaaaggccacatattgtatgattccaactatgacattctggaagaggtaaaacagcgaaaagagcagtggttactagtggttaacagaaaggaagaggtgagtaggtgcagcacagaggatttctagggcaatgaaactcttccgtttgatgctaacatgaaggatacatgacattatacatttgttcaaacccacagagtatacaacaccaagagtgaacctcaatgtaaactatggagtttggctgatgataatgtgtcaatgtcagcaggttaatcagttgtaacaaacactccactctggtggaggacattgatagggaggctgtgcttacctgggggtagagaatatatgggaattccctgtactttccactaaatttttctgtgaacccaaaactcctctaaaaaaaattgtttacttttaaaagtaaataactatatttacaaatataggtaaactatccctgactgtggggattttaaatcattggttttcgtgcaaggaatcatatggagacagaggagaatcctggagaatattcttgaggatctatgaaggtggtggagaaggcatcagaaggagcttcagtctctctgggagcctctcttgtctcgtccagtagagctgaaccttccagatgatgctgcactatcgcacttactccactggagcacttgccacgcccactctgctaatttccgtatgcatctgttcctcactggatgctggacttcttgaaggaagagaccatggtccattgatcatggcctcgagggtgcaaataagggtgctctctctctctctttttctctcatcactctctctctttctcatctctctgtttctgtctctcctctctctctctctctttcagaaaggagaagactaggaaaagatacaaataaaaataaccagaggaaagccaagagcgtgctttgcacaaacaggtattaaaactggtaaggagagaggaaaggaagaaaagaaggcctgaagggtcaggggaggagggagaacaaggggagggcttgaagtggggctcttttcctacatataagtagtagttataggaccatttgttgaagaaaatatttttctttccccatgaaattctttagcactgttttcaaaaaatggttagtcacatgtgggcgaatctatgtctggactttctactgtttcgaggatctatcattttgccaataatacactctattgattaacatcatgtacattttgaagttgggtagggtatatacttgattcttgtttgtttttttttttttttgcctttccaaatgaattttaaaattattttgtcaatttctagaaaaaaaagtcacctccgagatttgtatatctatgagaggagctgagagaaactctagtaataactgagctatcctaccaccagatggatatgagtggggctcagaaccaaatttaatttgatttaaaaacagagcaatgtggcatttcttgtgtttcgtggggcaaataatactaacgacatttttcatgcttctcttccacagtagactctcgagctgcatgagctccaaccggggaccccacactgtttcgccccctcactgtgcctgcagtctcctctcagtctcagcctagagtgcacggctctctgttgatagactgccaaagcgaaggctcagaaaagaaggttagctctgaaaggaagatctgtccctagagggtaagatacggtaaagatgttctgttcctcttatttttaataggagaaatttagatatcgttactctaatgtgaaggaatgaatgaaaaagcagaatctcatgatctagggaaatattaacctgccgagtggaggattctgaacaggagacaatatgatgaggaatttagggaagagatttgccttggtaggaggcttgaggctccagaggccacacaggatgcccttaagaggagctgcctggaaccagagcgctggactcagcctctcaaagttctacaacctgaggcaagttcttcacctccctgggcctcggtttccttgtgtgtgaaactggaataataatagcaccttgtcagtgtctttagagcggtgagcatggcactgcgcgattatgatcatgttacttggaaagtgcaaagcagggggcccctgtgaatatggggacggattactgagagtggaagagaaggcacataaggaagagcactcctctcagatggcctcagtgctcgctttctgcaaagtaagaatcaaggtcagtaggggagagtgaggctgcagggtagaggtggggccatggaggtgtcccttcagcgaaggacaagtgaaaagacctctcgtttgcatcactggcctcctctgacatcctttgtccatgacccccttcatccgtgaccctcacgggggacacatgtgatttatgttcagtagtagtaaggacttgagtccaccttgctgggccacctttgatccctggggcttcagccccccatggctgggccaaaacgttctctgtaaaatgaggacatgattcttctgagggaagggccagccagatgcatccaagaggttctaaaagttctgagacctaggaatatattacagctctcctattcctcctgatgaatgctgacacccactcaccagatggctggtcagaattacacatataatcagttgtacgccagccagctaagctgggcaactagcctgatctagcaaagtgaaaatcctcatatccataagtacatcacagccccactaagcaggtacgcaccttagaaaaaaaattgagctttctttcaaaatcataaacagaacaaatttcatctttcttgttgttttaaagaaataaaatagcaactaatacttcacatctgatatattactcacaggtaaacagatttatgattacttaagaaacttaaatccaattgtctaaattgctcttattccacatagaattcaattatttgtatttgctgaatgctacacaatgtaaatgtgccaagctacatagaattaaaacgaaaaacccataaaacaaatggtatgacacatacgggcggtcagtccattaaaaatagttattgagtactgtatctgcgatgtgccagaaaattcatcgaagaaagaaaaaatagctaacatattttaagttgctcagttttgaagaaaaatttaaatccattgaacatagtatttgcatttctatgacaccaaaacactttcagtagtttgagagaagttcatctgtagttttaacaaactgatccttttatgagaatatgaaaggcattagatgctgcgtcccattgcacacataaacagacagaacattattttaaactatgaacttcaaagagatcaacccaaaaatgcgagtgttaacattactagtatgtcatttttaagtgagttatggattatgtccctggtagagtacatttacatttaaagtgtgatttgagttaattgggcttggcttcatattttaagacaatattttaagacaatcagtattggtaataagcagagatattgaattaaaatggtgagataaaatttcattttaaagcaccattaagcgtcttcacaaattaactaaaagctcatgattctctcccactccatgctctccaccatctcctaaaatcagcacctcccaaagtcagctccaattcagcgctcagacacaaagctccaaggcacccttgatttggtgctctcaaacttcagaccctagccagcagtgagtcctgctctttctgccttctactccttctccaccttcaactcctgcgcccgacaactaccatctcgcccatcaacttttcccttcctgcttctttttttttttttttggagacagagtctcactctgtcatccaggctggggtgtaatggtgcaatcttggctcactgcaacctctgcctctcaggttcaaacgattctcctgcctcagcctcccaaatagctgggatgacaggagtctgccatcacgcccagctaatttttgtatttttagtaaagacagggtttcaccatgttggccaggctggtctcaaactcctgggctcaagtcatctgcccacctcggcctccaaaagtgctgagattacaggagtgagccgccacgcccagaccccttctagcttctatctcttttatttctgttcctctccacttacaatcagtaccaccaactccttctcgcctccacctgatatctgtaccttcaactcctgctctccctacctgtaatctccaccagcaccataagacacacacacacacacacacacacacacacagaaactcacaccagcaccatcaccataacctctatctccaccaccactaaccccacccccaccacacagcagttcttggcctgtaaaatttctaaagccctatcaagaagacactgtcggggtcccccagcaagaagcagtcagtgctccttggttattaagccctgatgtggctctggacgaagccccctcttcattgtccttgtccctgggctgggcttgtctcccccgggacacatctgaaatggaaatgggccttggggaatgcgccgaggagacatacagattcttcaacttccttcctcctcatcctcatggaaggtcggggaccaaggattgctttaggttttgaacagtaatgagcttttcttaccttgatttcctcggcagtagaactcctgcgaaaactcagtagccttccagtctctttgctctctgtcagttccatgtgtccacagctcacttagcgaagctctcagatctttttctttgctttctcattcccatttctcatctctcactcttttttgtttatttgtttgagacagagtctcgcactgtctcctgggctggagtgcagtggtgcaatcttggctcactgcaacctccacctcccaggttcaaacaattctccttgcctcagcctctcaaggagctgggattacaggcacctgccaccacacccagctgatttttcttttatttatttatttattttttatttttagtggagatgggggtttcaccatgttggacaggctggtctcgcacacctgaccttgtgatccgcctgcctcagcctcccaaagtgctcggattacaggcatgaaccactgcatcgggccctcatctctcacttttaagtcaaagataccctccctaggctgcagagctttgatggaaaggccccacctgtaatctactctttcagacatttaatcagattacaggtatttaaaaatctcaacccttaaatctgtgggctaaaagtagtcagtgtttttcacactgagagagccagatttctgactctgtattttttatttccttttacaaataagctgatctgtctgtataagctcaccctctttcttataatgcattatcacaacgaaccaatattgacccaaacaagctacatcgtcctgcttaagtgcaaggagggctgggctatattgggaacccacacacatactcagtgatccacgcagcttgttgtcaaattactttgctaaatttccttatcaattcacacttcttccagtagtaggtaagagtttgcctatctgcattcttcatgcttttttgctgttgttattctcacatgtctgtacaacaaaatttaagcttcctaaagattggaaccatgtcttcttaatttctatacatctcactactggtaatctgaaatatacttgaatgttaatataatgaatgtatataagaaaatgaataaatggtaggattacgcatctgtttttagaggaaaaacttatgagttcccagaatgcacatatcaaaacacctgccacaggacttcgatcttgacaaagctttactataaccctcctcagatctcttggaaaactctgcttttgtgactttatccagaataacagccaatccaaaaaaagtaatttccagccccctgacctccaccacaaatccattccaaatttaatgcctaaagctccgttaatatggaataacacaccccttttgcccaaagccctgttaatatggaataatgtactccctttgcctaaagtcctgttaatatagaataatgcaccccttttgcctaaagccctgttaatatggaataatgcacctttgttgcccaaagtcctgttaatatggaataataaaccccttttgcctaaagccgtgttaatacggaataacacatcctttttgtccaaagtcctgttaatatggaataatgcaccccttttgcctaaagccctgttaatatggaataatgcaccccctttccctctatatccagctcttttctttcaaactggagactccctgaacctcttgagtatacagctctctcctgtttggcaagctaataaattcagcactatttgtttgattttagttctagtggtctttatgccactgcttggcaatgcatacattcattttcctatgtctctcctggtcatataggtaaatgatgcagcatgatttggtgataaaagtttagtaactgggtcagccaaacctgggttcagatcccagctccatcgtttacaaggtagttgaagcaaatcaattcagcacttcatatatcagttctctgtcctgtatgagacagatggtacccagtggacatgaataaccaatagaaagcaactggaacacagagaactcaatgtacgctaacaaagtccagttgatttctatatatgggaaacattttcagtagctgccacaattttacctctaaaagcagagcgagtcattcctcagcaagaactaatggatcttaaacagaatctgagaagctcacctccctgacaatgacctcctgatctgtagaaagccaatctctctctctctctttctctctctttctctttctctatctctctcacctcaaactctacgattacaaattaggatcgaatccctcatatgtgtactttaccagttacatttgatcttcaaaatcaccctgtagaccgggcgtggtggaacacccctgtaatcccagcagcttgggaagctaaggtgggaggatcacttgaggtcaggagttcaagaccagcctggccaacatggtgaaaccctgtctctactaaaaatacaaaattagctgggtgtggtggcacacacctgtgatcctagctactcgggggctgaatgaggcaggggaattgcttgaaccgaggaagcagaggttgcaatgagccaagatcatgccattgcactccagcctgggcgacagagccagactgtctcaaagaaaaaaaaatcgccctatataggattgtccaaaggaatcaagcttgcgtttactctagatgtttagactagttcataggcaaagtgggaatacataaaaatcctaagtcacaacgttgtcatcaggatcacaatcagccaagatagatgcagtacaaaacataatgctagtgtaatgtttccggagcactgtatcatcttcaatcagtaaagattatttaattaaatggaattattaaatcactataaaattttattaaatgcatatatgtaaacttgtgttggcaaataaacaaatttgagctgtattcaagcagcgctgaattccttattcttagcaaataatcaaaagtattttccaaagttgaacattattaaatgaaagtaaaacatacgttaagaactagtattgttgtaaatatgtatgcaacagaaactaatcatgtgtacgcatgtgtgtatttcagtatcctgagtaggatacatataccacattaattttactagagattaaagctgatgaaatgaaatgtatctttatgaatgtatatgcatctgcaaatatccatgctacatacatggaagttaagaatttccactggccatttgttcagccacttgagcgttatcttctgtttcctctgattttacaaattccttgataaatttccaaaggccccttaaaatacataagaaatgaataccataggttagaaaaaaatacattaagcatgaaataaaatttcaaaataagcatctattttagacacatttacccaaaaacagacaagatgagactttgtaatcatttacttttttaaaacagatattttgagggagttttggccttgaatgtaacagattctctaaatagatagatggattcccctgtagcatatagtgtggcatgggaagtaggtgtaccatgaacataatgatatacttgagtccattcactttcattgccaaggccatgggaggtgcttccccagttttgtatttgtaactctattccctctttttaagaacacccaacatgatataaggaaccacaaaacctagatccacctgtatggcttgctcagcactctatccaatccctttctcccatggctttttctgccccataagctggagagtggggtgctctatgttctggcctctcttacggctgagagtgaccttggcccatggtgctggccaatgagatgtgggtaggagcacctagaaagaactgtccttcctgaataaaatggaaagcctcaaaatgagaagctctttgccatctgtcattcacatttccctttcttaatccatggaatgcggacccagttaatgcctgaaggcagccatattgagaccccgaggaggcagcagccacactcaaaggaaagcagggaagaaaggtgaggagccctagttccttaatgatgtcattgagcccaagccacctacacctaaaaatctttttcctgttgatacaaataagcctttccctatttaaatcatcatatggttttccattgctcttaataataccacattctgagattcaaactatagtaccaactcaaagaaaagtaactgtgcgaagtataagcttataatgtaaataataatgtttataccaataagtttagttataaacaaatgatataaatcagctacttactttttaaactagaattttcagagtaatatatgcataggagttttcaaagatttaacatcactaaaagccatataattggagaaaataaagccatgccttcccacgttcctgattcctgcccatgtgaattcaccctcacctccagctttatccaataaattcatttatatatgactaaataaagtgtacagattgaggtctaaatcttagactgagcattccaaagcacagaaaagaatgcaacatgtgtatttaatgtaagcattcatgagtgtgaacccttcaaaggtctatctagtctaatctagttttaaataactgatcttgagaacagcatgatactgctctagttcttttatcatgatgtcaatacttactcctgcctctcttcactgatctttcctatgatctgcttcacatggttttcagtaacctacaaagaattacgatcagttggtcatgcttattacacaggacaagcagtcaccagaggaaatatttttattgataaacattgattcacacaaaaaacttacttttattttcttctttaaaatcatattttctgtttccaattgtatagcttcatgctggaagagaagttgttttaaacacaatatacttggttaaaaatatttgttaattatttttctctatttaacaagattatgtgaatgatattataatttcaagagtactcaatagcacattacttaaaaacagatgaagaaacaaagcataaaatgaaggacaattaatgagaaggaaagatcctggtcctcccggtaaaaaactaggagaggaggaaattgatgtttcaaaatatcagaaaattttagggaaattccagaagtgaagggttcttcacttttcagaactaatgatagaatttgttaagggggctggaaaaatataaaaatacaaatatcaataaatcacatatatatcagcaataactgattataaactgtaaggggaaatttttaaattaccagttataatagtaatacatcccataaactcataagaacaaacataattatctttcaccaagttataaaaatacattaagtaagtataaaataatcccagataggagtattaatattgtaaagctgtcactttctcccaaatgcatttataaattcaaaataccaaaagtattattattagaacttcaaaaattaatcaatagtgttaatgaaagtattcaggataactgtgaacaaaataatgatgggcagagggtataaagacttgctctttcagatattacatatgttgaaaagtattagcaattttagtagttaggctgcatggggtatcattaagaaccaagcctgagtttcaatattaagtctactgcttgctaactgtgacctcaatcaagttacttagcatattagtgcttcatttctgtacttcaaaaagaggattaataatagcagctacctgttagggttgctgcaaattaaatgaaattatattttttaaatgttcataaaagtgtctgatacattgtaaatcctcaatacattcagctcttttttttttttttcctggttggaaatagtctatttgaaatctagaaccagataccaattacataatagaataacaatggcaattctattgtattttccagtatttgaattaagcagccaaatataaataagaagtagttaaagtaatataaattagtgatatggaatcttcatagggagttttctatttcttagacttgttttatctaaggaggttttaattatgaaagaatagtttacattgttctgacattatatcatgcttcaatatttaaatttagaacccattactgttttaaaatgcaattataaattgatgcttgtcctgaggacatttattttctgaaagaaataaaggagatcaaaccctaaacaaaaaccgcgaagaaaatctgcagggaggggccaagatggccgactagaagcagctgctgtcagcagctcccacagagaagaacgaaaatggcaagtgaatcctacaccttcaactgaagtatccaggttctctcactgggactgactagggggttggcacgacccacagagagcaagaaaaagcagggtgaagagatggcccacctgggagccgcaaggggaccttccgctcccagccaagggaggcagtgagtgattgtgttaccctgcccaggaaaccatgctttttccacagatctgtgcaaactgcagatctgaagatcccctcgtgagcccacaccatcagggtcttgggtcccaagcaggggtttacagacagaatgtctgctggctctgaagagtctagtcagtctgcacaagggggactcccccaagcgcagtgcacctgctccaccaaggggcagtcagagtgcttcgttaagcactcctgactgggtgagacctcccaacagggatcgccagacaccttatacaaaagcgtttctgttgtaaacaggttggtgctcctctgggacaaagctcccagaggaaggagtcggcagcaatctttgctgttctgcagcctccatttctgacacctccgggtgctagagggaccaaggtgaatagagtccgaagtggacccccagcaaactgcagcagccctatggaagaggggcctgttaaaaaagcaaacaaacagaaagcaacaacaagaaaaacatcaacaaatgagacctcaccaaaaccccatccaaaggtcagcactctcaaagatcaaagatagataagtgcatgaagatgagaaagaattaatgcaaaataactgaaaactcaaaaaaccagagtgcctcttctcctccaaatgatctcaacacctctccagcaagggcatagaactgggctgaggctgagatggatgaactgacagaattagacttcagaaggtgggtaataacgaacttcactgagctaaaggagtatgttctaatccagtgcagagaaactaagaaccatgataaaacattataggagctgttatccagaataatcagtttagagagaaatataaatgacctgatggagtcgaaaaacacaactcaagaacttcacaatgcaaccaccagtatcaatagccaaatagaccaagtggaggaaataatctcagagcttgaagaatatcttgctgaaaaaaggcagacaagattaaagaaaaaagaatgaaaggaataaaaaaagcctctgagaactatgggattatgtaaaaatattgaaactaccactgagtggggtacttgaaagagatggggagaatgaaaccaagtttgaaaacatacttcagtatttcatccaggagaacttccccaacctagcaagacaggccaacattcaaatacaggaaatccagagaactgcagtcaaatactccatgagaagattaaccccaatatacataatcatcagattctccaaggttgaaatgaaggaaaaaattgttaagggtagccagagagaaagcccaggtcacctagaaagggaaatccatcagactaacagcatgcctcccagtggaaaccttacaagccagaagagattgggggtcaatacctaacattcttaaggaaaataatttgcaacccagaatttcataaccaaccaaaataagcttcataagcaaaggataaataaaatccttttcagacaagaaaatgctgagggaatttgtcaccactaggcctgccttgcaagagctcctgaaggaagcactaatcatggaaaggaaaaaccattaccagccactacaaaaacacacagaccaatgacactatgaaggaactacattagcaggtgtgcaaaataaccagctagcatcatgatgacaggatcaaattcacatataacaatattaaccttaaatgtaaatgggctaaatgccccaattaaaagatacagaatggcaagctagataaagagtcaagacccatcagtgtgctgtattcaatagacgcatatcacatgcaaagacacacataggctcaaaataaaggagtggaggataacttaccaagcaaatggaaatcataaaaagcaggggttgcaatcctactttctgacaaaacacactttaaaccaacaaagataaaaaaatacaaagaatggcattacataatggtaaagggttcaattgaacaagaagaactaactatcctaaatatatatgcacccagtataagagcacccagattcataaaacaagttcttagagacctacaaagtctctaataatagtgggagactttaacaccccactgtcaatattaaacagatcatagagacagaaaattaacaaagatattcacgacttgaaatcagctcagatcaagtggacctgatagatatgtacagagctctccatcccaaaacaacagaatatgcattcttctcagtaccacatggcacttactctaaaatcaatcacataattggaagtaaaacactcctcagcaataacaaacagtctcccagaccacatgcaatcaaattagaactcaagattaagaaactcactcaaaaccacacaactacatggaaattgatcaacctgctcctgaatgactcctgagtaaataataaaattaaggcagaaatcaagaagctctttgaaactaataagaacagacaacataccagaatctctgggatgcagctgaagcagtgttagagggaaatttatagcactaaatgcccacatcagaaagctagaaagatctcaaatcaatatataacatcacaactaaaagaactagagaaccaagtgcaaacaaaccccaaagcaaggagaagacaggaaataatcaagatcatggcagaactgaaggaaatagagacacaaaaaaaccttcaaaaaatcagtgaatctaggagatggtttttttgaaaaaaaaattaataaaataaatagaccactagctagattaataaagaagaaaagagagaagaatcaaacagacaaaataaaaaatgataaagggaatatcaccactgaccccacagaaatacaaacaaccatcaaagaatgctaaaacacctctatgcaaataaactagaaaatctagaataaatggataaatttctggacacatgcaccctcccaagactgaaccaggaagaagtgaatccctgaatagaccaataatgagttctgaaattgaagcagtaataaatagtccacaaattttttttaaaaagcccaggaccagatggatttacagctgaattctactagaggtacaaacaggaactggcaccatttcttctgaaacgcttccaaacaattgaaaaggagggactccttaactcattttatgaggcccgcatcatcctggtaccaaaacctggaaaagatacaacaaaaaaggaaaacttcaggccaatacctctgatgaacattgatgcaaaaatcgtcaataaaatactggcaaaccgaatacagcagcacatctaaaagcttattcaccacaatcaagttgccttcacccccaagatgcaagactggtttgacatacacaaatcggtaaaatttatcacataaacagaactaaagacaaaaaccacatgattatctgaacagacacagaaaaggccttctataaaattcaacatccctgcatgtttaaaactctcaaaaaaactaggtattgatgaacacatctcaaaatagtaagagccatttatgacaaacctacatccaatattatactgactgggcaaaagctggaagcattcctctttaaaactggcatgcacaagataagaatgccctcgctcaccactcctattcaacataatattgggagttctagccagggcaatcaggcaagagaaagaaataaagggtattgaaataggaagagaggaagttgaattgtctctgtttgcatatgacatgattctacatctagaaaatcccatcatctcagccccaaagcttcttaagctgataagcaacttcagcaaagtctcaggatacaaaatcaatatgcaaaaattgcaagcattcctgtaaaccaacaacagacaagcagagagcccaattatgaatgaactcccattcacaattgccataaagagaacaaaatatctaggaatatagccaacaagagaagtgaaatacctcttcaaggaaaactacaaaccactactcaaggaaatcagagaggacacaaataaatggaaaaacattccatgctcatggataggaagaatcagtatcatgaaaatggcaatacttcccaaagtagcttatacattcaatgctattcccattaaactaccattgacattctccacattactagaaaaaaaaactattttaaatttcatatggaaacaaaaaagatcccctatagccaacacaacactaagccaaaagaagaaagctggaggcatcatgctgcctgacttcaagctatactacaaggctacagtgacctaaacagcatggtactggtacaaaaaacagacatatagacaaatggaacggaatagagaactcagaaataagactgcacgcctacaaccatctgatctttgacaaacctgacaaaaacaagcaatggggaaaggattccctatttaataaatagtgctgggataactggctagccatatgcagaaaaatgaaactggacccctcccttacaccttatacaaaaaataactcaaaataggttaaatgcttacatgtaaaacccaaaactgtaaaaccctagaagaaaatctaagcaataccattcaggatataggcataggcaaagatttcatgatgaaaacatgaaaagcaattgcaacaaaagcaaaaattgacaatgggatctaattaaactaaagagttctgcacagcaaaagaaactatcatcagagcaaacagacaacacacagaatgggggaaaatttctgcaatctatttatctggcaaatgtctaatgttcacaatctacaaggaacttgaacaaatttacaagaaaaaacaaacaaccccattaaaaaatgggcaaaggacatgaacagacacttctcaaaagaagacatacatgtggccaacaagcatatgaaagaaagctcaacatcactggtcatcagagaaatgcaaatcaaaaccacaatgagataccatctcacaccagtcagaatggcaattgttaaaaagtcaagatacaacagatgctggcaaagttgtggagaaataggaatgcttttacactgttggtaggaatgtaaattaattcaaccatcgtggaagacagtgtggcaattcctcaaagatttagaactcaaaataccatttgacccagcaaacccaaatcccttttgtatatacccaaaggaatataaatcattctattataaagatacatgcacatatatgtccattgcagaactattcacaatagcaaagacatggaatgaacccaaatgcccatcaacgataggctagattttttaaatgtggtatatatacaccatggaatactatgcagccataaaaaggaatgagagcatgtcctttgcaggggtatggatggaactggaagccaatatcctcagctaactaatgcaggaacagaaaaccaaacaccacgtgttctcacttataagtgggagctgaacaatgagaatgcatggacacaggaaggggaacaacacacactgggggctgtcaggagggtgaagggaggtaaaacatcaggaaaaatagctaatgcatgttgggtttaatccctaggtgataggatgataggtgcagcaaatcaccatcgcatacatttacctgtgtaacaaacctccacatcctgcacatgtaccctggaacttaaaatagaaaaaaataaaataaaataaaataaataaatgtaaaaacttagcctgttaaaataaggctagaatcagtacaattatttcatccagtagtatttcattcttacaacagtaaaccatagcgtttcctctatatttaaataattttcttctaaaacaggggtcaaaaaactaatccagtctgcacctatttctgtaaataaagttttattggcacacagccatgtcccccctccaaaaaaaaaaagaaaaagaaaaagaaaaaagaacatccgaacatatgattgtaaaagagaaagagataattttttcataaagaaggttggaccaccaacacctttctatatgctctataattctgctaaagagaataaaagtagtgctggaaaaatatatttaactatagaaccacaataaaaaaaatcatgtatttcttatatactctacaactggaggttacattgagttatattctacacaatttaaaattctgtttttaaattttttaacttttatggatttaggggtatgagtgcagttgtattacatggatatatgtgtaatggtgggctttagtgtaccaccacccaaatagtgtacggtgtacccagtaggtagtatttcatccctcatcccccttccacactcccacattctggagtcttcaatggctattattccactctgtatgttcatgttactcaaaaaattaggttttggctattaacagaaatctatagaatttttttatcactttccttttttcttattttgatagatcttttaattattatgattatttgctacaaacattttgaaataaaaagtacatttgggccaaattttatgatttttttaccctattaccaaatcacattacttcatgtgtttgccaaggtcttcaagcaaaagaataatgtaaatatttaaataaataagttgcgtacctctatgcttttaatcctattctcagtgatatctgaaattccagtatgaaccaaagttgttttaatttctttttccagagcttgtatctcatcccacttactgagtatttcacacctcttcttttcaaccttctcagtaagagtaagtcggttttcatcaattatatgtttctcagatgattctggaaatattttttaaaacaaagtattaccatgtttaatatctcagttattattaatagcattatgtattattaacaatattatgtatgctatagtatatataactataaaatataattcaaactcgaagcatgtcaataaaaataatctgaccccagaatgagggtattcctcctttaattcattcctctaatcaatacatatttgttgaacacatttttgtgcagacactgggctaggtagaaaggttcaatggtgaattagccctttccagagtgtgtgatttagcagtgcagaccaacaagaaacaacaagaaagtgacagtggcagagcagaaggtgcaacggtaagacaaagcaagaacatcagacacagcaggaggaaggctcagggatgactttgccagagaagtgtggctaggttgaaatacaaaggataaagagaagttagacaagcagaagggttttggaagggagcagaagacagaatttagacattgagggacaatcctaggagggaaacggggggcagatctgagaagatttgtgacctatgttaagaaatcggtcaaagatgttgagggcttttaatatgggcagagacacaatcagacaatgatcactgtctccagtgaaattgtgtcctgaaagtggatcagacagcacaagactagaatcagaaagacctgttgggaagctatggcaatcattcacacaggttgatcgggtcagggtatgtattagtctgtttcacgctgctgataaagacatacctgagactgggcaatttacaaacaaaagagatttaattggacttacagttccatgtggctggggaagcctcacaatcatggcagaaggcaaggaggaggaagttccatcttacatggatggcagcagccaaagagagaatgagaaatacgcaaaaggggaaaccgctgataaaaccatcagatctggtgaaacttattcactaccatgagaatagtatgggggaaactgtcctcatgattcagttgtctaccaccaggtccctcccacaacacataggaattatgggagctacaattcaagatgagatttgggtggggacacggagccaaaccatatcagaatagtactcccagcatgaagagaagtgaacaacaacaacaacaaaaaacgatttaggaaatagaaaaagaaaatagaccttagtaattgactagatctggcaatgtagagaaggcaatgtcaaaaataagccctaggttttagctcagttgtagctagaaagaaaacaatgagttcaatgaagcatggaggtaagaaagaacttggtttcaatcccaccttggccacttatttcaagctgtgttggaagaggttgaggggtaggagagtgaaagttgcctggcacatgttctatggctttcatctccatgtgtttggtgataccatccattgaaatagccagggggatgccaatttagagaaggagatgatgagtttaatctcggacatgttgaaatacctatgggacactcaagaggccacgtctaataggcacttggatatacagatctcaagcaaaaaagaagggtttttagcaggtaaaatagatttggaatttaaaaaaatgttaactcttccaaagagatgctggactccaaagaatatcaacatttaaggagtacagaaaggaaatggagacatcaagtgatccactgctaaggccaatttgtcatcaatcaacacagttatatactaattagagtggtgagacttaattttttgagaaaaaaacaattactacttttcgatgggaacaaaagagttagaaatattaataacccttcctggtagatagtaaacaaggtggaagtaacagccatcattcaactttgccaaatttggaagaggagaaactttgacattaaattttgaaatttggggaaattaagtaggcacatgatgagctagctgaggggatagaaatggtcatagttaagcttctacacaaactgaaagaaactacaaaataaagtatttgttctccgccttaacctaagctgaaggtttcagcccaaaaccatcagctgagttcaaagaggcaaaaaggaatgtcaagcccagggaatgacctccacctcacccttttctaccctcaagacataactatagggaaagactgaggtatgaaaatggggacattccacagcaaatgtgtatgattggaggagcaggctcctgagatagaaagctttgggaaaataataaagcaggaagaaccaggggcaccaggtttgttccatcgcaatgaaagggtgatgggaacagtgggctaggatcaaacacgaagaaagattactagagctctggaaagttcgtcactgcatcttatttttattaatctttgccatttttttattagtggctagcagtaaagtaaagcccttaagtttctgcttttttgtttttttgttttgtttttaaatcgtgggcctgttttaagagaaagcaaggaaacagaaaacaccaagcatgggtcctatttcacgtctgtgagaggaactctacaaagaacgaacaacgtggtggaagaaggagggaagcaggtgacctctgagccctgagaagggatggaaggagaagcagagtcagcctgggacagagaacaggcgggacaaggggatgcaaatcaggcgacaagaaacctgtgcaggatccagcagtgttaacagcacccgtgctgctcataggtagaaaagaggaaacaggcagcagggggaaaaaggcggtaaaagcactctggcaaggatcttcgaggccaagctctactaagaattcaaaacaggatagtcctgtgagcatatcctaccagacgctgagaaaaagtatctaaaaacagagtatgagtgagtgtttaacaaacttggagggaaaatggcatttcatttaaagttggaaaacagtcaaagttaatgagcaagatacttaaacttatttttatcatataattgcattctaaattgtatacattcaaaataattttaatatctattttgtaaaatgttaatatctatttcataaaatattcataaaatgcaattaattcctcatgaaatgcgtatttttcctcacatgtaataatgaaaagatgaagaacaaacaggcagtcaccaccacgtgccaggccctgtgatcttgggtgatgtgggtgaatatgttgaattctcgcaacaaaactcagagggagcatcagcatcttccaagttgacagacaggcagccacactgcagcagctgaaataatgaaggtcacagcaaagcacccataaggaaggacatcacacagacacctgcctgatcgttcctttgcagactgcagcaatgccacctccatctccagttcacttctgagtctacaatgtgaggataaacaatagggaaatattagatccccattatatcttttgtcttttgtctgggttacaccacaagtctcttacagttgagaaattaaaatagatctgcttacttttaacacgacagatactctgaagatatttattaaatgacagcctaaatcagtcaagttaaacaaaataatactgtcttaccaagattgcataagcctttaaagagttagttaatttaaaataaatgatttcctgtagaatttattggtattttttgttaatgcaattgctaagaaggaagaaggcaaaaaaaatttaaaaaagataatttaaaaaaacgtagcattttacactcagaggcaaacaacatgttaagggctatggaaagactttcctgatgctgaaatacacggcatctttcctgtgtattattattctgtgcaacagatacgatttacaaatttcactatgtttaaattaaaaataaaatacaagaggccgggcatggtggctcatgcctgtaatctcagcactttgggaggctgaggcgggcagatcacgaggtcaggaaatggagaccatcctggctaacacggtgaaaccccatctccactgaaaatacaaaaaattagctgggtgtggtggtgggtgcctgtagtcccagctacttgggaggctgaggcaggagaatggcatgaacccgggaggcagaggttgcagtgagccgagatcatgccactgcactccagcctgggagacagagccagactccgtctttaaaaaagcaaaaaaaaaaaaacaaaaaaaaaaaaagtaaataaataagtaaataatacaagaaactttaaaaaacagaaaaaaacctccttgtttcctctgcttggttcagagtaacctacatcagctatcttatgttttatagatttaaagagaaaacaaaaaggagtctaacaggtattacatattttgaggacaacactgtgatttgatttaaaacatccacatgcaaataatttaaagccaaatgtctacaaagggcctaacattttaagagttttacacatgttagttcttttcatcacagattaagagagaaatagggtggttattatgaccctcaattttaagaaactggagccaggtgtggtgactcatgcctgtaatcccagcactttgaatggccaaagcaggtggatcacttgaacctaggagttggagaccagcttgggcaacatggtgaaaccccagctctacttaaaaataatacaaaaattagtcaggtgtggtgcctgtggtcccagctacttgggaggctgaagtaggaggatctcttgcacctgagaggttgaagctgcagtgagccatgatcatgccactacactccagcctgggcaacagagcaagaccctgtctcaaagaaaaaaatttaagaaactggggattcaatggattaataataatgatgaaagtcttttcaatatatgtagtaagaaagttttatttccagaaaatttttacatattatagttttaaatattacttaggtttttgttctattgctttgtttttcttcttcagggactttaattatacgtgaattggacattatttgcttatgttctatttcatctactttttctgacttttgatttctgtatctcatttacattcttttaaatatttttctactttttcccaatgcctattatgttttcattcaaaactattcttccttgggtatttcagaatttagtcttgacctatgatataattttgactttttcaactattttttcctcggtttttatcttgttttatttcttctttattgttgttgatttctctccttagtttttaaatttatgactcaagattgttttcatgtcctgaaatgctctttgggaacatgtaatttagcttggagtgctgtgctacagttttcttcttgttcaactttattattactattccttggtaaggcagggactttcatcaggtaaatcatttggattctcattttctgttcttttctcatagtagtttgtatagacaaagattgtttacacctctgcatttttgccagctggactagtgatttggagtagtatgtgagattgctaattcaaatggatacttttccgtcagtgtagcaatttatactattttattattgatttattgtttttttttttcggtgttgttttgatttccttctatagtcctggataccttgcttgtttagaggggaaaaggacagtatgtggaagggttgtgtgcaccctgattttcctttttataggtttctaaactttcctttcttgctccctattgccttcactggacatttctaaaggatgctgctccctttcccttaacccccttctcacatgtattattaccatttcaaagttgtcttctcacttctaccctctcccaagtaaccccaccccaccacacccccaccaccacacccctgccatcatagtcaatgctgccatcagcccagcaggacagttgtgtggctttctcacttatgtggattctctctctggaagtggctttggaacaattttaggcctccatctatctccactgttctctcttccatgaacttttcccaaaacctcacttgctctcacaaacaaagctttgcagcaggaacatggcaactggttcactgccactgaatgttttctttcctattttcagtcatttttaaactttggatgcatttgcaatgaattcagttttttgttgttgttgttgttgttttcgttttttgtttttttttttttttttttttttttttgccttggcattcactttgaacagaagtttaattttctcactccagaagcagggctcagtcaccattgcttgacacagtttctcgtgcttctcctcctcccagtgcctcaaaatggtcagttcagatatctgccttaaacaaccacctcccagggatcacccactatgagacagctaaatacaacctactttcctcaacccactgaccccgcaccctgtaggggccatgagaatatgctgcagtgacccagaaagcactctccatcacagtgtgaccccacagaactcgtgccttcttgccctaaacccaccgatcagaattccccatggaaaacccgcttgggtcccgctctggacccaaacaaaagacttggtccatcggtcctcactctctctcttgctcccctacctgctggtggagcgagtgtgtttcaggcagctccccacttcctaccacccctgagaggtacgctgccttcttttctctgggatccgtaagtaacaaatctgctatttaatgtgctttgttctgtggccttctctgtgcctcacctgatggacacacttgaatgtcaccttttaccagccagggctcccctagagactggctatcttggtaggaataaactagatacacaccagacaacaaccacgagggcttctgccagtatagtcgggtttcttgtgagaggaatatctggtcacaggtcagacacttggacattaagcctgaaggccaggatgaagacacatcccatgaagggtaccctgagaatatcctccaccagcccccaaagctccatcaggggagggctagagttcatagccacccttgtgagagagaccttaagaccaaattggaggccaggtgtggtagctcatgcctgtaatcccagcactttgggaggccgagatgggtggatcacttgaggtcaggagttcaagaccagactggccaacacagtgaaaccctgtctctactaaaaatacaaaaattagccgggcgtggtggtacacacctgtaatcccagctactcaggaggcttgaacccgggagatggaagttgcaatgaactgagatcaccccactgcactccagcctgggcgacagagcaagtctccattaaaaaaaaaaaaaaaaaagaagaacaaattggaacaacaaatacaacagttctctgtcttctggttacactagaagccaaattttgttttttggttttgtttcttgtttcatgctcttgaagatattttggatgttgcagatttcctttaatcttttttcaaatcatacaaagagtatgccctatccaattgttattcgaccccggaaaatgatacagagaggttatattagaagagctttgtaagttaaaaaacaataggggcattcatataaggtgtcttagatctgcagccctctcgcctatcagtcagtcttcaggggaccaccagaaaagacaggcaattccttgagaaacctgcccaaactccccccatggacacaccatacttagcagaatgtcttagtcacataggtgatggcctgtagaaatagccagatgacaggcatgatattagcaaaagtagcatgttttcagcaacgcagaaatcaatgtaaccgtaggcttgtcacagcggtttcagaccttgttacggaagaatctaaacatagatcagatccgtccctcatgcctcacctatcattctgctccagggctgcttttgtggctgtcacgagcatcctcagctcttccctggcgagatccatgtccgccgtcttcaccggcctctgccccagcgccttgagttgagccagaagagcctaggcaggaccaggtacatgaggtgagacaagcacacagggagggcgggaggactccctttcttatttgtcattaatgcgttttcaaggtgccctgggttaacatataagttctagttaaaataggtaaattgggaggatttaagggagggagggccgttgggggagggatggcccatcagtgaagttcccggtaaaatacctttttcaatatgttaaaagtttatttttctaagaaatggaaagatggtagggaatttccctgttggcccgtgtggggggaaggacatactggataaagtcctggaggcacattgtcagtggcaccgcaatcgtttcctctaggtgaatgagaagccatgtgaatgtgcttgccatccgcagatgtaaagcagtgctgtgctcaaatggggagcaacagagatctctgcttcttaggggatgggttgccagggttacagacacagaaagaggcatccagggccctgctggcctgggaattttttcatgctcacatttgaccgagatagggacgtatgccacttatgactcaatctcaaaacgtaaggaacaaggtaaattccccactggaggctttgctcattcttgtgaagacaaaggctgcttctgtgttatgaaaaggctcagcacaaagaaaatggtactcacatcttattttacatgaagaagcaaactagaactgatctccttgcaatgctgtgatcttttgctcatgtataaaagaagcaactatctttcctaatttatgaagtaaaattaatctttaaagtgtattgaattcaaaataccaaagttatcttagctatcttagctacagtgttagattttcttaggttttataagtgataaagttattcctgcagtatattttcttatttgaccaatcacatgtttaacccgaccctggaagggaacacctggaacgctgtcacccgttaaacaaagagatcatggggtttgagtcagcttacagcacaccagccatcacaatgcattctcagtgatttcgccaggacaatggctggacagtggtttttggaaattactggaagagaaccatttatattcccaatttatacatagatagttatgtcgcttgtttgggagtataaataatgctatgccaatcaaaaggaaagttctttatcaataatgttattaaggcagtataaaactcatctataacaaagaacatatcagctattctaaattatggggcacacatggggcttcttggattcagaaaggtttccactgctcatgaaatatgaagctatggataagcaggctctattcaggctctttgtgatcgatcgtcacctcgtactgtgctgcaggctgggactccaggagcgttgccatgtagagttcatattcatcctgtacagaaacaaacaaaagtccactggccatgtatgaggaggccacagtgcaggtgtttcacgtgtataaataatacggaagtcaagaatgttcatttagatcatttcagaaaaatataaaatgttcccacaatgcattaaacggtatacatgctcacattgataaaatcacaccatctttgaagcatatttgagcattaagtattgattacctcagaatatcataaaataccatacaataaaatataaaatattgaggcaatctctgcctcccggttcaagcgattctcctgcctcagcctctgagtagctgggattataggcatgtgccaccacgcccagctaatttttgtatttttagaagagatggggtttcaccatgttggccaggctggtcttgaactcctgacctaaagtgatctgcctgcatcagcctctcaaagtgctaggattacaggcatgagccacagcacccaaaaatcactttcatcatgaaattgcaacaaacctataattccataaggattcaaataacattacacatgtaaagttaaattattaatttattagaattataattaagttatataaaatttataaacggttatgcataattaggaagctttagtgggaaaatatgggtttgaggaatgagttaactgggtgttgattccacatggccccttacaatttacgtgcctgcaggcagatgacctcgagtctctgggagtgatggtccctgtctgtagaagggggcctgtgatacctagcagaatttcagtgcggcttgagatcattcttgtacacagaacctcatgcaagcttctcaactgttatgctgaagatgtatgtttcttaccttaacttttttcaagagatcaccaaatatcaaagaactgttacaaatatcttcaaagacttttccaaagacgtgcagtctgttgaactgctgggggctgcacgtgcaaattttctggagctcctggaggaaaaacagagtcagcccatttcagggtggcttcatctttcttccagaaccgaatttctcaggagtcagtgaggacacagctgccatcaccctggcgagtgggcggggcggcacagggggccagtctcgggggttctgatccctcccaccagttgctgagcttctttgtttccctggtcacccaagatgtgggatttttttaaaaaaatcttttcttctttattgactcccttgctccccgtgctcaagcattcactctccgcctccacagtccccaaaggccctttctctcttccaaccccaaggcctggctgcttcctgggggcctgctattttcttctctttcgtgcatcgtccccatttggaggtgatgcctccagtcagctgttctcctctgagtcggcagcctaccgtagatcttctgtacacatgtgctgcctgggcatacctcagggcgtgacagtgcccatcagctctccctctgccctcacggttcttccaccgtcagccaggcaagccctctctcagacccctctgctgacctacgaacatctgatttactgttgcagccacatggcctccaatgcgtccgctatgggcctcccccagctgaccagttcccagaaggcgccctccttcatttcacccaaactgtccccattgaaggtgctaatgctctcggcacctggtacagtgctgcatcctgcctggacgtatccgggaagcctcagaggacgagcctctcagctcaccgtcgtggctgtccctgacccagagcactgcgcccagaggctgcaccaagagcactgcaccgagaacactgcaccgagagcactgcacagagagcactgcacccagaggctgcaccaagagcactgcaccgagaacactgcaccgagagcactgcacagagagcactgcaccgcgaggtctgcaccgagaacactgccccaagagctatgccccggagctctgccccgagaggtttgccccagagctgtgccctgagagcactgcaccgagagctatgccctgagagctcttccctgagaccaccgcagggctgccctcctcacctgctgcagctttctctcgtggcccgcggccgccttgctcccagtgaagtcattcttcaggagatcttgcttggcgagcacttccttctggaaacgcaggaacatcctgtacctgtctgcgctggtggctccggccaggtaggagctgacatagtggtgccggtccctggtgcctctggacccggcctcctggtagcacagcaccttcaagtcgggcagccggagttcttccctcctgcgccatccaggagggccccgtccaggagggcctcctttcttttcttccttcccctctctgacagcctccactggaaggaaatcctcctctgaagtgtgggaaagagaggcctgggggttcaggtacctgaacagcggggtgtcctgggcctcactggggaccagggccgtgtggatggtgaagtgggccagggcctccttcatcctcgccaccttccctgcgggcggctctcccacctcagaggcgcgctcccccttgggccggtgggcattgggccagtgctgtaagatcgtctccggaggctggtagagcttgttggggttcaggtgtccagagatgtagaggtagacgtcctcccggtggtctttctgaagccgattcagaagtttcttcagattacacagggtcttcactcctggcgtctcgcagtgcttcagattacacagggtcttcacgcctggcgtctcgcagtgcttccacttcaggtacactggtcagaaaagaaaaggaggctcttagggatcgctcttagttccacagtaagtcagctggtgcactggctgagaggcgtagcccctgaccaaaagagggtctatggagaaacagacgaacagagtacatggcccagcccttaaaagtcaaaggcacccgtgcccggcccagtgtgctgctgcagatgagaggcgcccaggcccccaggatgtgcaagtcaacccgaaagctcaggaccgtcaaagccaataagaaaaagacagactatcttgatttggcagagtatttcttacaatactagcaaaggctctgaaagaaaagtgtacaatcttaattataattcttaatgatgatgcttaaagatgtcttctttaacgtatttcaccggccggggaattcagaaagggtttggggggtattctcacttaatgataaactgtctcagcagtccctgactaaacccctcaatgaccaatggcacacacacctcttcctgcagcatccctacagagccaacccccagggcttttgaaccacagttgcctcctctgcaacatcagagtcatcatctcaatcaaaattgttgattgacacccaggtggaaccacttttggcaaagaggcacatggcctagaagagacgcttcataaattctacccatttttgctgcaggtctatagtacaggtaacacgttactgaacacttcagatagaacaagagcagcccagatttgcccccttcatttgctgttttctaacctaagaaggagagtttctttctgggacactgtgtactgtgatggccaaagggcagcaggcccatccataccctcctcagagaaacttcctctgtccattgagaagcaaaccatccttccctgagtcaaccaaggcggctgaatactggagccaatattttcagcagagggatgctagagaatcgccgctgttgatcagcttagtccttcagagcaaccacttaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagatctgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaaggataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctccatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaactgcttcaaagagaataaaatacataggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcacactccctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattcccgatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagaaacttctcaaaagaagacatttatgcagccaaaaaacacatgaagaaatgctcatcatcactggccatcagagaaatgcaaatcaaaaccactatgagatatcatctcacaccagttagaaaggcaatcattaaaaagtcaggaaataacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactatccacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaattataaaaaaaaaagaataatattcatagaaatggaatttctaggtgaatgcaaaaaaaaaaaaaaaaaaaaaaaaaagaaatgattaacagaacaaattctccaaggcaacaatcattgtaattcgtcaaaggcatgaacacttaaagctctaaaaggcaccttgtaccaactctatggaagatggaagaaggaggcgacttcattgctgttgtgttatcctttgtttattttatttccaagaaggatttgaagccatcagcaagtcaatcaacacaatcattttcccacttcaaatgctttttcttttgattgtagtaagagctgctccagacagaagtttccacttctgtctgccacattcttgtaatatatgccatgaatccccatcgtggcaataaatattttaatcattttcccatctgaaaacattgtgtgtgtctgtgtgtgtgtgtatcctgcctctctgcctgagagagaaaacaaacaaacaaaaaagaaagttttaagaatttattggaaattatgactctcttacaaagatttgaaaacaaatttgctgtcagtaaaaccaaaccaagttttgaatgtgtactgaataggaacatgtagtaataggtcttaggctacatttgggttaatacatattgccaaaatttagtattaaacatttttaaacagaggttttttatttgtttgtttctttggaaatgtatccatccccccaccccccccaccccaccaaccccagaataggacaataggcctttaatgtcaaaattattacaactcaggctgggtgcagtgactcacgcctgtaatctcagcactttgggaggccgaggcgggtggatcacttgcaatcaggagttcgagaccagtctggccaacctggcaaaaccttgtctctacaaaaaatacagaaattagacaggcatggtggcgggtacctgtaattactgatactcagaggcggaggcaccaaaattgcttgaacctgggaggtggaggttgcagtgagtcgagatagcaccactgcactccagcctggacgacagagtgagactgcctcaaaaaaaaaaaaaattttttttaatcactgtcccatgttgtcagatctctgggaaactgagaatcccatggaaattctccttggtctcattctagaacattcatattccctctgcgtttctgccctctgccttctctgctcctaccctaaagtcagtgcacatcctaagaaatgtacttctggaaagacttccaagaacagagcagcaggcccagacccacaggctctctgctggaggagagcgggagcctcaggacaggcctggccagtgggggtctgtcctcgagtcctgggctcccctcacagaactcgttgcagaactcacaaagagcgtccatcactcccctgtgtccatcctaccagccggagaatcttttcagactccactgagattgcaatctggcctttcctgaacccacggataaacatctgttgccccacgctgcactgtgtgcttcaggggtgggatgaatgtgagcccccaggaacctggaaatcccacagggagtgagatgcagacccagggccacaggggacctgagcccaagggagaagcacatgcctcacatggactctgtctcagggtgaaatgtggaagcagaatgatgggacccagagctggccaccctgacgccagaggtcagggaaaggggactttaccagctgaattcaggtgatgggccttaaaataaagtgattagtctggatggtcagggctctaatctaatcacgtgagcccctaaaagcagagaagtttctctggcaagagtcagaagggagaggtggaagaaagggggtcagggaagttgcaaggaaaggaagcttccagactcgctggatcccaggtggaagccacaggccagacaggaggcgacttcctagggccagggcccctgctgacaacccacaattcccccaccacaagcgacagggtcatgccaacaagtccactgggcctggaaggggttcttccccagatcccctagaaagcagcaaaactgaccttaccctcgagtccagcctggtgacagcctgaagctctttgtatacaaagaagagaaaagacaactccccaaggactgaaagacccctttttaaaatgactcccactgtctattccacagccggtgtgcggcatgctgattcaatccccacaacagcccaggaggtaggcgccgtcccatcctcctttacaggaggggaaactgaggttcaggtggtcagatggtcagctgcctccaagaccacgctctcaacctgcccactcacctgtacatgaagagcactaaatgcattctgatatcacacaataaaatttcttttaaatcattttcttgttgagactgctttgctcagtctaacaagttttctctctgcccaaatttcgtctgaatcagtcggtagtcctgtttcagtcccagcacatggcgggtggtgggaaaaagcgaaggcttcgaagtcaaaagacctgggcttacctccccacagactcccatgcgtaaaatcacattaatagcaccagccttcagggtcacagagacaaaataaaggacttctgacttgatgaatgtggacgcgctgagctttgtggtcatttataggagcgcggaaaggcagcatgccagggaatgctctgaagtgcggctttttaaaatcaccctctgaacagcctgcaacctgccgcttcgtccctcctcctcctcctcctcttcaggcttccggagactccaacacacggcgcgtccgtccgcgcaggtccacactcgctggctcccacgcccacatggcgcgcaccccccacctctgtgctttgcgcgctggtttcagattctctgaggaggcagcacaaccccaatccagtcctcagccctagtgaccctggagccggcgtgcagccaccagaaaaagattttcacatttcaaatcagtcttcagaagcccatccctccacaattgaacatcaagcaaatctcacaagccagcaagagccgctccaggccacttacattcaggctcccgctcctccgccatcgcttccttccctccagctgcctgggctgggctgtcgccgtggaaaccacaaacattctaagccctccttggcttccttcactgctgagcaaccaggcacagcccctgctgcggaacctccccccaactcctcccctcttctgtgccttctggaacagagagtattggtgattgcttgcttgttttactttttttttttttggttaataatttttttaattttaatacagccggtgctctttgtctgggttccacatccacagattcaacgaagcacagatttaaaatatttggaaaaaagttttaaattaaaaataacaatacagcaataaaaatacaaataaaactatagtataacaattacttagatagcgtttacgttgtcttaagtattacaagtaatctagagatgatgtaaggcatatggaaggatgcgtataggttatatggaaatactgcatcattttatataagggactacagtatctttgggtctgagcatccgtggtggtcctggaaccagtcccatcccccatacaatactgtaaataaaacatttgtttttaaaggtacatcagctttatgaaataagtgaaacactttccgtgatctgaaaaatatcaaagtatcctcgcattccctaatcctttccaaagcccagggggcaaaagataactggtcttcaggcatctgctatagaaatgtgcaggttggacagtgcgtaacccacccaactgcacctggaggtccagcacagagtaggtgccagtcacgaagtgatcatttagtcactttttattattatctatgtattttctaatggggaactgagatcctgtggggtaatttgcccaaggtcagttagcagacagtggaatttacagatgtgtaagtgcgcacctgtatgactgcaaagtccatcctctctcctcaggcgatcccatgtgccaagggagggaaaagctaaaacctctatctttgaaaactgtaattctgtttatatgtcttgcagccagaaagagagtactggaagggcgattctgctggttcttagaagtaactttgacgccaacccttactacttacagctctgaaatgagaaagacggtgatgtaggcgttactggttgtgaggatggaattacacggtactgtgaatgaggggggcacacagtgttttttgtttctttgtttctgttgatgctgcctgttagttcaaactgcaccattttgtaatcccagccccatttcgcagaccctggtcaaagtgaaatattccacgggggtcggaccacgagaaatgtcctgcccaaccacctgactttcttgttatcccctgcccggcaaagccccagctgaaggaacatcctcatcatatcctctgctgggcaaagatccaaggaacattctatcacatgccccccaaaacaggaacattctatcacatccccccaaaaacagggccaaaccaccttgtcatggaacatcttatcaacatcttctgggaagcaggctataccccctagtcccctcccgcccaggcctataattgccccagcctataagcggcggtcagcactggcattaacctggtcccccatctctgcaggtcttaggctggacatagaacccgaatcgctggagagctgccagttatctctctttaacccttgccttcccttccaaacataacactggacagatacttgaaacgtgaacattctggaaaccaagaagctgccaggaccttcacctgctcaggtggcttcatcaccaggtgcattggaattccacctgtgaaaaggttaccggagtgtttactgcttgtctctctggaacgtgcatggtagttaggcatcttaactatgacagaaaggtcgacatgaagatgcccaagctgcgtaaggatgtctaggtatgggcaccagagaggaaatgctgtgtgcccctcgcctgcagttcgttataaagtaggctcacatgggcagcggagaggaaacactgtgtgcccctcacctgcagctcattatgaagtaggctcacatgggcagcaggccaggtttttagataaccaacaattagagatgaggaaatgaacctctatgctcagaaatccttagtaaactagtcaatctcataacttctaaaatagtccatcgcttccacactgcgcagtcaggcagagaggtgacaataggtgttctccacttttctttcacagatgggcaggagggacaaagggcccctctgccggccttgggagggatagtgatgaggagtgcatcccaccacgagagctgctcagttctggggttcagcctgtgctaccctcactcctgctccctagcgtagacattatgtggaattgcagagtattggttttgatcaaaagaaaataatttgtttttagggcctcagtttctcccaagtcatcccttatggcagaacacaaatgcagttaaattaattcatccaccccttacttatatgctatcaagatcagaaagtcaatgatcaaatcaatatcaggccttaaaagcccatctgtggctctcctattgctaaatatttcatcaaagcatttgaggcagaaacatacttaacgacaacattatcagcataatgaattgatgtgccagaaacacactggatcttccttgaggccagacttctatgtagaaatagccaagaactactcagcaggcaaattgcgtctgcacatatttcagtgactatggctgctgttttgcttatccactccagatagcgcttgaacacatcctaaaacacttggccactgaatgcaacccaagggtgaggccattctaccatcccaactaatccacgcatccacccgtcctttcatcctacccctcattccagaaaaaaaattaaaaattaaaaatctttgtctactattgtttctttgctaggactgcagaaatgcacaatgaatcccctactttaaaaatgctcggtgaagaggagaccactggggagtaaaatgcagtgtgatgtgagcagcagtggagatgggcgtggaccggcagaggaaggagtgaaggattcacatctcataggctgcggaggcttccagaaataccacctgttccaggtgtgcaggatgggcgagcgggagttccttgtcaatcatgggggagggtcggggagcatcagtcagaagaactgatgggttccaaaagggaagaggtcacaaataagtgattccagttactgcttttcagctattagactctgctgtgcaaaaatgaaccgacttgcaataacttaaaacatctttgtgcttcctaagctctggagaaactgaataatgcttttaagaaattttagatagaatgcaaagcaaatgctggcctggcaggaggatgtggggttgggggtgggatgagaattcttggatggggcaggggcagagtccggagggagtttcagtttggtcctgaagatggctgaagagtcatcaagagtcactgaaaaatgttttacagagtggggtatcatcacttctttctagagaaatgactgttgctatacttcatagagaatgaagggaacagggctaagagccaagaatgacatctccagttctaggcacgtaagcaatggtggctggcagtgacactccaaattctccaccctcctcttgatgtgtcagggaaaagcctctcacccatccaaggccaaagtgctttgctcctgggctctcttgccctcttgctttttcaagggccccggttcattggtctgtttttccatctgtctctcttttcctctcctctcctctctctcactctcgccatctctctcttgcatcattcatctttgcttttctataggaacatttctatcagaaaattaacatgttcatttttctcatctcaaaaacacatataaacaagacctttgcattgactctacacctctctaaggcaggtattccatacaacagatccaggtcagagtctgtcacaaggaagctgttggccagcctgccaaggaggaggaaacacgaagctctcggtccacctgcgttctctgtgagggagcctcctacggcactgttatctgtggcacaggtgggctatttccacttatcccaaagcttctcctgtggagcctggattttgccctaaaagtaattttctgcaatatagcttcatttttgggtggtatttgagggcaaaataactataagactctggaagtttgaaaaatcgatgaagaaatggtgcagtcagaacgcacctcttgaagggcttcctaacatcccttccccacgccccaactccccagcaagtctctttcctcctttggaaagtaaaacaaacttcattcaatgacatttgtgcataaaaactgcatttctttattttcaaactgttgtttatcactcatctacacctgtttccaaaagctccattattttttcaactgtgaaaatgatttgggcatcttgggtcaagacaggagacatcatgattcccccattaagtgagaggtatgtgggccatgaaaatccccccagcacaccccatagcctctggtcactcccttcagagaccacccatctgaccagctgcttatacgacttcccacaggcagcccgtgtagacaagaaaattcactcacaccatctctccgtcctctctcttccaccatgacagcgggccactcccacttcctccaccttgcttttttctcttggaaatcattccggactagtgcataaagagcacctgactttttacatgtctgggcagtgttccattgtatggctctactgtgatttattccagccacagaccactgatggacatataggctctttccattcttctgctattaaatcccactgctggtcctccagtcacttcctgtgtgtgtgaatctgtaggtaaacacagaacttgagcacctggggtggagtcgccaagtttgtgcccatgggatgttgagaaagagcatcaaattgttctcagaagggttattacagtttgctcaatcccagcagtaatgagagtgcctgcttctccacctcttcattaccagatggcattttcaaacacaaagtcaccacactgtctgatctttgccaatacaaggttgccaacaagatgtcaagagagaaggaaaatctacaatgaaactgtgaaggaaaaaaaaaaccctaagatgttataaaagtacattgtaactgcagtggtgagtcttaaactattttacataagatgaccagggaaggcctctatttgtttcttgtggctgccattataaataaccatagacttagcagcttgaaagaaacaatgaatttactttctcacattgctggaagtccaaagtctgaaatggctctcactggctaaaatccaggtgtgggcagtgggcagggctgcttcctcctggaggctactgaggagagtccccttccttgcctttttcagcatctagaggccacctggttcctggctcctgggcccttcctccatctgcaaagccggcgaggctgggagagtctttctcacatcccagacaccctcctgcctctctgttctctcctttttttttttgtgatggagtctcactctgtcacccaggctggagtacagtggcaccatcttggcttgctgcaacctccgcctcccaggttgaagcagttctcctgcctcaggctcccaagtagctgggattacaggcacccaccggcatacctggctaatttttgtatttttaatagagacagggtttcgccatgttggccaggctggtctcgaactcctgaccttggggaatccgcccgcctcagcctcccaaagtgctgggattacaggcgtgaaccaccgtacttggcctgttctctataaaaggagccctgtgatggcactgctccagcctagatagtgcaggctcgtcttcctattttaagcccagctgatcagcagccctgatcccccctgcagccccatatcttctctgcccagtgagctcacatcttcaccagttctggggattagagtgtggcgctctttgactgcaaccttccagaggaggtgacaaagagccagaggaagagaattcttggcatcaagctagagaatgtggtgcagacctgaccccccttttccaaaactcctgtgtggcctgacactggaggtagaacattggctagggatgggggagatggttcaaatcgttgtctgttttttgttgtttgtgtttcattggtcgatttgtttatgattagagagattggagggatcccatgttgagggaatggggccagtggagtgaaaaatgttgaaagtctgggaaataggcgacatttgatttcatgacttggtatgtgtctaaaaggtgtgtctgggctcggtggattggctcacgcctgtaatcccagtattttgggaggccaaggcaggcggatcacttgaactcaggagttcaaaaccagtcagggcaacatggcaaaacccctaccaaaagtacaaaaaaattggccaggtgtggtggtgtgtgcctgtggttcccaactacttgggaggctaaggcaggaagattgcttgagcctgggaggtggagattgcagtgagccgagatcacaccacttcactccagcctgggtgacagagcaagaccttgtctcaataaataaataaataaataaatacatatatacatacataaatacatacatatacaagtaaatttaaaactaaagaaatagataaaaggtgtgtgtgacctgctccaagggaatcttgccatagacaagggggaaagaaattcactgttgctggggaaggcaaaagcaaaccagaggtggagtagtccagttccccagatgctttccgtcatcctgatgttaatgtagttcttaggaaagcacacctaaaagcgaggcccatgtggctcccgggggatgatgtccaggcactgcacgtggggcacgtggccctctccagcctggatttgcagaaatcagaggccctcatactatgccctttgaatttccgcagggagtggaattgaccgagtgcaaacgcagggtgacctctgcaagctcgcagcgccaacgcgggaaccccagcatggtctggctgcagagtctgtctgattgtccaatcaaacccgcatctgtggggaaacaagacatgattcctaccaactgtttttcaaaatatttggagttgctgattatttactgtttctggtccttgtttcatattgctgatatattcattggtaacaaatggttgctcacatttctaaaaatgaaataatgggaggcctagtggttcctgaatacaagggctagaaaggaatgaatggcgcctccccgggagctgtccgctccttcccacttccacaagcgtttccattgaggctgagggttgttccccgcccttgagagtggagaccttccccttccagggtagatgggtggccaaggcttgtctttcccccagggattttcccagcagtacggcagacagaaggattttctgtgtgtagaacctagagtgggggaacatcgctacttagttaaaaaaaagcctgaagttgtccaaataagaacaaacatggttgactttttaaattcttaaggttaggaaatgtgagctgtcagggggaagacctgaagtcctggttactggccaccctctgggctggcgggggagggatggcctctgggagactttgggcgcttccttgatctctctgtgccctttgctcccttctctatgcagcaccacaacccagagtagcctccattgaccgccctgcactgtgctgagaagagtgccactcaacacctggagggttcgcgtcaattctttccttctagaattccccacgtttatctacacaagcctgcaccccaccccacccccgctcctcagaggcacagaactgattggaagcatgcctggagacacgctaacctttattctctccaccctcttcccctaaatacaatgacaccgacattgggtgttttggggggagggagcggcacaggataatttaaagccattgtaattttcgctttgtccactctgggcttcccttctcattcccgaatcccagaggggtttatgacacaggcagaaagcaggcatttggaatgattctcctttcttgttcttggtgtttgttttggaagccgaatgtcatcgactatattgaaggattttctcggagggaaaaggagacacagcggcctttgagaaggggaggaggagaggggagtccagcctggaaagagaacaccagcgtggacggtggacggggactcctgcctcagcgatggtgctgcgctggcctgccctccacgggggcatctgtcatcaggacccaggccaggagcagcttcgcaggaatgcagagaggccttccttgaacgcttggaacaaacctgagagtctccttggacgtccttggagatgagtgcgataaaaattcccaccacctagcaaaaatggagtcatcagacttgagatctgcaaatgaattgaacatttttcctccacctggactgtagagtatggcagatgcccagtacaagccacatgtactcttcttccaaataagagcggcagagtgagcgaccgtatgcctgccacctaggtgacaaaattaatactccgacttccttatctgtctctccgtccacactttgtgctgaaatctttgagttggtagtaaagttatgagtttttacccttagataattcagcactcagcaggtctgctaaagtaaagacattctctttctaaaccacagaccatggttactgaagaaaccaagtcatgacttctgtctgcagacacctagcaaatattcacagttcccactttccacaaaatttcttctatagctgtgttttcaaataagaatccatatatttggttattaccccctttatttatttttatttttttattatactttaagttctgggatacatgtgcagaacatgcaggtttgtgacataggtacacatgtgccatgatggtttgctgcacccatcaacccgtcatctaggtttcaagccccgaatgcattaggtatttgttctaagtctctccctccccttgccccccaccccccgacaggccctggtgtgtgatgttcccctccctgtgtccgtgtgttctccttgttcaactcccacttacgattgagaacatgtggtgtttggttttctgttcctgtgttagtttgctgagagctatagtttccagcttcaaccatgtccctgcaaaggacatgacttcattcgtttttatggctgtgtagtattccacagtgtatatgtgccacattttctttatccagtctatcccccttttaacaactttctttatatacatacaatccagccatctacagtgcattatgtactggttttcatgatagtcacagagtcctgctcttttcacctgaaacagtcacacttaaaaaaaactatattgacatttttaaaagaccaggctggttgtcttataccctgtctacttttgggatttgtctgattatttcattctgtgctgtggttgaaattacattggttgattctaaatcaataaaatggaagtttggtctgaggttcaattggttataattaggttgaatagtttgctaacacttcacaggtgattatctgtgattcccactgttgacgcaggagaatggagtatggaggcagggaacataaggccagttcacccccgttaactgtgacaggaaatatcctctccatagggtgtacaccacataaatggctttgtaactttacttcatcccttcatttacataaggtgtacaccaggaaaccaatggaaacctctagaaagtatttaaacccaaaacaattctgtaatggggctcctgagcccctgtgctcaggcccattcccaccctgtggaatgtcctatcattttcaataaatctctgattttgttgcctcatcctttccttgctttgtttgtgcgttctgatcaattctttgttcaagaaggcaagaacctggacaccctgcactggtaacactatcagtgatgcaaaattagatcagctcactcctgagggggtaggcggccaccacgtcctgttacaggaacagtaagctttcccctttgcaattagcagggaggctgcagggtgacacatgactcatgaaactccccagttccctgagcacctgccacctccattcatgctccttgcctgaatccttaagtcaagggagtttgtaaatgtccatttcttccatattgatgactatcatttcttccatattgttgagatgtcataatgtcattctgaaaaacagctttccctcatcaatctggtatgtaatctcctaaatcgggaaatattttattctatagttactgcttttgaagtaaggaattggtgtagtagtcacctctaaaaccacctaatgaatgtattccttctttttattttgaacgttattatggacgtggattttctttttttaatgtaatataaacaatcacagtcattcttcatcttcatagttttattgagaatgtgttcaacatatcataaaatgcgcccttttaaaagtgtacaatttgtggtttctgatctattcacagagatttgtagccatcaccactatctaattttaggacattctcattaccccagaaaaaaacccatccacatgcgcaatcacccccagccccagccctgggaaccattcatctacttttgtgtctctatgaatttgcctattctggacattttacataaatgtggccttttgtgactggcgtctttcactgaacattcatccatgtcgtggcatgtatcgattattcagttttttataaatcatgttctattgtatggctaggccacttttgagtgttcatttactcagctgatggtcacttacattctttccattttttacatgagtaatgctgtatgaacattcttgcagaggttttagtgtggacgtgtgaacatatgtttttatttattttgggtatatacccaggagtggaatagctgggttatgtggaactcgatttttaacattttagggaaaggttaaaaacttttccaaagtgactgcatcattttgcatccccacagtgtataagggttgtaattatttcacatcctcaccaaatttgttattgtctatcttgtttattttagccatcgcagtgggtgtgaagtggtatgtcactgtggttttgatttgcatttttccaataactaatgatgttgaacaccttttcatgagtttactggccatttatgtatcttctttggagaaaggtctattcaaaccctttgtcaatttttttagtggggttatatgtctgtgagagctctgtatatattttggatatgagtcctttatcacataaaggatttgtagatatttcctccccatctatgagctgactttttactttttgatgggttcctttaactcacaaaggattttaattttaatgaagtttgtcttatttattcccttgttgcttgtagcattgttgtcatagctaggaagtacttgcagaccccacggtcacttgggccaggtttctgctaaaatgccatctcatccatcagaggtgtttatcactgtccatcagcctttgtcccttcccttgccctatgttttttcattgctgttgccatcgcctgacactttacataatcattgcatgttaatcatctgtctttctactcaagaacacacactctttgacagcagggttttaaattcctgttgtgcatggctggatgcctggtggctgggatagagtgaggcttgttatgtattccccacagctgaggaaatgataggcagagaaaagagaaggcaactggtccacaggcagagctgcggcacacaatgccacctcctatgaagcaaggaaattaggcagctgagcttctgctaaacacattggaggaatgcaaaagaagccaaaaaaaaacaaaaaaaaacaaagacaaaacagacatcattgttaaagaccatgtgtccaaggactttgtgaattgaaaattattttacaaataacagtaagtatcctggcagaagagagaggcatccctggtgtgatggtgaatttcacacatcaacttgactggactacagggtgcccagatattttgttaaatattattctgggtgtgtctgtgagggtgcctctggatgagataaatgtttgaatgagtaatgtctttatcagctcagactgctgtaacaaaaataccataaacagagtggctcatcaattacagaaatacatttctcatggctccattggctggaagccagaggtcaggataccatcatggtctagtgccagggagggtccacttctggattgcagacatctgacctctccctgtagcctcacatgacagaaatagagtgagctaactctctggcctgctcttatgagctgtattcccatgacataattaccttcctaatgcttctcctccaaatatcatcgcactggggataatagttcagcaaatgaatctttttcaaagggatcacaaacactcagaccctaacaggtagaacaagtaatgcaggttgccatcccatgtgctgggccccagccagtctgttagaggccttgatagaacaaaaggaggagcgggagacagacaatctgctctctgctacagctcagacatcattctttcctggctcttggactgaaaatcacaccattggctctctgactcttaggtctttggactcagattagaacttctcccagcagttttcctggggctccagttatagatggcagatcatgagactcctcagcctctgtgactgtgtgagccaattctttataataaatctcactctctctgtctctccagagatcacagacaatatatatatatagagagagagaataagagaaagctaatacacctggttagatccaaatggaccatgaaggttgatatggtttggctgtgtccccacccaaatctcatcttgaattgtaactcccacagttcccacacattgtgggaggaacccagtgggaggtgattgaattatgggggcaggtctttcctgtgctgttcttgtgatagtgaatgagtctcacaagatctgatggttttaaaaacaggagttccctggaaaagctctctttgcctgctgccatccatgtaagacgtgacttgctcctccttgcattctgccatgattgtgaggcctcctcaggcatgtggaactgtgagtccattaaaccttttcctgtataaattactcagtcttgggtatgtctttattagcaacgtgaaaacagactaatgcaaagttaataggctgttgaatcattggataagtgtagcacttttcttctgaaggaaaagcaactcttacaaaaaaaatgagcaattcctttactgaggaaaaattagccactgataatacatgaataatagcaccttgttgtgactcaatactgtaatgcatgtacttacatattaactccacagtaaattctgtgttattcccattgcatagtcaccagtcaccagcttcatgttaaataaatcgctaagctactagaaccaagaatgggagaggcagaattggctacacctgtatagcaaatatggaattcactggtctcgaatgcaagtgtaaaaaaaaaaattacttttctagaactgtatttaatttgccttgaattcctaatttctctaatttgctttgaattcctaatttatctaatgcaagaaacttaattcagtcaccatgttcaggtaaattctctaaactcactgcttcttgaattcatttaggtttttaaatcatttaaaagccttttcccacattcttctcccgtctgagttttgggtgtgagttcgaggaggttggaggttgaatgtggactctgaagcaggagtaagtaaggacccttgctctgctgtgctgcccacatgactgccattgtaaggccctcgctggctctggcctctgccatctgtcctcactgatgtactctgcgtcagcctatgcttatctgagccagtgttcactgaggcggtgtgaccccgttggacctcaaacccatggcattggggccatgaagaactggaccccacgtcataaccacgagttggttccctttggggccactgcctgcacagagctgtcagacttggtgcacctggtcacctctgctcttggtcatttctgtcccctgccatgttggactgttcatgatgtttgggatgtaccacaggctctgagctctaggacaaaagcaggcacaaggaccctctgcgttattctgtgcacctgctctgggggttttctgccctgcctttctatccccaaggttcccaccttggtcgagagcagggctgggcctgtttttggagacagcctgttgtgaattgccttctttctcacattccttccttcctcagttcaggcaaccctcagtcctgggggctcctgaaaacatcttgtttaagccagattgttaccctgtaaacacgaaaacttctcccaatacttcatctactgtgaatttccaaattatattttgagaaggaaaagtggaatgctatttgtttctttctcttagacttcctactcttgcactcctccaggcaaggagtgaagaggagcattgttcatgaggaactcgatgctttgggacgaggatcctgatggataacgtgaatgttttatgtgccttactttagccagatgcaacctttacaaacaggtactgaagcaaggagcatttcaggacatcatagagcttacagatggagtctcagagcctcggtgggctcaggtacatacccctacatcctcatttaccagctactgaaccgctctgcatttcatttttctgatttttaaaagaggggccctattacacataagtcatagaattgttgtgagattgagttcagatgagtaggactcaagagtgcctgcaaatagtaagtgctcaatagatgttaacctctattatttccgcctgggctgggtgcacatcacagccccatttcatcatgcaggggggtcaagggagcacattcagggggcacatcactgaccggcagaaacaggctctcaagtagaggagattctcaaatttatgttttcaagaatgaattgaccaaacagaaatcagagtgaagtcactccagtagagagaattgtatgtgacattctctaaaggacatgggatgctcaaggaatggtgtgacttccccaggactgagccacaggccatgggaggtaggaggtcacctgagtgccagctgaggcacttcagccacatgttattctgtagtaaggaagggcccagtagcaggctgctggcactttcctcaggggagaatgtcaagaatactgcaggtgccttagccaacttatattttaaagcaattaaaaaaagatgaggttcagcatgaggaggcatgatagccttcttcaattaactggaagattgtcaggtgcaaaggaagtggacttctctgtgtgactacaagctcagaactagcatgttggaataaaaatcataaagcaacaggtttcagctcaactttggatagaacttcctggcaactacagctgtcaaccagcggtctggtttgcctcacggtagaatgttttccaactcaggagtggtttgttgaaggagcatctaccagaaatggcaagtaagggattttgcattggctgatgggagattgtacccatgacctctgagtccaatccctaacattcctgatttcacaggcataatccagttatgcaggagacttaggaaacagggtggtctgatattttgctttttttgataatgcaaagtaaagcaggtaaacatttccttaatgtatatgaatatgtttgtgtacctcagtcattctgtatgttaaaatgtttgaatctgttttctttttaatgactacttaccatgctgtaaggtcatccttttgagcaggagttctaattagtgacatagacatcaaaaaagctagacattatctgaatatatacaactaccagctaagaatttggaagttgatatttcaaataaattcctgattttattttctagtcactatcctttgctcttcactgtcgaggaaacgtctagatctgccgtgggaggcatctttttatttctgatagtgggcgaagggtgtgggagaggaaaaagctgtagacatgcaggggcatgcttctgtttggtttctgtctcatcaagcttcgtttcctcttataagaatggaatcaattgcgggtttttgaaattaaaaattgtaattaaatatctgagatcttcaggtctttaaatgtgtgctttctcttccacactgcggtaactacgatcatgaaagtagtacttacggaaaggcacaagtgcacaggaatccatggctaagtgactttgtctttggcaagatgaaggtgtgagggccaaccctacagaaacatgacatcccgtcctctgcttccaatctcttctccttccattctttccttccacacactaagtgcctaataaatgcttgttgaataaatgtttgtttggtaagtgttgcttttgaggattcttcttgcattaggaaatacatgtgatggagaagttttactctcaacactgttgcattacaggtgatggaaaaatcaaaggtatgcacagttaagatgaggattcaaattcagatcagctttacagagtgccaatctgcaacttgaataactaaataactttatggatatattagctcatgaaatttatttttagcacaggaaatgaatatttcacaggaaatgaatatttaacaaaaatcctgtctaccattatgtatagtgctatgcatccggagggcattccattagtaagagtttggtattggagaagaattccttttccttctaattcacaaggctgtggacactcatatgtttaagcctctcacatttaactctaatatgtttaaggttagagaggatcagggataaaatttaactttttggtcttacatatttatcatttgcctactcatttgatggcaaacagagatagtcaaaataaaaacataatttctttacccagagttttaaagataagaccatgagtatacttatcactgtgtacacagtatgtgaggttttagccctgaatgtgttctttcctatagcagaaagaatcccaacacgtacacataaacacacatgcaccactgtgttttgcccagcacttctcttttcaggagggtgtgcttttagtgagtgtgcatttgcgttgttgccccaaagactccgagggccacggaagctcccggggaagcctgcgggttggcactcagggatgctggctcagtaacctgaagccatcactgcggcaccacgggttccctacacagtatctgaatctttaaaactacagaatggacttagagttagtcaatcataacatttaacattttatgttgtcttgtgctgtctgctagaaaatgggtgaagcaaacacaacatgttaattcaatgtaaacttggtgttttctaggcaaacaaggcctggagtgttttcaaatgaccttctgtgaaatgtctattatcttccccacaaatgagagcaagtgatatacgtgaaagatattttaaaaactctgtattcaattattcacaccaaaggatatccattaaaattatgaacatttctaaatatatttcatgtatcatacatatatatattttatgtgtataattacatatcaacaaaagaattcttgctgctttaaccatgtaagtaaaacaaagattttgcaatataacactcatatatgcatatatactggctgtttgaattatgaatttatttacaacttgcctagattataataaatgattactgttctattatacaaacataacagtaaatgttttttaaatacaaagactgcaaatgaatacatgaaaaaattacacacatgtacaatatttataatttataaatgcaaagttaagacctctttaaattattgcacttgcgcattttacaaagatttttgtcatacatataaaatcattttttaaaatttactaacatcaactatgataaagttagatactgttaacttgaaattctttctccttccaatagagagcctattaaaattctggacacaggttcattgactctacaaatcagttcttcatgagcattgtatttgtgatggcatataacctgtgttactctccagtagtttttggtcagcaagattatcaacagcaaactcttagatgccttagctacgttatggatctaggatctcttttgttcatttgttcatgtaaagaaaaccatcttgtcttctcagaaagaatgaagatgctgcatttgtacaaattttggtaactatttcacagtgtgttgggcaagcatgtaatttcaaataggtaggggcattgtatagaaacaccttctctgggtaaatctattacactctgaacttgcacacgaaatgaacacatagcatatacaccatacaacagatcatatggaaaataatattcctatatgtcatttatataggctatcagagatacagcataggactgggtattaaggtgactaaagaaaaagacaaaggctgtaacgcccaagatataatatttcagttgggctagagtatcagattatacacttttagaacctaacttacaatagaaacaaaacccttctgcttaaacttctgcaaatacacagtacctcaaaaacatcagaggaaaactgaaatatgtaaactgacttccctacttagtaagccctggattcagctgtaagtttccaccttggtcctgaggtgacattatcctttgcctcacagggccacacctggccctgtgtgccattgattagttttctcccacttgcaggaaagagcacgtaggctctgtacggctttgcaagccctgctctccattgctgggttgagaagagaaacatcaagtgaggacagcattgcttcttcggatgttaaatgtgtttcttaggtaacattaatgtctttctctttgttctatcttcttaatttagaaccagcacaccgttgacactttttaattttttcttgctatttttatcatataaaatgcttccaacgctacagacaaccaaaatattccgttggaaaaaagacaaaaaagtgtgcactgcattggatattactaatttaaacaatataaatggttaaagaagtcagcaaaatgtgtattggctaaatacttatgcacatgtaaaaatctcatggccatgcgctgaaagcatggggaaactataacggatgacatacttggctgatttacattttacataatttaaaaatcagatgaatacttgcagtagaagagatccactatagtgactaaatgaatatagtctttaaagaattaaatcctaaataaaatctgcaaagtgtagaaagcaaacatatgttcgaaatatgtaaagagagaagtgattttaaaaatcatgcttaggtacctgaaaccccccaaaatcacatcataaccagtgtcacagttctctgaagttcttgccgaaaagactgactctgaacagttcactggttatagtcaccagggtatatgtcaatgaagtcaaataaagaacagaaatctgatgaggagagaatggtcctattcattcaacttgataaaatgaattgtgcgttcctgcaaatattttcaattatacttaagcaagaaaagcaaaataataaatacatgaatgaagaagtaaaattgcagtatttaaaataaaggcacaggccaaggcaggtgaataatttagtcctattaaagctcaaaccttaattttgagttaaaagaccagaaacacaatacccaaacctaaacctattaaaaaacccaggtatctaaggatttatgcatctatttatatcctgtacaatacaggatttgtctcgcatacacaaatataccaataaagaaaaattaactgagattttacaaaatgaaaaaaaatctaaaaagcatgccaaaaaagaggaaatctattattgaacacatctagtttccaattagttgcttttgttgtggtgagaacgagtcacctggggcaccactgtaaacatctgtaccttccttttccattgaagagtcaggaatgggaacgattgtgtctaatattttggtctcttttgcaagatgggtttttcatacacctcttagagagaagtacagctgggaaatggaccagagtctctgccctattaatagggctattttttagaattagtttccacatccattgtatttcttttgacccttttctaattaatcaattcacattgcccgaattcaatattccatgttattggcaggcatttatgtttccaaggacatttttagctaaaaaacatattcactgtgtccaaaaagataatggaataattgcatatgaccataaaacttgtctattataaaccaacataaccaacaaaagtatctgcaaattgaatatcctacatatgctcatagcgggttactaaatttatactgggtggaaaatttggcacaatacacaatacgaccttaataggaactcatcaaagctgttgttagtaaaaaccatctcttggcttctggtgtcacactgttcttttaagaaaagatctgggaacaagacaagaaacatgacccgaaagtctgtctcctaaacatctgacaaaatacaaaaatactcctaactgcatgttttccaaaacaaatcattaactaaatatcactgcaacccgggtccttttattttaggtaaatctgtgattactaagtaaatcttacacatggtaaaagcaatattgacagtttatatcagaattcagtcttttgttcaagctgtgcttctattatgacaatatttcacaagaaattaaccaaccagtaaatccaatcacattcctttgggaaactgttctaaatagagattacataatacacttgactataataaattaagagaattttctgtaataacctaaaaatgtaaatgtagccatgagattcctaactccataattattttctatattaaaaaacagaattcatacattcttttaaaattcttgtaattaaacaataatcttaaataatatatcccttcctgaaattccatctccaagcgaaatgagataactaaactaacttttgtgactaaagctgtgtttggtagactccagcttcataaatttgtatgcagaaaaatatgtatcttgttcaaattcaattatatgatacactaacacaaaaatgacactttcttgtcaactgtcaagtgatatgcattttccatcaagaaaaatcattgttcttaaagaatgggagaatggggctgatttatattttttcctacatgtttgcttctctcttcctctctttccttctgtctctcgtgtgtgtgtatgtgtatgtatcatatatacacatatgtatacgtttacatacatgagtgtgtatcctatatacatctatgtgtgtgttctacatatattacatccatccatatatatatgtgtgtgtatatatctagccacagtggtacttctctctcttttgttattacattttacctcatagtgtataatgaaaatagcaaatggagctccacggagggaagatggcaactttcagaagcccacaagaaaactgaacacatagtgttaattttaaaataagaacaatgtttatgtagagccaactttgctacaacataaataaaccatgttgtagaagcctctgatttaattttgcacaaaccaggctcatatgaacaaaacgcctatggtggtaaatatgtagaagcatatttttccattttattaaaagcgatattccagtttcctgccacatgaaaagtgaataagttatttgatatgatgggcctgtcacttcctgagtgagtctctgtctaattcaggtttggaggttaccgtgccattgcactaaaaatctttaaattattaaaatgcgccagaagtgactgctttatcatctttgtaggaaggggtgcagagtattactttcgtattttttaaaacacttacattgtatagtaatactggtcaaccaaaaaggtgtatagaagaaaccatcgaaacccacaggcttctatggagtgatctgatctgtgagaagagtaaagagaacagaaagaaggtccaacatgattgtactactttctgctctgtttctgtgctatggacagaaagctcatgaaatacgaccgtgcagtacgtggaagagataagtgagaggtgactgcggcaggtcagagtaaaattacaaaatacactttttatggtttgatgtttaaaagagaactgtatggtattttaattaaacaatgtttaaaataaacttttcattgtgaatgagagtctaaaattctgcaatgacacaaagtgaaaatataaaggaatcattatgaaaaatgtacccttcgtatccataagacttgtccattaaaaaaattacaatgccgagcttttattttgttctttatgcaaagggttcagtaaaactgccaagacaacaacaaaaacaattttaaaaactgacatcttttgaactgctacttgaagttctgagatttattgtaacatatacctcatctcttctcaaaaagacaggaagtctacttcgtctagtgttaaatttattgatctcagccctttaggttgaacttaaagaattatgtttagtctaactaaattcatgaagctctgaaataagagtttgacgttttgccatcatttcttactctgtaacctcaacgacatttgtcctgaggctgtggactacaactcaagttaattacaagtaggtcatacatgaacattcaccattcacaatagtaatgtgtaaaaattcctatttatatccaacaacatcaaagcaacattgatgttaaagcccaagtacaataccataatagtaccattttaaacccttattagaaagatacaatggaaaagtaccccttctggataatttttgtccatttcctttaaggcctcagcaatattagcctattagaaaaggctggtttgcaagtcaaatggagtcacttggccagctgatttctgaacgtgggggtggtcctggttgctcagtgtctatgatgcctcacagaagagattggcaggaagtcctctgcttgacttatttatttgatgttaccttcttgaagaggtttgcaccccagttaccaggtgcaggttccccccaccccccccaaaaaaaggaaaagaatgtcaaagaagcaagatgaggatctgtaggtgggacagcgtgtcagggtgaccagtgctcaatcttcagatgcagctgccttctgagccacggatggggatgaaatccaggttgcagtctcctcccctcgaatcaccttctcccactgactgagattatccctagggataaaagatgcagtttcaggagaagctgaataaaggatttctggactttgtcttgaaaactaaccaaacagtcctgtggcacagctctgcacaacggcattgtgtggggccctccgacatggttaccagcacgacgtggccaggcaggttcctgtgatggctgttcaggaaagagattcagaggtgccagagggtcaggggcaccttggtccatccgctctggaccgcgaaagcagcagaaatgctagggctcagcatacgtcctttcttagaaagaaggattaacttgaacagggaaagagccctagggtttactactgaggaatacgcgggatcgtgcaaaggaggtggtcccagagcagtaggaacacttggtgacaacacggaccttcctactgagaaatgtcgacagtgcatctcccaggaggcctaaacctcatcatcttacacttgttcttattctgaacagtgtgtcgtatgtacaaagtcatcctaagttacacctggcaaaacttcggaaattttcttgttacagtaaaaccgtgtttgtgctctggtaagtcctcacccgaggcagtctcatttctcgagtcctctaatctttctctctcagtgtctgtggttcaagcttcacaggcatcgtcatcttctctaactgcgtgatcacaaccactgcacaaccatcttactctacatggctaccctggcagagctcttagccacattcctgtgtgaagtcacatgggaatcttggcattgggaaatacaaaactcctatgagacacagttttaaaattctctcaaatttcttttagcaaacatgctaagacacattcagatagacaaaaccctaaaatataactgaaaagtgtagcccttttaacttttgtaacatatcatcaagtattatttttccagaccctagagacttctgatatattggaaaaagccatacactaattttggtatgtttccttggacaccgatgatacatcatacgctttttaagcgttaataagattaaaatggcctttaagaagttatgtggtccagccaagtatactgaagcaggaatgaggcagagctgcccacacagtggacaccgtgttctcagagctccacaaggaaggcacctccatagcgccctacagcgccgggcacgcgcctccatagcgccttacagcgccgggcacgcgcctccatagcgccctacagcgccgggcacgcgcctccatagcgccctacagcgccgggcacgcgcctccatagcgccctacagcgccgggcacgcgcctctatagcgccctacagcgccgggcacacgcctccatagcgccctacagcaccgggcatgcacagtcagcactcatgacctggcttccaagtacctggcataaaacacacagaatttctggacaggaaaggacttttgaagatattggtttaaacaacatctttgaatttacattgatatcccactttctctttaattttgcacacacttttataacctaattccttcaagaatgatctggcctcacactccatattgcccattatgacttaggcctttgtaataaggtaagattttaataaactaaccagggattaaggtcaattaaggctcaacagaacaaggtgggatgctacgtttatatccacaggagcaggaaggaaggagaaaccgtttcttaaatattatatatataaaatttttaatattgcttattggtctttccttgaaaaaagcagaaaaaaaatttcaacagcagaagataagagtatactaagtttctggttttgtgtaaaactctctggccagtgtctgttctccgtcctcccacagggcatccactccaacccaccccaggcagagctatggctaagtagttaaaacatggcccggagccaattcacctagaaaagactcacacgcacagctgctggctataaccctttgacttcctcagagggaatttataaagtaaaatgaaaatctttaaaaatatccaaggttcttaaccgagttcactctttaaaaaggataagaatggaatagggagaaataatgaatctagaagagataacgatgcttaaatgtctttctggaatgagaaaaagacttaaagaggaagcggttattcaaaatttaaggtccccttcttccatttaaacaacaaactgtgtgatctagtcagcctcttcctgcacaggcatcctcaatagacaccattaccttgtctttttaaaaacagcattgggcaggtcctctgcaaaataacaataataataaaaacttcttcctcctttttggtgtatgaaggacttgatatgaatagacactcttcacatatacatagtgtactacatagggacatactgtggctgtacgagtcatgagagccaggggcccctcttgcaggactgactccatgtctcacttagcagaataaggcagcctggccaagggcttctatcccaggcctgaggacctccagggacaaggtcccttcagcacagatgcagctctcattaggcttgaaaccaagctgccttgcaagaaccacacacatgccctttctcaaagaaagacctggcaccccactcagactgaacgtgggcataagaaagcgagaagggtctcccacaccgagacagaggccctcccagtcactcggtcatctgggccctgactgtgtctggccccagcccccagcctgttcccactgtccctctcttcagagtgtggccagaagaagctacccaagcacccaaggtgcctgaggctcgtctttgaggagaattgaaccaaaggggagaagtcgtggccctggggaagccaggtaaggaggccccgagtccctgagcacaacaactcgacatctagacaaacacacagaccacaacacactagtggggtacaaaaatcctatacagatctcagtgttgttggaaacaatatttttacggcttgaaccatagtacatacctgcatgctttcagaagaggctccgtgggagggaggatctgggtaagggttgtatagcagggaatggccacggcattgtagaacccaagctgcctccatgcaaaaaccacggacaagaaacaaaagtgcacattagcaattccagtgatatttatatttcttaagtgactgttctgtttctgaggcctaattataaaattgcatgttctagttttgctgtatgtgatatctgggttccatgaatactattatagactgtattttaaaatgcattaaaatggattctagaaataaaacacatgaagattcaaaacatattacaaaggttaatacctactgaaatctggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagctgggcgcggtggcaggcgcctgtagtcccagctactcgggaggctgaggcaggacaatggcgtcaacccgggaagcggagcttgcagtgagccgagattgcgccactgcagtccgcagtccggcctgggcgacagagcgagactccgtctcaaaaaaaaaaaaaaaaaaaaaaaaatacctactgaaatctaagacccaagtacattaaatgacatttcgctaatagatcagtcagttgatcattcaagtcctgtgttatctccagtcacctttagtgctttcttgcagacacttcaacgtaaagcctgctattctttcatacatatggctctttccgccctcgtgctcaggtttacagcagtgctttctgcttgtctgttactcttggctttggtgccttgtgtggtgtcccaatatttactcatcctcccagccctcttatttgaactaaaataaatgtcattggttttatcacagctcttcccatttactgtttttccaatatatcacatttcaaagtttaaaaatctgtagtattttaaataatacataaataatattttattaggaattctgggtcactgtgcaaataagactggcttactgaagtccagatgtaaaagatatgtgactatcagccagataacacagcttgtctagtcataagtcactggccaagtggctgcatcatgtacgagacaaatagctctctagaagaggtgaccccaaatcacagcttaccaatttctcgaaagtactgaacttcagtgatatgcatcgaagcatacagaaggatcaaatttattcctttttgctttctcctgttataaagtctatcgtcatagcactcttactagaatagcgcctgtgttatttccatttttaactttatggctcatgcagagactttcttattctaatatttaacagatgtcatggggcacaagatcccagaaaagatactaatattagaaattagagtatttcattattatggcaaataatttcacagtcatcaactatttagaagcaatatggttggtaaaatatgaactgatcatagaaatttttctttaaacctttattaggctgtaaatgaaaatcaaactattctaaaacaaacgattatcttagttaaaaacactagagcaaaacccatatgctgacagcatcaatgagaaatttccagctataccatgcattcttgggatgactgttaactactgggaaggaaagaaattgtagatccctatcttaaataatataacaagatacattccaaacaagtcaataaatcaaatggaaagtaatcaagaagaaactaaagaaaatataggcaaatatatttactctcaagatgggaaagaacttctcaaatacaatatgaaaagcagacaccgaacaggaatgactaacagctgtgactccatatatgggaaaattccatgaacagtggtaaaatgcgacaaaaacttcaaaatacacctgcagtaaacacgataggtattcaggatccatttctaatcaagagggaaaagtgaccatgccatcagaaaacctagccagggacataagtggaggcaatggccattcattcagcctctttgttgtgctggtaccctctgtgagctgtggacttgtctaaattttgtataaatcaattttaaataaagtagggaaatttgagaacttatcaaaaaccaccatcctgtggacttttttaaacatttgttaaacttatctgtatcataattatttatttgcccacaactaacttccttgttatgccattagaagatgagacagttaacgaaagccatactctcagaaatatatgacaccacacatacacatgtgcaaaactagcgaggcacaagacctctcaaaacattcaaaagcaaaataaattatgtagtatgacctgaaaagaggataattaatgtcaatttatgttgagacaaaacataaaatgtactaaaatactaagcattatttgtcagaaaaaaatgaacctgaattaaaatctataatgtaactctccaaaaatatctttgtttagccaatgacaaaatattttctgcttgttaaaaataaaacaattcaaattcatccaccccctctatttcaagtcagaaaagaaagcctatttactgcaacggcagctgtagaaaggagtcgtggccaaggtagtatgaattctttcagtccacagagatttcctaaccttggtcttactccatctaaatggagaaggtttcaagtggttctagcttctgtcctctgagcactaagtccctccagtccacaaggcagccagaccctcaggattcctcactgtggcttttagccttgggaacaaaatcagtggttagagttggccgtcaaactcagattaagagtataaactcttttagagtctacttttctgagtgtcttagcaagtgaaggctcatttgagtagatgattattcagggtaaacagtttttctttttctagttctcaatcttgtaagataaatttctgaagtttctatattaatcaccagatctgcctggaataacccattcccttaacataatatatgatgacatgctttccatttatgtatgattttatgcccaccttaaactatttggctttagcaattacaatttactttaataattcatacctggccttgggggacttcatccttcttgtctctgtccatcataggaataggctgtattcccaatttcttcatttcatcaccctaagatgaatggggagaaaatcatgctttctcaaatttcaaattgctatactattttgatattattgaattattccctttattccttaattttcttcaaaacaaataatgtttgtggttgttaacccaagaaaagtacatcaaaataaagaaaaacttaatgtatcattattttgtactttatcctgattttctccactactgaattaccagaaacccagccattattactggtttcattttgcagaagttagtaaataaatgttataataagaggagatacagtaaacagtgaggagaaataacaataacaagatatggaataacctccaggcccttctctcttccaaatgatcttccaagtgcatggaactcagtgaagtttggctttccagaggaatatttacagaggaagataaacatcaccagtcgactaaaatgtgctagtaaagacgcagtacaacaaactacacatatcatctaatttacaattataggtaatacttactaaagattaactatgttagttactgaaggttcacgtacagttacaggtaatagttactaaagattcactatgttagttactaaagattcacttacaggtaatagttactaaagattcactatgttagttactaaagattcacttacaggtaatagttactaaagattcactatgttagttactaaagattcacttacagttacaggtaatagttactaaagattcactatgatgcaggccctgagctaagtaatttgtaaatattatttcatttaatccttatgaaatattctaggatatgctgttcccattttaaagattttagaaattatcttgctttttatttatttgttaaaggtaaaacttgtacaatcttcttaagatttcctagtatttttcctaacttcccactcttccctcatagtttttattattttagtaacgttggtcatgtttttagaaatcagaagtacagcctagaaacttcccagacttgctaaaatagggtctacaaacaaactactatcaccataattaggtatttttatgtacaggaccaaagcacttgtcctgacaaagcaaagccacttcaagcatggctgctgttccattgttaccactttaaatttaaaatcagtggtctcaaaccttttgcttctctatccaaagtgagtgagacatactaagtcccttgctctcaaagacttgacaagtccaacaaggaaacagctttttaaacaaacgatgatttgaatatgtactcgaaacaaaaatgctaaaaaggaaaagaacccagtgctacagaccatggctctaacagagggctgagccaatctgaggctttcacagaatacagagggcaggagcatgctccaggcagagactgcagggaacaaagacctaaatggcagctaggggctgagatggggaatatgcctgcacagacagtgggcagggggccagccatgtggggctctccacacggaggtcatgattttggtctgtattacaacaagaggatcagaagcagggtacggatggaatccgaattattatcatccctatctcataaactggcctgaggttaaataccaagtgccaaagcggaattttaatttcaagcaacctggcaccaaagaccacattattaattacttttgcacaaattctaaaaggtaatggcaaggaattcagttagaaagttgcagtactcaaggcatgagttggtgatgacctgaagaggggaaagattgtgaggatggagagaagagacaggactttatagatactgggaacaactgtcaggacttggtgaatatattcctgcttcttcctgtggactattgaggttggtgaaggctgcacctaagagcatgcagagagctgaatcattatctgtggactgaataaccagtgaataatataaaggaaaaacatctccattacatattggtcacattttggcattaaattctccagcttttaatcctgcaccttccttttactttaagttgtcatttaatgactgcacattttctacatttgtctagaatatagaaatcatattacagtctatagttatgcctttctcatagcaatcctgtacctgaacaaaacgtgcatttttagtatgagataaaaagatatttcacaaacagtgcaaggtttttgctcctgttgtcatagctgcagtgatggcttcatgaatttccttttctttttttgcaacgatccttacacgggattcatttatgttaacatggcggcaaccacagctgcagacttcagtctagggaacgtatcaagcaactcaactttttcttgtcatgtcatgacttttctctgcttcttgggagcacttccagcatcctagtgtaactctgtataggtgctatggtgttacggaggacttaggtattgcactaaacacaatgaaaactatgcaagaaccacgagagatcactttttactgtgatacacaatttactggagagacgaatagctcagagacaattagcatcacagagcattttaaacacagcattttaagtggatacttgtaacacttgagctcaccgtaacagcaaaagaaggttgctgcaaaattattacagtactgccgtatgtactatggttaactttacgcagttacaatttaacacggcatctgtttgtttacatttctctccagtctataagtgtgtatataagttttgataaattttaacttatcatagatttttgtatattttatggtagtaaatgataaaatcgactagtatctacatatattttatgcacttatggcatacttaaattttttatatttctaggatatgttgttctgtatttttgtcatagatctccaaaaaaatctttcaatatatttattgaaaaatatctacatataagtggatccacacagttcaaacccgtgttgttcaagggtcaactgtgcattgaaatcaatcttcctacttgagtctgatggtaactaggttctgacacatacacaataaaataaagaaaaagctcatgcgagaccacgcatatgcgatgtgtaaagcattctggagaaatcatgccgggagtataatcaactcaaggtctgtgatcctcatacagtaaacatactttggctttattattatgaaataattcaacatgataaacctttcccactaaacttgtggctgaatgatttgctgtttatgttttacatacattcttctgtatgaatgagatatacgattgaattatcagctgctttgtcctccaaatttacttttatttattcaaaccagaagaggtactcaaaagatttacagctttcttcatagagtagtttttgaatatgcaaaggcctaggtatccgtgactcatttggatgggagaatgatattctacttacttacatacaattccatcagcaaattgagcagtacaatgcacatcactgataaattagataagtcagtcaagaaaaggcgttaataaaagtcatttacgtgttgtttcaggagtattatgaatgaatattccacacattctgcagaacacataatttgcaggtgagctattggttatatttacatattctcaatgtctatggtgcaaaacaattattctcctgaatttttaactgcaggtggatatatcctgtattatgggaccctctgagtactttgtccagtgcctatctaaagtagatggccagtaatgtttattgaatgaatgaacaaaagatcagctgttaagtaagataactgttatactactgttcagtgagtaagttcctaaactctttcagttgagctcagagaattagacacacatgtaagtaatatgtaaaagaatgatcattctctctttgtatctgcataagtgctaaatccttcagtatgtgactcaccacagttctctgaaataactatcaacatgaacaactaaagtattcttagcaattgatccatacgttttatttctcctcactatctatgtcaatataagaatcaaggacatacctcagcccagaattctgcatatatatcatttgccgtcaattttgtaacgggccacagttttgtcacagaacaaaggtcacaggcagtcatcatcaaaccaattacacggtctctagaacacaacaatataagactggtcagcatagcatttgcacatttatagtaaggactagaaagacttctgtatttcaggagtgaagtttaagtatgtattacttcattaaagagcacacagaagtgacagccaggacagtaaaatggaattaaaaattagtgtcattttcatcataagaacaagagtcacttctatcacaagtcccgtgaggagtgcatcatatgttcctgttgcctcaatgctactgaagaaatcaaatataatgtaggctctgactaggctgccatctaaatcccctggtacacttttatggctatggatcaggctttcattttcattgaattttggaaatttagagtgggaagacgtcttaagagaaaatctatcccaatcctttcattttatattagcaaagtctgaggtgcacagaaatgaaatgacttttctaaagggacaggaatttgtggcaaggccagaggaggaggtagctgtgcaacctggttcctcactctccccgtgcaagtgtgtgagctggatgcagcctccaaacactgtgcttctcattagcagatatttcttttcaacaccagcctttcaaccaaaatgacttttcccttttcagctgcttgcattcataactaggtgctccatgtctgactttattttctaaatatggcttggtttaatctttcctcttgaagaaaaataataacttaaaaaaaatcaaagacatatcccctgcaatttgaatagatttggtcttgtgatatgtggctaccctaagtgaagtctctacttaacagaataattaagtggtagtaattaagacagtttaatgtacaactttagcttttgtaaagcaaattatataattttaaaagacaaattatcaacaaggatataaaagtgtgtaatgagtgagacgatgctcttacttctagctcctatctcaattcgaatgagtttaagcaatcccctgctgttaaccactgccttacctcttctaggtccacattctccaactgcgggcacagtcctgccctagctcccgagcctgtcttgacccaggcagacagcacattaggagcatccatctgtcaatctggcagagactctgctctagtagtgctcttagcacatcttagctcaagctaagatgtttggatacctggaataccctgattcttatgataccatcgatcacagagttctttatttcctgtcagctcgcttcctttagcccatttaaggaatcatcagttttactaccttgctttttgtaagggcacatttcaagagggtatcaggtctcttacaggttagactaaatcactttacaaacattggttagatttatgcatacccttcctgtaaccccaaacagatgctatgtgaagatccaaatcccttacaagtggtcagggaaactataagattttcttaatgaggtcgtttctaagaactttgtgtcttgaagatatttatttttggatttgaacttctaacgtaatgaatatatgaccttttttttcaacaggtaaattcatttaaacacaaatcgaatgtgaaaaactaccatttacaaatatttcatatgtttaaaataattcaatcttattaatttatattcaccaaaataacgtatatcatggtgaaataatctaataaggtttatctcaaaaaactttcataaatctgtaaaacaaaagaaatgtcaatagaattgggcattataaaacacatgaaagcaattttcttgctggaaattattcccaacataaagttgccaatataaggactgaaaagattataaaacagttatttagatttcactgtcaaaattacttagacaaagcacaaaaaataaaacagattagaaatttggcatcaaatgtctttagtaaatgtaagtactcatttttttactcccaattccaaaccagttagatggccatggctatacagaaatattaattgggatcaacattttatttctatccatgaatggaatgtagaactgactgctaactgaggtagatccttaactccaaatatgctttaataaccaattgtgaaaggatcatgttcatgctaagcctactcttggtttgagatcatataacctagtcgctaaaaacaatcaaggaggagcccaacacaatgcctatgataaaacgattcttaatcacataatttcagaaggtttaactacattcatttatcctcaaaagttgtgaatgcctgcatgtatctggcagttacagcaaagaaccaaatagacccttttctcagagtaataatgtcctaatagggcaaggcagacagtcaacaggtcaaaactttcatgaagcaagtgctgggtaaaaatcaataaatcaataaatcaataaagagaggctaccacgtgaagatctgggaggaaggtccagcagagaggagtgcacgtgaagtcctaatgtggaaacaagcaaggcaggtttgaggaacaaaaagaaatgccattatggctgcgacacagtgaatgaagtgaaacatggaacgtagttaagtttggagaaacaggctggagacaagataggagtttaacttttattccaagtttgatggtaaaatcttggtgtcttttcccagaggagtggcctgatacaggtattaaagaggatcactcaggtctgctgggtggagatgactcatagacctgtgaaggggcaagggcaggttcggagtgatcacttaggagaaccctacagtagttcagatgagaggtgagggcagcttgaagtatggtgacagtagtgggacagggggagtaggaggattccagacattagaggtagagccaaatgcaaattattaacacccataagagttataaagacaaggcatttctctctcccgtcttcgtttccttttccctcctttctccccgactgccatgtattaattatcccagatcaagtggagcagataaagagcacaggctctatcacaggggtgcagatattccaacctcaaagaggcgggcacctctccgcagcgtgcatgtttgcctgctaagtgccatcctatttcaagattttcttcccacatcagaagatcatggaatcacagaactttaccaaaggaaggcaaaatagaccacacagcctgcagtagtacttcagatgagttactgatgggcaagaaggaagcccagccctcccacactgcccacaatcccacgccacacactctgtaaacctggccagccaaggatatactattttgttggaaaagaagaaacacccattctctaattttataatgattatttgaaatttcttttgaatttctgtattcaaaagtatactgatgtataagcaaagaccagaattctgttatgaggtagtcttaattattactgtgagagtggttaagtgttatcaagcggttaactaaaaagcaaaggtgggggatgtacagtggatgttttgtttagaagctgtcatctagcctcattttaattattttactttaaaataaagtaacacatagaatttgaaaagaaactaggttcaattctttttttctctaaattatcaccttaatgcttttttttttatcttgcttttaaactcattttcaagggattttaaatcattgggttgagtaatttaaatcatatctgtaataactactataccttcatcaaaatgtgacctattttgagtaatttagtaaacattaaactagcctaagaataatacagtttttctgaaagtattatttgaacagctgcatactcaaaatcatagaaaatattttaaaatcttactgtttccaataacataaataactttcatataagtataaacatgatatagtaattatctcactaaaatatactttaaatttaagttctaaaatcttaataaaaccctaaatgttacttcttttaaaaatacattttttccatcacagaaataagttgcttcttttaaaaatacatttttctccattacagagagaaaaataaattataaacgaatggaaaatgaatcttaggtaaatgactaccacagagggaactgctgttattaaagttaataccagagtattattcctagagttaacaacctttacatggtctcacagagtaccatacataactttaatccaaatgggaacattagtgatcttgctttagaatttcagttccccacatttcaggttcttcagttgagacatcaaacattcctggcagagggaggcctttatgcacttacagtcctacagcaggtaaaggctggaggctgctgccacatttgggaaatgctaaagaaactacattatggcatatatatatataaaaaacaggtaacacatcacatagacacatttgttgttcttcaaagcacacagcaatagctatgtaaaaatatagaacttttcaagttctatttctgaattatttgaagaattaacaaagaattgttaaagtgtttaatattgtaccctttctttgacgtgcacgtacctgtaccctttctttgacatgcacgtacatctaaattaagaaaagacttcaagggaagtggagcaaagggattgcttttgaagggtacaaatattatctgggactaagagaataaacattttcattttagaaagataacaaaaataagagaaattatgatttttaagctgccatttcaaattatgaaattagtttatctttacaatttgtgtttacgaaaggcagttcttgcatgaaatacatgaaagtaaaaattttaaaaactaccagcaacttccatatttgtcatcttaatacttaaaaggatacttttatctgatatcatagcttaaaacgcaccatggtcttttctgaatttgctgaaatggttcttagttaagactatacctggttctatttagccataatgggaccatgcttgctaatttcaacaaaaaacaataattctacttttgcctacccttggcttgagttcagagctggtttccagacatgacatttgtttttagttgtagtcaggaaaagtgctttgaagggaaatttcagtgcagaaatcaagcagttcacagatgattggtggccctgcattacgtttcctctctctctcttttctgttcctagcaaatcctttcataagctagaattaaactgtctgatatagttgtcccccacccaaatctcatcttgaattgtagttcccataatctccacatgttgtgggagagatgaggtggagataactgaatcatgcgggcagtttcccccttcctgttttgtgatagggattcagttttcacaggagctgatggttttataaggggcttccccctttgctgggcactcatttttctctctcctgctgccacgtgaagaaggatgtgttagcttccccgtctgtcataactgtaagtctcctgaggccgccccagacatgaagaactgtgagtcaattaaacctctttcctttataaattacccagtcttgggtatttcttcatagcagcatgagaatagactaatacagtaaattgatactgcagagagttgggtgctgctataaagatacatgaaactgtggaagcgactttggaactgagtaacaggcagacgtaagaagagtttggatggctcagaaggcaggaaaatatgggaaagtttggaatttcctagagacttggacaactcagaagacaggaagaagtgggaaggtttgaaacttcctggagacttgttgaatggctttgaccaaaatgctgacagtgataaggacaatgaagtccaggctggtccaggtggtctcagatgtagatgaggaacttgttgggaactggaataaaggtcactcttgctatgcaaagagactggtggcatgttgcccctgccctaggaactgtggaactttgaacttgagagagatgattgagggtatctggtggaagaaatttctaagtggcaaagcattcaagggaaagcagagcataaaagtttgaaaaatgtgcagcctgatgatgtggtagaaaagaaaaaccaattttctggggagaaattcaagccagctgcagaaatttgcttaagtaacaaagaactgagtgttaatcaccaagacaatggggatgtctccagggcacgtaaaagaccttcatggcagctcctcccatcacaagcccagaggcccaaggggcagaaatggtttcgtgggcccccctgctctatgcagccttgggacatggtgccctgtttaccagctgcttcaactccagtggtgacgaaaaggggccaatgtatggctcaggctgttattttactgggtgcaagccccaagccttggtggcttacatgtggtgttgggcctgagggtacagagaagtcaagaattgaggtttggaaacctccacctagatttcagagaatgtatggaaaagcctggatgtccaggcagaagtttgctgcagggccagagccctcatggagaaccctgctagggcagtgtgaaagggaaatgtggagtcagagcacccacacagagttcccattggggcagtgccttgtggagctgtgagaagagggccattatcctccagattccagaatggcagatccacctacagcttgcatcgtgcacctggaaaagctgcagacactcaatgccagcccatgcaagcagccgggagggtaactgtatcctgtagagccacaggggcagagcttccgaaggccgtgggagcccacctcttgcatcagcatgacctggatgtgagacatggagttgaagtatatcattttggaactttaaggtttaatggctgtcctactggattttggatttgtatggggcatgtaacccctttgttttggccaatttctcccatttggaatgctatatttacccaatgcctgtacccccattgtgtctaggaagtaactgacttgcttctgattttataggctcataggtgggagggacttgtatcagatgagactttggacttgaacttttgagttaacactggaattagttaagaatttgagggactgttggaagtagaggattgtgttttgaattgtgaggatatgagatctggaagggggcaggggcagaatgatatggtttggctgtgtccccacccaaatcccatcttgaattgcagttcccctaaccctcacttgtcatgggagggaccaggtggagataattgaaacatgggggcagtttccccaatcctcttctcatgatagtgagttagttctcacaagagctgatggttttgtaaggggcttccctcttcgctgggcactcattcatctccctcctactgccatgtgaagaaggacgtgtttgcttccccttccatcatgattgtaagttttctgaggcctccctagccatgctaaactgtgagtaaattaaacctcttttctttataaattactcagtctcggctatgtctttattagcagcatgagaacggactaatacactgtctaagaatcgatttctaggatcccaaattcacttgtcagtctttgccatttataaagtttaaaaaaaattattattaagtgtaaggtatttgtgaagtctgcactgtatgtcttatgtaaacaaattattcatctgcatttgaaacacacatgacaatgactttatacacaattgggctttggttgtttcatttttaaaataaaatatcataaaaaatacctagtgtctttaatcacagttgtggtcacaatgtcaatatgagtaaatggcataatagctaatgacatcatagtaaatgtgaggggtaggtggtaagggccactggtaaggacaaaaggtgggaagcaagtgtcagaagattaggacttccagcaaaagtcaagataatgtaactccagaatgaatgaaacaaagaatgaaattttttaaaaaaaattaccaggacaaaaaatgccaacaatcaaagacatacatgagtatatgaccacatgatacaacctataattcaaattacttgctattttggattatttgtttacttgagaaatatttgctgaacacctactatgtgctagacactgtcatagttatccatacctctgggccttaccactacacaaaagcccagaatgtgactccttccattacatgacattccatcattgcaacaaggatggtatgccacataatttatgttcaagccaatacagttttgagagtaaaagccagcactgctatgaattattttagctcaacatgtgttagctgagattgatcgaggcaaactgtggagcatggtcactctaattttaacacaaaatatccataaaataaataatgaaaatataacatttgagaattttttttgagactgagtctcactctgatgcccagactggagtgcagtggtgcaatctcagcttactgcaacctctgcctcccaggttcaagcaattctcctgcctcagcctcccaagtagctggaattataggtgcctgccaccactcccagttaatttttgtatttttagtagagatggggtttcaccatgttagccaggctggtctcgaactcctgacctcaagtcatccacccaccttggcctcccaaagtgctgggattacaggcatgagccactgcacccagacaatttgagaattattctaaaaatattaactttaagtattaatttttccactaaacgaaaatgcatttataagttgcacctttctatctacttatggtacagaaatacattgattcttaatacaaataaggatgcctggctctatacattgggcaacttgagttctcaggccaagtctgccatttatttctccaaatgaaataaacactccttctgtgttttagtattaattttggatagagagaggccactgactgtcatccatcaactacccaagatagtaattataattgacatctccaaaaaagatcacctaagaaatattaccatatattagctataaagtttcaagcaatatcagataaattgatccattaaaagtataaaaccaatgaaactaagttggatatttaccaagctcataaacaacaagcattttaaaagttatagttccatttttaacaaatggtgccagaacaactggacatctgcatgaaaaaaaaaaacacaatgcatctagacagagaccttagaacctttagaaaacttaattcaaaatggatcacaaccttaaatataaaacacaaaactgtaacacagatatataacatagaagaaaaatctagttcatccagaatttggtgacttttaaatacaacacaaaggcatgattcatgaaagaataagctagacttcattaaaaattaaaaatgtatgccctgcaaaagatactgtcaaaagagtaaaaaggcaagccacagaccgagagaaaacattggcaaaaggcatatctgatcaaagactgttaccacaaatatacaaagaaccctcaaaattcaacaataagaaaacacccaaatataaaaatagggctaaagacatgaactgacacctcactaaaaatatatataaagatggcaaataagtatttgaaaagatggtccacatcatatgtcatcataaatatgcagattaagacaatgagataacactacacatctattagaaaggccaagatccagaaaactgacaatgcccaatgctggatatggagcaagaggaattctcattcattgctggtgggaatgcaaaaaggtacagccattgtggaaaagagtctggtatatttcatacagaattatgaaataattcataattattcataagtatttcatacagtatgtcataagacatactcttataatatgacccagtaattatgctccttaatacttacccagaggagttggaaatttatgtttacacaaaaacctgcacatggatgtataggcagctttacgaatagttgtcaaaacttggaaacaacagtggtgtccttcagtagatgaatgggtaaataaatgatggtacatccacacaatgcaatattattcaatgctgaaaagaaatgagctatcaagccatgaaaagacatggaagaaacttaaatgcatattactttgtggaaaaagccaatttgaaagtcaactactctatgattccaactatatgacattctggaaaaggcaatggtatgaggactgtaaaaggatcagggattgccaggagttgcggagagtgaggaatgaataggctgagcacaagggatttttagggcagtggaattcctccatatgatactaaaatggtggatacgtttgtccagacccatagaaggtacacatcattaagcctgcatcctaatgtaaactacagactttaggtgataatgatgatttaatgttggttcattaattgtaataaatgtactattctggtgcaggataccaacagtgggggaagttgtccatgtgtggggaccaggatatagaggaactctgtactttctacccaatctttctgtgaatctaaaattgctttaagaaataaaattggttaatgtaaaaaagaattatagtttcaaataagatggaaaattagtaggctaagataaatgcccacatcagaaataacagctaagttccaaaagaaaagatgaattggtagtaaaggcatgatgccacattgataaggaaaggtaaattgtatagtgaagaaaagcagtctggaagtgtatttctgacttaagaccgtaacttaacagagaaaaaaataattttggagaagtatcctttttgaatagtatggagaaaactcatcagccatcctgaataaagaacaaccagcagtggaggcaaatgtccattggataaccacattagtcctaaggccaatgacatcagctaagagcatacttaatcttgtttcttttgaacatgaattgtccaaacaagaaaataaggagttaagatataaaagccactccaagctggagatggtatcttcacatcggcacagatgggaattcagttatttgaataattcaaatcagttgttcaactgagttactgaattccaattgagttatttctacaactgaggtaaagtgtccatctgcagacttcagatgggagaaacaactgtaaagatatagatggtgccacctagggaacatgggaagcaaacccaaatctttgaaaaggacaggtggaggagtccacatccttgttacaggggaaatgatgtctgtgttaactcgagtgttataaggaactctagaaaatggtgaggagaagagaaaggtttccaatagccatgaaggcatttctacgctggtggtaaaagccttccagtgaccaaattctacacagtccatctcatatgacagcaaagaatggcttgtgttaggcaattccttacataattagccatcacaacaatgtaaatgtgtgaattttgaactcattattaattcttaagtagattataactttactcattataatgtagaattctgtggattgcttccatgagcttatcaattcctaatcacctcacagtgagataagatctcacttggtgaattaaggatcattccatattaatcttttaatgatttcctttaaagtgatactgaggtaatcgacatcttaagaacaaaatacttcaaacaaaatgctttgtattttacaaaatgcagatttatagatcatactttttttatactttaggttatgttatatagaatgaaatgcataaatttgaaggatattagtgagtatgaaaatatatgcagtctgtaatgaccacaccaatgatgacaagtaatgtttttatcacccagaaacctcgttttctagtcaatgtccctcatcgaaccccagcaactgccagtttaaattccagcacaatcactaacattattgttttgcctgttgtagaactgcattacaatagtatcatatagtagtatgtaaccactttgctcaaactaacatttgtgtgattcaaccatgttgtctcatgattcagagttcataactttaaaaattgctgaatagtacagtattccattgtttaaatgtccaaagttgtgtatctagcccctgttgctggacatttaggttgccaccaggtgggatatactaagagtaatgttgctatgaatgtgtgtcctagcctgtgtgtgaaagtacactttcattcctcttggataaaaatacctgagagtgaactgctagaacacagtataagaacatgttcagctttattaaaacaaaacaaaataaaaacaaaacaactaaggtgttttctaaagcagctgtacaaattctatactcttaccagcaatatatgagtatttcagctgcttgacatccttgctgtattagtccattttcacaccgctataaagaattacctgatactgggtaatttataaagaaaagaggtttaattgactcacagttccacatggctggggaggcctcagcaaacttacaatcatggcgaaggtgaaagggaagcaagtattatatggctgcaggagagagagagcaagcaaagtgggaggtgccacacactttcaaacaaccagatctgggtgagaattcattcactatcatgagaatggcaaagggaaaatctgtccccatgactcaatcaccgctcaccaggcccctcccttgacacatgcagattacaatccgagatgagatttaggtggggacacagccaaacaatatcacttgccaacaactgataatgttggtctttgtaattttggccattctagtgggtgcataatggtacatacaccaccctggttttaccttatgattagagatgttgagaaaattccatgtgtttattggctttaaattctgtaaaaatctttcatataatttttttcttgggttgttttattattgactttacaaagttatataataccttcgtcaaacataaatactgagaatattttctcacattatgtggcttgtcttttcatttccttaaaggtaccttttaaggatcttgttttttagcatgatgaagtctcatctgtcatttatttgtttaaaggttcatccatttttgtgcctaccctaaggtcatgaagattttctcccatgttttgttttagaaattttataattttaattcttatatttaggtctctcatccaactaaaactggtaaagaaccatttgcagaaaagacagttgttcatatacaaaaaatataattgattttttaaaaaatgttgaccacatagcctgtaaacttgcttaattcgcttattaattctagtacattttttggagatgacttaggtgtttttcagtagatggcatgtaatttaaaaataaagtcagatttacttttttctttcaaatctttatgcctttcatttctatttctttctataattcactggctaggacctccaattcagagtactacagaactagacagagggggtattacttaatatatgaactatcatcacgggggctatgatgtgttcatacactttttacaatattaaagaagttccattgtattcctagttttctgagatttttggccttcataaatggaggtgtaattttgtcagatgctttttctacatctattgtaataatcatatgatgtctcttcttcattctgttgtggtgaattttggaaatgttaagccagtttcctaatcctgcaataaaattcttgttatgacatatgatcttgttatatgtgattgaacatgttatattttgttatgaattttacagttatacttttacagttatatatggtcatgagttttatagttagatccaaagggaatactgaacttgaatttactgtttttgtgatgtttttgacagactttggaaatcaggattatttagccttcataaaataaggtaggaaatggttcttgtccttcttttggaaagcttttgtgcaagattgtttgatagcaaccccacatgaagctgttgaggcctggtcctgagggatgggtggtttgtttgtttgtttgttttaagattagatttcttcaatgaaatattcagagttctttttggttcaagtatagtaagctggatttctcaaaaaatttatccggttcatctaagtttcaaatttattagcatattatttataatactctcttattatcccaatgtaatctaagtgctatcccctctttcactgtcaacattggcaattggtgttaatattttcttttttttccttaattagtcagaattgtatccattttaatagtcttttcaaagaactactggcatttcgaatcttccttctgttgcttgctttatgttttattgctctcttatccagattatttacttcccacaagttaggctttaatttactctttttttctagctgcttaaggatttaaatcactgatgaacatacacattgaaagttatacatttccctctcagcactgttttagctgcatcctacagattttgatatagtttgttttcactgtcattctggttgaggtattctcggacttcccgtggagtgtctcttttgactcatgggttatttagaagtatactgtttactttccaaatggttggggttttccagatagcttatcattatttttaatttaattcctctgtggtaaaataatactcctaagacttcaatcttttgaaatttattgacaaattaggtcacaatagtgtcgtttagatctctgttagccttagcgaacttttacatagttcttctgtaagttacttaaggagggatataaaactctccaactaggattttggatttgtttactttttagttctgtgtttttttgttcgtttgtttttgaagctttgttattaggtgcatgtacattctgcatttattatgtcttttgtacattgaccatttcagagtaaacttgacctctttatatctggcaatgtttcctatcttaaagattattttgtacaattttaatataggtacaccagttttttttttttaatgctgttgccatggtatatctttatcatttgctttcaacaaatctttctacttaaagtgcatacgtcatagacaacatggaactcggtcttgctatttagctggtctgatcatttctggctaattcagatattcagtctatgtatatttaatttaattgttggttttattaggttcaaatgtaccatcttgggatttgttttctatttgttgaatctgtttttgctcctcttgtcctgcttccctgtggttttatcaaatgtacttttactattcaatatttttgtctacttttaaaagctatacagtttcagtagataaatatgcatattctaatctctagggaaactgtaaaaagagcaaatctcttttttttactctttttacagtttccctggggattataatatgcatacttatctactgaaaattaatgttcttccacttaacacttcactctacccttcacaaatgtaagaaacttataactatagaatatatagaactataattctacatagtctcatcctttgtgctgttttcatatttaatcactacatatgatacaaaccctatcttaccctagtattatttttgcttgaaccactcattcattttttagaaaaatagaagaaacagtattctgttaatatgttctatttatctacatatttgctactttaccttcctacagactgagttttcatctggtaattcatcactctgaggtttctcctttagtatgtcatgttattcctgtctgctgacaacatattcttccagcttttatttatcacaaaaatgtccttatttcagcctccttttttgaagaatgtttctaatggacataggatttggaacagacagtgctttgaatacgtccatgtttttgctctccatgatttctggcaagaaacacgcatcatgtgtagtattttaccctgtttgttacgtgttgtttctccctggtactttattattctcaaatttctttggggctcaattttataattttcacttctctgctaaaattctgcattttttcactccttaaaatcaatttttgtttaacaccttgaacatatttagagtcactgatttccagtccttccctgctaattccacaatctaagtcatcttgggctctgtttctcctgactgcttatgtcttcttgattgtgggtcctattttcctgcttctttatatttgtagtaaagggccagatagtaaatacttcaattttggtgggctatatgtaacatctgtcacatatctttttttttctgttcttttttgtttaccagtgcattacaaacgtaaactcatcccagtttgtgggctgtgcacacagacagggcacaccagatgtggcctgaggctttagagtgccaacccctatttctgacagtccattatgagaaatctgggtcatgatgtctcccttttgagtttatttctgccaggctgttacttcactagtggatctccccaatcctgtggaagtttgagtttacgctttggttaggagaatcaagtattgtctttgttccacagtgtggtccatacccacgatatggctttgctgatactctatcctgtggtgtggacaagctctctctactctagatgagctgaaagtctgtttccaaatactgtgtgatccctacaatctccgtgggatgcttaactctgcacactgtggcactctcaactgctctgctagggcctgtgaaattccaccccaggtatgagaaactcaggcccagccactgacccgtgaggagcttctgcagattcttggcatctcagcacaattcccacatctcccggattctacccagtgctgctataaggctctgctttcgttccactgccctgtcccagagtcaggaaattatcctcaactggataaatgtaggagttcatatgtttcacttttctcaaggattacagtcctttatcacctaccatccaatgtcagttgcctagaggtactcccataaagagtggatgttgtaggaggaggcaactgggaggacatggatggatttattggagatacaggctcaactgtagtttggaaaaactgctgaggagaaactggggaagaggtggctgggaggagccatcctatggtgagacaaatctcaaataaccgagtgctggaaacgggccttgaaagggcccatatttgactgactctgtctgtaaagcaatgtctcccccaaatactgttgttgtaaacaataaagccaccagctgatggctgttggaacttaagagtagggtgtgggtcaggaaaagagacagtcaaagagacatgccaaaaccactgtccttccaggtgactgtgggtacaccaatgctgtcccctttgaggatcaacatcaaaggcttaatactggggggttcattacttaagggaaaaagacaatttgctttcccccaaagaacaggaacaagaagaatgcctgctcttgccacttaaattcagcacaagccagacatttatcaaatagaaagaaaaggcaaacagattaaaagagaattgtataactatctctatttgaagatgacataatcttatgtgtgtacagagatgcctaagcattagaagtaataaatgcgttcatcaaggtttcaagatacaagataagcagtacagaaatcaataaacaggcctaaaagacatgtacagagcactccaccaaacaccacagaatatatattctttttgagtacagatggaacatcccccaggctaaatcaaatgtcaggaaataaaacaagcctcattagatttaaaagaataaaaataatataaagtatgttctttgaccacaattaaatcaataacaaaaagaaacttggaatcttcaaacatttatggaaatttaaaaacatattctcatatgactattatgcacgaaattgtgtccctcaaagagatatgctgaagtcctgacagttcctcagaacgtgaccttatatagaaatagtgttcttccagacataattcgttaagatgaggaaatattggaaaagtgtgggcccttaatacaatatgactggtgtccttataggaagaggaaagtgatacaaagaaggaaagacaccaggggaatacagagacacacaggtatctcatcactggcatgtgatgatggaggcagagattggagtgatactctcatagactacaaatgcctgaagttgccagtatctgttaaaaagtaggagagaaacattgaacttactgtccttctgaaccctccagaaggaaccaacgttgccggtaccttgatttcagacttctggccttaagaattgtgagaaaataaatttctattgttttaagccatctggtttgtggtatactttgttaacagcagtcctagaatatgaatacaataacaaatgtatcaaagttaagaaattaaaaaggaaatgtgaaaatcccttgagatgtatgaaaataaagacacaatatatcaaagctcatgggatgcagttaaacagtagttagaggaaaatttagagctatgaatgtctatattaagaaagaagaaataattcaaattaataacctaaactgccttaagactgaaaaaggaggagctaactaaaactaaagcaaacagaagtaagcaaataaagattacaaaagaaatacatgaaatttggatgagaaaaacattagaaaaaaatcaatgataccaaaagctggttatttgaaaagatcaacaaaactgacaaacttttaagctagactgaccaagaaaagacagagagggagagggagaaaaagaaagacgattcaacttaataaggaacagaaacgaaaaagggaactttactaccaatcttacagaaataaaaaggatcataaagaactaccatgaacaactgtatgccaataaagtagacaagttagttgaaaatggacaaatttctagaaagacacaagtgactaaatatgacataagaagaaatagtcaatgtgaatagacctataaaaagtacaaagactgaattagcagtcaaagggaaaaataacaaccacaaagaaacatctatacccacatgacttcactggtaaattctatacatttgaagatgaattaatacaaattcttcataaactcttccaaaaaaacagtagaggagggaatacttcccagctaattccatgaggccagtgttaccctgacaccaaaataagacaaataccacaaaaaagaaaagtacagaccagtataatttatgaatacaggcactaatgtcctcaacgaaatatcatcaagccaaatccagcaatatatagaacaactatacaccattattacctgatatctatcataggaatgcaaggttggtttaacatctaaatatcaattaatctaatgcaccttactaatagaataaataacaaaaactgcttgataatctcgatagatgcagataaagcatatgacaaaatccaacacccattcacaataaaaaaaataaacactcaacaaatcagaattagaaggaaacttcctcaacctgataaagttcatctataaaatacccatatctaataccacacttaatggtgaaagactagatgctttccccctgaaatcagaaacaagaaaaggatgtcttctcttgtcactgatattcagcataagccaaaccaatgattaaataaaaagaaagaaatgggccaggtgccatgactcacgcctgtaatcccagcactttgggaggctgaggcaggtaaaccatgaggtcaggagttcaagaccagcctggtcaagatggtgaaaccccgtctctactaaaaatacaaaaaatagccaggcatggtggcaggtgcctgtaatcccagctactcgggaggctgaggcaggagaattgcttgaacccgggggaaggagggtgcagtgagctgagatcgtgccactgcactcccagcctgggcgactgagtgagactctgtctcaaaaaagaaaaaaaaaacagaaaagaaaagaaagaaagaaatgacagattctgaatgcaattgtttgtacaactatctctatttgaagacgacatgaccttgtgtgcacaaagagaaacctaagcaatgcaccaaaaaattattagaagaaatgagttcattaaggtgtcaagatataagatcggtagtacaaaaatcaattatttctacatactaacaataaaaaatgtgaaaataaaattaacaaaattccacttacaatattatcaaaacaataaaatccttagtaataaatttaacaatagaagtacaaaatatggacttgaaaactagaaaacatggttgaaaaatattaaagaacaagtaagtaaatggaaaagcatctcatattcacagacttaatattgttaagacggcaatacttccaaaattgatttacagattcaacattttctgcatcagaatcctagctagcttttctttagaaactgacaaggtgattcacatggaattgctagagacccagaatagtgaaaacaatatcgggaaagaagagaggaaggaaggatcagtaacagaaaagcacttactgttattctacatatttgtaactctagataatacaagtttctatagactgaatgtttctttcccctaaaattaatatgttaaatcctaatgtccaacatgttagtatttggaggtgggacttttggaaggaaggtgattatgtcatgagggtagagccctcatgaatgggattagttcccacataatagaaacctcagagagctccctcccttcttccatcaagtgaggtggcagctagaagatggctctctaggaaccagaaaacaggccctcactcaaattgagacactcaaactgccagtagcttgattctggaatactcataccccaaatatgtgagaagtaaccttttataagccacccagtctatggtatttcgttataatagcctgaagggactaagacacacatataatctataaagaaagaacacattgatttctatgcctggggtagggaaatttgattggaaaaaggtagagtggtggcagacttttttatacctttactgtgactctgctagtagttgcatttgccaaaacttaaaattagtgtaattacacctaaataaagttgctttaacaatcatcttttctgtcttggccaggaagaaaatattgatcaactataaaattttaacttaatagttatattctttttacaacaatccaaagaagtctctaggaacaaaataaaaaataaaaaacaagcaaacatccaaagtatttcgaaattagaaaattactttgaaataacctctacatcaacaaggaaacaaaagcagaaataaataatctaaaaactaaggaaaagtacttcatcaaaacttgcaaggtatagttcagtcaatgcccagatcataatacatataatctgattatttcattactattcaatcagagaaacaagaaaaaaatccaaaagtatagtgaaagcataaaaataaaagttaaaattaatgaaagaacagacaacaaataaatgaaaaattttataaaagttagttttattaaaaaggagtaattaaaaattcccaggcaaaatggattatataagaaaggaagaaataaaaatgtaaaacactgaaaattagatataaatacaaatttagtaatatcaattaaattttaagtgaaaataatctgtgcatacattttttatgaagttttaaatctcaaggcaaaagataattttgtagcataatacattgaccaagagatggaataaagtggcaaaaacaaaacaaatccccaaaccataaaagacactgaaagtttgttaaatatttttcatttaaaaaggtgacaggctggacatgatggctcatacctgtaatcccagcactttgggaggctggggtgggaagatcatttgagccctggagttcaagaccagcactggcaacatagcaagactctgtctcaacaaattatctcaacaaataatgacaaaaaatgtagccaggcatgatggtgtttgcctatggtctcagctatttagctacttgaaagactgaggtaggaggaacccttgagcctgggaggtcaaggctgcagtgagctgtggttgtgccactgtacttaagcctgggggacagagaaaacccggtctcaaaaaagtgaattaaattaaattaaaatttaaaaggtgactggatagtttcacaaatgagtaattcccaaaatgattaaatgaaccttcccaaaatggttaacattagttatttaaagtcttccagatcagaaagaaagatcaatagcttctagcaaattataatgtacaaaaaagacaactatatgtcaaaattaatagattacatgcaaatatgctaaaaaagaaaattttatttcctcagcctattaaagaactaattccatggaaaagtacagttcaggaaattaaggagtggcacaaaattagaaaatttaaaaacctattcatcaaataagaaatcagtaacactaagaaattagagaaaaaccttctatccatggaacatggatacagataaaccttatacatgataaacatgatttatcaagatacatcaaatactaccttaaaaattaaaactctaaactcatgtctattaaagtcatgcacatattagaatgtgcttgctttcttcacaataagctaatattgtgttgtaaattctagctatgcagtcagatcagaaagcaaaatacatacaaacatcagaaaagtagaacaaattttattcatttgtagatgacattactatataccttaaaaagccaagagactaaaataaaacttttcagctgataaagagtatataatgaaatggctagatactaaacaaagttttaagattctggtaatcatagaataataataataaattctagatagaactaaaaacaaatcttgaagatgctgtctagtacctaaaaactggcgtaagtggaagaagatttaaacgttgaaaggcaagaccacgttgggtgacatccttatttacacagctcttctcctaagggcatgtcataaatacagcccaaaagaaagtcagggcccattgagaagggagagtctggggatgtcagagcacacacaagttgaggagggaaatcctagaaagcagggagaaccacagaagtggaagtccccaaattggaattcatacaaatccctgacagagtacaccaaggccaaaacagaaatggaaccacccaactaaagcttaaaggaacatactcatatatttaggatgattgatgagaaatgcaactggccactaggataaaagttaattaccttcagagaaagacaagagcatccagaaagataatggagcttgttgcccattatgtaatatacaaatataaaaaaattactagccatgtaaagaaactgaaaaatgtattacactgtctagagtaaaatcagtcaacaagacaaaactcatagaaaacccagatagtgaaaattcagacaacaatctctaaataatgtacagatacgctaaagaatcttcaggaaaatatatatttagaaaagataggtgaagagatggggaatttcaggagaaacatagcagctataaaaatgaatgaaaaggaaatcccagaacttgaaaatattacatatatatatatacacacacacatatgtgtgtgtgtgtgtgtgtgtgcgtgcatctgtgtgtattttctaaaaatcacaacatgaggttaactacagattggacagaatattaggaaaaaaaacagtgagattagacagatcacaacaaaatacacaaaccattaccagtgaaaaaccatacagagccttaataacctgtaacacagtataaaggggtctaacagaagtgtcagagtctcagaagaaaagagacataatggggcagaaaaaacatctgaagaaatgtaatgcttgaaacttctccaaacttcactgaaatcagcagcccacagacccagaaacctcagaagacaccaagaagaatgactgtaaaagcggtcagggtaaaagatcacagtatactgaggagaacaacaactgctgacttttcccctcaggagggggaaaaaaaaaaagacagaggccagaagaccatttactgacttttatgaaatgatgaaaaaataatctgcccactaagaactctaagtccagtgaaaatatctttaaaaagcgaagccacaataaagccattcttagattaaaaaaaaacaaaaacaaaaaacaaaaacaaaaaaacacctcaaaggatctgctgtcaacacactgagagatgttaaaggaggttatttgggctcaaatgaaatgatagaagttggaaatttggatttacattaatgaattaaaaacagaggaaatggtatacatgtgaaaaatataaaaagttatttttcctaaattcttttcttgtttttttgagatgaagtcttgctctgtagcccagactggagtgcagtggcatggtcttggctcactgctacctctacctcccgggttcaagcgattttcctgcctcagcctcccgagtgtctgggattacaggcatgcaccaccacacctggctaatttttgtatttttactacagatggggtttccccatgttggctaggctggccttgaactcccggcctcaagtgatcagcctggcttggcatcccaaagtgctgggattaaaggtgtgagtcaccacacccagcccatatttcttaaattctttaataattgattcattatttaattttaaatattagcaacctatgtggggtgtataacatatgcagcaataatagctacatatataactatagcagaaaagacaaaaagaggtataaattgaattattttaaagtttttcacattgaacaaaatggaaataatatcaattcaaagcggactaataaaaatgcatactgtaaactcaggaacaaccacttgaaaatttaaaaagggtataacaagaaaaaccaaaagcaaatatagaatgaaatatcactcccccaacacaaatagctcaaaatagaaaatggataattagacaacttataaatgcaaatagactaaacagtacattaaaaagcagtgatttcagacttaaatgtccctgtctgacagctctgaagagagcagtggttctcccagcacgtagctggagatctgagaacgggcagactgcctcctcaagtgggtccctgacccctgacccctgagcagcctaactgggaggcacccccaagtaggggcagaccgacacctcacacggcccggtactcctctgagacaaaacttccagaggaacgatcagacagcagcattcgcggttcacgaaaatccactgttctgcagacaccgctgctgatacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcacctctcctcctccaaaggaacacagttcctcaccagcaacggaacaaagctggatggagaatgactttgacgagctgagagcagaaggcttcagacgatcaaattactctgagctacgggaggacattcaaaccaaagacaaagaagctgaaaactttgaaaaaaatttagaagaatgtataactagaataaccaatacagagaagtgattaaaggagctgatggagctgaaaaccaaggctcaagaactacgtgaagaatgcagaagcctcaggagctgatgcgatcaactggaagaaagggtatcagcaatggaagatgaaatgaatgaaatgaagcgagaaggaagtttagagaaaaaagaataaaaaggaatgagcaaagcctccaagaaatatgggactatgtgaaaagaccaaatctatgtctgattggtgtacctgaaagtgatggggagaatggaaccaagttggaaaacactctgcaggatattatccaggagaacttccccaacctagcaaggcaggccaacgttcaggttcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcaaatctctcggcagaaaccctacaggccagaagagagtgggggccaatattcaacattcttaaaagaaaagaattttcaacccagaatttcatatccagccaaactaagcttcaaaagtgaaggagaaataaaatactttacagacaagcaaatgctgagagattctgttaccaccaggcctgccttacaagagctcctgaaggaagcactaaacatggaaaggaacaaccggtacagccgctgcaaaatcatgccaaaatgtaaagaccatcgagactaagaagaaactgcatcaactaacgagcaaaataaccagccaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctcggataaaacagactttaaaccaacaaagatcaaaagagacaaagaaggccattacataatggtaaagggatcaattcaacaagaagagctaactatcctaaatatatatgcacccaatacaggagcacccagattcacaaagcaagtcctgagtgacctacaaagagacttagactcccacacaataataatgggagactttaacaccccactgtcaacattagacagatcaacgagacagaaagttaacaaggatacccaggaattgaactcagctctgcaccaagcggacctaatagacatctacagaactctccaccccaaatcaacagaatatacatttttttcagcacgacaccacacctattccaaaattgaccacatacttggaagtaaagctctcctcagcaaatgtaaaagaacagaaattataacaaactgtctctcagaccacagtgcaatcaaactagaactcagggttaagaaactcactcaaaactgctcaactacatggaaactgaacaacctgctcctgaatgactactgggtacataacgaaatgaaggcagaaataaagatgttctctgaaaccaatgagaacaaagacacaacataccagaatctctgggacacattcaaagcagtgtgtagagggaaatttatagcactaaatgcccacaagagaaagcaggaaagatccaaaattgacaccctaacatcataattaaaagaactagaaaagcaagagcaaacacattcaaaagctagcagaaggcaagaaataactaaaatcagagcagaactgaaggaaatagagacacaaaaaacatttcaaaaaattaatgaatccaggagctggttttttgaaaggatcaacaaaattgatagactgctagcaagactactaaagaaaaaaagagaaaaatcaaatagacgcaataaaaaatgataaagggcatattgccaccaatcccacagaaatacaaactaccatgagagaatactacaaacacctctacgcaaataaactagaaaatctagaagaaatggataaattcctcgacacatacactctcccaagactaaaccaggaagaagttgaatctctgaatagaccaataacaggagctgaaattgtggcaataatcaacagcttaccaaccaaaaagagtccaggaccagatggattcacagccaaattctaccagagtacaaggaggaactggtaccattccttctgaaactattccaatcaatagaaaaagagggaatcctccctaactcattttatgaggccagcatcatcctgataccaaagccgggcagagacacaaccaaaaaagagaattttagaccaacatccttgatgaacattgatgcaaaaatcctcaataaaatactggcaaaccaaatccagcagcacatcaaaaagcttatccaccatgagcaagtgagcttcatccctgggatgcaaggctggttcaatatatgcaaatccataaatgtaatccagcatataaacagaaccaaagacaaaaaccacatgattatctcaatagctgcagaaaaggcctttgacaaaattcaacaacccttcatgctaaaaactctcaataaattaggtattgataggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaaatcaaattgtccctgtttgcagatgacatgattgtatatctagaaaaccccattgtctcagcccaaaatctccttaagctgataagcaacttcagcaaagtctcaggatacaaaatcaatgcacaaaaatcacaagcattcttatacaccaataacagacaaacagaaagccaaatcatgagtgaactcccattcacagttgcttcaaagagaataaaatacctaggaatccaacttacaagggacgtgaaggacctcttcaaggagaacgacaaaccactgctcaatgaaataaaagaggatacacacaaatggaagaacattccatgctcatgggtaggaagaatcaatattgtgaaaatcgccatactgcccaaggtaatttatagattcaatgccatccccatcaagctaccaatgactttcttcacagaattggaaaaaaatactttaaagttcatatggaaccaaaaaagagcccgcattgccaagtcaatcctaagccaaaagaacaaagctggaggcatcacgctacctgacttcaaagtatactacaaggctacagtaaccaaaacagcatggtactggtaccaaaacagagaaacagatcagtggaacagaagagagccctcagaaataacgctgcatatctacaaccatctgatctttgacaaacctgacaaaaacaagaaatggggaaaggattccctatttaataaatggtgctgggaaaactggctagccatatgtagaaagctgaaactggatcccttccttacaccttatataaaaattaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaatttttcgcaacctactcatctgacaaagggctaatatccagaatctacaatgaactcaaacaaatttacaagacaaaaacaaacaaccccatcaaaaagtgggcaaaggatatgaacggacacttctcaaaagaagacatttatgcagccaaaagacacatgaaaaaatgctcatcatgactggccatcagagaaatgcaaatcaaaaccacaatgagataccatctcacaccagttagaatggcaatcatcaaaaagtcaggaaacaacaggtgctggagaggatatggagaaataggaacacttttacactgttggtgggactgtaaactagttcaaccattgtggaagtcagtgtggcgattcctcagggatctagaactagaaataccatgtgacccagccatcccattactgggtatatacccaaaggactataaatcatgctgctgtaaagacacatgcacatgtatgtttattgcggcactattcactatagcaaagacttggaacaaacccaaatgtccaacaatgatagactggattaagaaaatgtggcacatatacaccatggaatactatgcagccataaaaaatgatgagttcatgtcctttgtagggacatggatgaaattggaatcatcattctcagtaaactatcgcaaggacaaaaaaccaaacaccgcatgttctcactcatagatgggaattgaacaatgagaacacatggacacaggaagggaaacatcacactctggggactgttgtggggtggggggaggggggagggatagcattaggagatatacctaatgctaaatgacgaattaatgggtgcagcacaccagcatggcacatgtatacatatgtaactaacctgcacattgtgcacatgtaccctaaaacttgaagtatgataataataataaaaaaattaaatctataaaaatacataaagaaaactttaattattatttgttactatgagacttgatttctttaaaagatcaaaaatttgtcctcctgaaactaaatctgttttcaaaagaaaatctgaataagttttttgaaaatctaatgtaaagaaatatgtgtaatatataacagaaaattttaatatccttaacaaaaatatagaataaaagctgatatataaaaaagtaaacaattcaacaaagtataagcaaaatttatgaataaatacacagaagtaagaatagtaagtaataaacaaacataaaaaaatcttcaatacagtgagtggtcagagactggcgtatttactgagaaaaggttttcacctttatgttagaaggagtgtgaatttctatagccttttctgagaatgtaatatatgtataaattgacggcaatatatgttccaggcatacattgttttattgcattttgcctgattgtgcttcataaataccatgtttttggtttttttttttttttacaaattgaagttttgtggcaaccttgggtacagcaatatcggcagcatttttccaacagcaagtgcttactttgattctctgtgttacattttggtaattttcaaaatatttcaaatattctcattattttattgtatcagtcacagtgatctatgatcagtgatctttgatgttaccattgtaactatttgtgggtgccatgaattacacccatatatgatggtgaacttaattgataaatgttgtgtgtattcagactgctccaccaactggctgttcccccatctccctccctgtccttgaacatccttgttccctaaaagcagtaatattaaaattaggccaattaataactctacaatgacctctaactgttcaagtgaaaaaaagtcatatgtctctcactttaaatcaaaagctagaagtgactaaacttaggaaggcacatctaaagctgagataggctgaaagcaaggactcttgggccaaacagccaagttgtgaatggaaagaaaaaattcttcaaggaaattaaaagggctacaagtgttcttgatgatatgaagaaagttttagtaatctggatagaagatcaaaccagccacaacattcccttaagccaaaagctaatccagagcaaggccttaactgtctccaattctgtgacacctgggagatgtgaaaatgctgcagaaggaaagtatgaaagtagcagagattggttcgagaggtttaaagcaaggtaaaaagtgcaagctgaagcagcaagtgctgatgtaaaagcagcaggttattcagaagatctaactaagataacggatgaaggtggctcaactaaataacagattttcagtatagacaaaacatctattagagacatctaggactttgatatctagagaggagaagtcaatgtctagctccaaagcttcaaaggatgagctgactcctgtcaggggctaatgtagctggtgacatcagggtaaagccaatgattatttaccatttcaaaaattctagggtccttaagaattatgctaagtcaattctgtctgtgctctataaatggaacaacaaagcctcaatgacagcacatttgtttagagcatgatatactgaacattctaagcctactatcaaaacttactgctcagaaagaaaggttcctttcaaaatgttactgctcattgacaatgaaccaagtcactcaagagctctgatggacatgcacatgattaatgcattttcaagcctgttcacacaacatctattctgtagctaatggatcaaaatgtaactttgtccttcaagtcctattatctaagaaatacatcttgtaagaatatagctgttatagacagtgattcctccaatgaatgtgggaaaggtgaattgaaaaccttttggaaaagattcaccattctagatgccattgagaacattcatgattcacaggaggtagtcaaagcttcaagacttcagtggaggaagaaactgcagatgtggtagaaactagtggagcctgaaaatgatgactgatgcaatcatgatcaaacttgaacggatgaggtgcttcttatgaatgagccaagaaagtttcttgagatgacatctacttctggtgaagatgctgtgaacatggttgaaatgtcagcaaaggatttagaatattccataaacttgtttgacaaagcaggggcagggtctgagaggactgactctaatgttgaaggaagttctactgcaggtgaaatgctatcaaacagcgtcataagctgcagagaaattttctgtgaaaggaagagtccattgatgtgacagacttcactctcgtcatattttaagaaactgccacatccaggctgggcacagcggctctggcctgtaatcccagttactcaggaggctgaggtgggaggactgcttgaggccaggagtttgagaccagcctgggcaacacagcaattccctatctctaaaataagaaatgaaaaaaattagctgggcatggtggtgtgtgcctgtagtcctagctactcaggaggttgaggtaggaggatccctggcgcccaggagtttgaggctgcagtgagctatgatgatgccactgcatgttgacaggctgaacaagaccccatctttaaaaaagaaggagaagaaaacaaattgccacatgcatccctaccgttctatgatttgcaaccaccaccctggtcagaagccaccaatactgaggcaagacccttcaccagtaaaaagattatgatttgctgaagtcttagatgatcattagcatttttaagcaacaaagcatttttaaattaaggtgtgtattttttaggcatgatgttattgcatacttagtagaacacatggtgtaaatacaacttttatatgcactgggaaaccaaaaagtttgtgtgacttgctttattatgaaatttcttttacaatacatctgagttatgcttgaacatactgtatgcacacacgcacacacacacccctacctttgaaaaatcatagaaaaatgcctaagatgacattacaggaaatagacagttgctactggaatgcagaaaaatagaatattactcttttttatacctctatattatttgaattattaaaacaaacatgcattgcctttcaatgcatgtttcaatgcatatttgttttaattgcttttcaagttatatgtcaaaaattatttaaacatgcaccactaccacgtatgtacatgggtaccaaaagtgttgttatttttaggtgaatgtttaaatttcctatattataataatcattgtaatcattctgctgaaaagattatattcaagaggctggatactagttacatgattcttatttacaaccccagaagaaaaaaaagaaagtgtatgggtttcaggaaaccaagggatatttcatgaaggctctatttccctgatcttctgattgccataaaaaaaaactgaacaaacacctgtttctacatgtcttggaacaaggactacacacaacctgttggagacataaagactgtagaccacacttctcatgtgggctgaaggaaaagaaagacatgctagaacaccctaattgatgtttaggggcttttccctgataccatccctctttgtggtccaggaagaggccctggcaatgtcctcagactgccatgtgtgaaaataagatatctttgtattgtttttcttaaataaggttccctaaattgtatcagtttcaagctctacaaaatctggatccatccagtttgaaggtaagttgaatcacaaataactgctgcttatccaaaagcatcaatatcattatacaaatggtacttattcttgaagaggtaaactttattagatatctatagtcatttgtaaaaccaacattttgtatttggtgtacctgagagaatagtgaattatttctaagaactttaaaacagtctgtcccaaagaacaaaatgtaggatcagtacttaatgaatcacagaggagatatacagaacacctgaacaaaaagtataaatccaaattcagcaagagtggcaaagaagcagtaagtaagtgctcaccagcctagggataaagatgtcctcacttaagcagaagttggtcagacatgcaaacaggaacaggaaagccacagaaataaaagctagtgttaccactacaaattgtcaaggggagatggcaggttagccaatgaactttgatctaatatacagatgggtgaacaggttcataaagaacatacctgacctatttctgaatccactaggcaagacacccatcctcaaaaacaaaagggcatcagactaatttagcctgattccattaggatatctaatttatctaatcctccttgttgtaattccatgttcaccaaataaacttttcattgctacttggctttctaccccatgggatgccaatattctgacccttgtgactgcctaatacaattacagatcaataaaaggggagtccagtttctacaccaatcacattagcttgcttaataggactggattctggaaatagaatccattttcatttgctcttgagtttctgaggccaatggccagaccctgaatgctgatcaatgcaagaagggacctcttggagaaacatcattccagcctttcctttgaaagttgccaatccctgtgtgattagtgtaacttccaatctgtattttgattatcctcactagacattgccagcaatcttgtcaaacaacaaagcatctaaagtaaatataaacaagatgtacataaagtgaaaaacatgtaaattttttacattccttctttcaaatataagcttacgccacattacatttcttaagtatcaatttattccagataacactttctgggcttctaagcttttaaaaattatttttacctatgtgattgattattaaggtttagtgatccggtctggtacatctcttccaactgcttcctgtttccaaagtataaagcaaggtctgtggcaatgatggctttgcggatgatctcaagcacctgctcatattcactggagctcagagtggagaagatattgtgcccttccaactagggaaaaaatacaaataaaaaccaccaataacaagcacaagctctaatcttatgacatttttagttatttgaaactatatagtcagtcaatgacatctggcacactaatgaaaggttttggggtaacttttgttttttttgaatagttagaaatgactaacgaaaactgcgttttggtttctctttaagctacagaaacaatgaagctaccacttaaataaactattgcaactataataacatcatttactaccataaaaccccagtgatttaaatatatctagttcttggatatttctaatagtttaaaaaaacttgaaaatgtaaaatatttaagttaaagacttttcctcttaagctaattaaaaacttcagtaatttttgtattatactagaaccttaatgggctaaaaaaggcatctatatccttgtccacttcaggttgtaacataccaaaacatgcttaatagacagtaatatatttctctgtatcctagaagaaaatgtcctacaacctcaataaaatgtttattcaaacacattaaaaactctaagggcaagagtacctttccctacaacacaaatcactgaagctacgacaattctaggaccatcttctattcccaagggaggtgggaatggcagatcatcaccctacacaacaccagaacactggtaatctggattctattggctcagaatatccttcgtgtattaatcttttaaaaactttataataatttattcctgtggaaattttaaggtttttatttgtaattgagggaaaaaaaccctttgttgaaactaaaaagtttgagataattaagatgcagtcaatttgcagattcatcaattattttgatattatttcattattggtcaatatagtactactctaagttgattttcaattaatttcacttttcttaatatacatttattgagttaaaatacagtaaaaacacaatgattgaagcatatttctttaaaaaattagacatctcactaagacactgtctcttcatattcttaaatgaaattgtacatgcaccatttgttttcaattatcagaacagttccatattatttgctcttaaagtcttagaagtatttgaattattgtatgataaatgcagcaaatggactcaggtctagttatttattttcctgacaataatagtagtaagaccttacatttgtagaaagttctacagcttacaaagcactttgaaacacacgacttcactttcaaattataaaacttatattagttcagagttcccacatggattgtacatgagatgctatgagatgagccgtttgagcataggctggttagtgactgatggggacaacgggaggggactcaggctttgggctggtggctgaactcaataatcatccaagctcgactctcttcaattttgttgtagaaagttctaagaaggaaatattgattcatgctatggtatctgctttcctttgaagtgaccgtaactcacgtgaagcaggtagctcctgcatcaacactgaatgcctgtcacctctatttcccacttcatgaacatgtttcagcatgtctggctggtgctcacgcacacatctgctttcagcaggtcatgtgaagggaatcacagctgatacaattttgtgctttgtatttgtatgctttactctctttatcaccaataattatcaccataacctgttaaattataatatataaaatattctagtctgctgttgacatttaaaaagaaatatctctaaaatagggtctccttagcctaggctctgtaaattctgtagggggacaaaagagttataaactcactgcaattctacacactggatatgtcatctgtaagctcatgtttttatcagagtcccaaaagtgtcgactgtcccaaagcaagttaagatttattttaaagaatgtatatattctactgactactttggagtcattacttttcagtattaaaggaaactaggtgaaaaagctccatagagggcttttataataaaaaggtctaactcatttactgtccccttcaataatttacaagagtaaagggaatgaatgaacaaacaaaaaataaatatctcccttttctttctttgagacagagtctcgctctgtcaccaggctggagtggatctctgctcaccacaatctctgcttcctggattcaagcgattctcctgcctcagcctctagagtagctgggattacagggacgcaccaccacacctggctaatttttttttttttttttttttttgtatttttagtagagacggagtttcaccatgttggccaggatgctcttcatctcccgacctcgtgatctgcctgcatcggcctcccaaagtgctgggattacagacgtgagccaccgcgcccggccacgtctccctttactttaagagaatctagcattttgctgctatccaaactaaagaaaataaggaagggagatacaagcaatgaagcatagcagacaaacagtatcttctttaaacctccaacctcacatttgttaacacataataaatccttataatgcattataatacttttatacaccaattgataattttactatagttacatagtttgaagtctatgttaattcaagctagttgattccattttgcataaatcaagcatgaaatagtagactttttacacccacgaatgtttctaaaacttaacgtgggtgaacagcatgtaattcttaactctatggaagcacacagggaggctctggttgtatgtaaatgctgtggctgagatctgatattagagaatggaaacaatgttgaaattggtgctgacgctgaaagatgacccagggactgccttgaatagatgattctcaacactccttccagcccttaatcataaggatcctaaaggctgttagtattctgtccactgctgggggattagggaaccaccgcttttggaaaaaaatgtcaacgatgcaactaagcgcatcaaacattcatgatggcaatgcctttacaatacatagaatactgattttgaaagttaattacctagtacatgaaaccacatattagggagcattatagtactgtaattaagagcaccgattttggagccaaataattctatcttttaatgtcattctgccacttactagttatgtgacaaatagattacttaacctccttgatgcatattattctcatctgtaaaatgaaaataaattaatacctatctcatggggatataataaaaataaactgtattaaaatatgtacaaaatatttaagtttctggttcattgtaagtacccaatacatgataaaacgattactattataatagtgatgattgatgatgatgatgatgatgataaaatctaccagtacaacttccacagtcagagttaaaaaaggaaagacagatgaaaaaacaaatatatgcctaaaagagaatttgatagccaaataccttttctattcagaacacagctgtagaaaaggacggatttaaactagccactttgtcatatattttagattaccagtacaggtagtgttgaatataagtacaataattttgctataattgtaatatacaacagcaaattgtatctagtgcagacgaattggaagaactctctagctaagtaacagaaatagtgcttctataaagagtagtaagaagtcacgggatcccaaaatgttggtataaatagataactttctgaaatatgatcacatttcaaaagcaacagataatttaagattagtggaacattaagaaaatgttctcaataatgagaataatcattcctaattggtctgttttctaaaattttgactatttttaaagtcaaaatgggctattaaaaaaggcaaagaaaaagtatagtttcaatgttcaaaataatcattcatatcttatgagtaaacagaataaattgatttaatattccagcaataatgattcaattaccattactaattgtaagctagtaagttttaggcaagaaaacaaagctcacctacgttcttggatgtgactgtccacacaaaacagtctgctcacatgaaggcattctgcttgccttcttcccctgctcagtgtctcagttctctgccccaccggacacagctactcactttcctcacgtaaagcttcagtttcagtctctgagtgctggttctgcccactctgcatcttcccctccccatgctctaccttcacacttccacttgtgcccatatcaacagccccagaggtgggcctgtgagtccagaggtgaagaaggggcagtgactctcctcatcagcttctaattcagaagaagtgggaagctaaactcacaaacagaaaacttcaatacagtgttaaaaacaaaaaaacaaacaaaacactaagatgtatgtatgcttgaggtgctcaggcgctatgtaaaagggggcagtgctgtaccccagtcatgtggggatacactcaaagaattttacaggatgaggtcatgcctgagtggggggccacaagaaagggtgtggggtaattacatgtagagagaacccggccaatggcacagggttaagatacggtctgaaactacagaagcagagcagatctgtagtcctggaacagacaggggccactcatgaaagacttgtatatccactaagaaaacaggaaattattccagaggccccagagagtcactaatgacttttaaacaggagaaaaacatattcagacatatacttggaggacggatttgggacacaaacacttggagaaacagtgatggatgaggaggaaaaggcggaaaaacagacaaaatacgatgaaggctgaaaccgagatgtcaagtagggatggtgcttgccacttgggagctgtagtggtcagaggggccagattaccatttactagagactcaagggactttcctgtctgctaaatgtccaccatgagctctacacagcgacgggccccaaacaccatgaaaacaatcctgatggccagcattaaggcacaatgggaagctcagggaaaaatgagaacgcagactgaccttctctgcagatgctcttgtatttacccttacttcatgacttaatctcttcccattgcccactcaacacgggattatctactgcatccctatcactgtgaccaaggtcaaggcaagctgtgagcaaatacccacttcctgcttttccctaccatgagtaacgtgtgtgtgtatgtgtgagtgagtgtgtgtgtgtgtgtgtgtgtgtgtgtgtgtgtgtgtatgggggggggcgactaaaggttagcttttcaagtctattgtattattctccttgcttgctgttgtcactgtgttagccagcagtactcttctgaatgccctgcttatccagtagataccactggcagccatagtgaaagctggcactcaggttggcaaaactataataagcagccacatatgcaacacacacctgtgaagatgcctgatgaggaactatttccaaccatcatacacaaaattgcttacgtcctatctgtctgtgtggccagaggatgggcagcgccatgctcgtaatcatctgtgtggcaatgcagatcaagaaagcaatgggaaaagtcttttgtggataaacagaagtatcacaggtattcatattatgaaactatatattgttcttattttaatgactggaagttggaatttttaactgttacccaaggatagcatcttaattagtcaagcttgtaggtgtcttttgatgaaacataaaatcagcaggacttggtggtaacaggatggagggatgggaagataaagctaaagaagggaaaaatgatgactctaaggtcatcagcctgcattcctgggtcaatgagattgccaccacagagatataaaatacaaaaggcacctaaataagtataataccaagcacaattcgggcatactgaatacagggttcaactgcttgggcagaagtcctattgagcactaggcagaattacatgggtacgagagtcctcagggcaccactgtcagagccacaggtgtgccaggtggtgggccaatgagaagaacaacataagggcagaagtcaggggactcaggccttcctcactctgacggtgagttccagaggacagggatttgtggttgctctgtttatcactatatccccagtgcctaaaacagttgttggcaaatagaaggtgctcagtaagtatgtttgttattaaattggatttcagggaccagttagatgaatccaaaaaaacactcagagaagtatcatgaggattactgcaaaatcagccaagtgtacagaaattttccgaagaggaagacactcttccctgaatgttcctgcccatgtagattgggttgtctgtttatggccccaatattatttctctctgggcgtagctcaaattgaagggatttggtcaatcgaacatataaatttgttttcaaactggcagtgcttttcatctgaattcgcagcaatccctaatccttattcccagcttctgtttttgcaatgtacctagcaccttatcttctctacgcagaacaaatttgtcattattattaattcaccaatgactgaaattccagctctaatatctgaacctattctcccatgcctttttgaatgccaacagcttacctgtctgaacttaacttactgccatgagctcctgttactagttctgatctgtttttaggaacaccgccttaagtaatctgcaagccccacatcgcggagggtttgccaaaatggaggcaaaccaccctaaacctccatttttgatggcagcaactgggccaagtcttcctagggtttaggtggacctggagcttcaccatccccacctgccttgatgtgactgctatattacaaggtttatttattattctgctcaggggcaataaactttgcaatctggcctccttcaaaactaatcctattatatttaatacagcctttctaaagaaactctatattggctattaaaattcagctgtgattaaactgctagcaatgttgtactgtcaaatgcatgaattcatttagggcatgggatgctaattcagtgactcctaattatttttaagtgaagtcatcctgatgttgtttctggcgtttattcttcttaaacaaacaaatagtctccaatgatgaatgaggtcaaagtagacattagctgtcataaagttttagaatgttcatccatttacaaaaaagcatgttttacatatatgtgtaaatatatgtacacatacatatacacacaagccttttatcctgcttaaatttctatgtatgcagccaggcgcggtggctcacgcctgtaatcccagcactttgggaggctgaggcgggcggatcacaaggtcaggagattgagaccattctggctaacacaatgaaaccccagctctactaaaaaaaaaaaaaatacaaaaaaaaaaattagccgggcatggtggtgggctcctgtagttccagctacttgggaggctgaggcaggagaatggcgtgaatccaggaggcggggcgtgcagtgagcccagatcgcgccactgcactccagcctgggcgacacagcgagactctgtctcaaaaaaaaaatttctatgtatgcttgttttatgccggtatgtatgtatctatgtaaacatatgtcatttaaaaaggaaagagctggtgtcaagcaaatgataggaatgatgactacatgttgctttcacgaccaaactgaaccatgagcaagctcaacatcagctacctactggggatggcttgaaaatgactcaaatagctccatatctgaaacacttttcacttctacccagaagataattcgaagagcacccacaatagagtaagttcatcatttaccttcgtaggcctgaggacatgagacctggacaggtcagttttgctgggttttaaaaaggactgagcaggcagcactaccaatcacgtggacagttaaatgaggaggcactaagagaagcctttgggaaactgaggggagaaaaaaaaatcctggcatttagaggaggcctggcctattcaacagagaaaaactgcaccaagtggcaaaagcttttctgcttcgcaacttgcctatggccagttactggcagagtcactgctggcattttgctgtgacatcctaaaaactcaaaaccttttcccttagacacatcattggaagacctaacgaggatttctcttcctacttagaggtgctgacagtgagaggaaaatatagggcccactatacttaagccaaacccagattatatttttaaacattgtttgtgataggaatcaagtcactatgatgtaatagctaccttgataagatgagtttgagaaaaatcatttaagaaagaaggagcgtatatatcccatgttgaagtgatgtctgtgattgtctacatcaattaccaagaacatcttaaagacaataaaataaataaacaaaacatacagtgtaaaaaaagaaaggctacaatgcatttaaaaccttatatttagctaacttttaagatttgctgttcaatatcttcttgttcaagaatatgataatctatataattaattgatttaaactatgtaaaataagtattgctttagggttacaggtacttactgatataatgtttaaaaaacaaatgtgattgcaaaatacatatattcaaattatttgtaaaggattctttatgcaaaaaacactattatttaatgatgactataaatataaggttctacaataaaaagtagctgttgcttttaaggaagccataatgatcttccttttccacctatgaagtatccctatctcccagacagcccttcagactaagcgagagacggcgtgcagtgactcacctggaggatggacacagtctgggagaagtggtgctgctccatggtggaagtggagtagagagcggccagagggtggtcgaacttctgcaggtagctgttactgaagcccctgtggtccaggtcatgacacagacacgcaatcagcagtcctttgcgctttaaaaaataatatgatgcagagatgctcaaaacacagaaacacacatgagcagacttaccgcttacattcatgtcacattactttctggcattaatatagcacaaatacagcattctggcataaagaatcctatacaaatagagcaaacccttaggaatcttggaaattccagataatctaactcatttgtaggccctttctttgtttctctgcttaggaatctgatagtcaaattatttttgagtttctctctcaactctaggaaaaggtgcaggaggtatcaacttaaaggtataaagcaaatgttccaaaaaagtacagataaagcaaatctgcacaaggaaagaaaggtcagtttcagcaaaatctattcaatgttaaattctaacaatgctattgctattataaacaataaatataacaggtaaatcatatcgcatgtaaaaatggcaaatatatagaaaaaaaggcagagcaggctaaaggaaattagagaaagtcaggctgagtatgaaataaactaggcaggcacacctcatgaaaaggccaggtgtgagcaaagacccgaaacagggtaaggagagcggcaagcgcagtgtgggagaagagcacgccgggcaggggagcagtaacaacataaacttgaaggcgagtgtgccctgagactcggaggatcaggacggtggccagtggggtcgagggcaggggaagcagtcatcataaaaggcttatattctcagtgatctggggaactattattacacggtttttagcagagcagtgttaccatcttgcttatatatttacaagattattctggcaactgtgtggaaaacagactccaggaggatgagagatcagtgaggaggtttctaaagtaattgaggcaaaatgtaatagagctttagaccaggataataacagtgaaagcttctatggggtgattaaagtctggatgcattttgcaggcagaaccaacaggattttttgactgtcagagtgtgaaaagaaaggacatgaggaggggtcaagtatgacctcaaatgttttggccttagaagctataatgattaccatcaactgatatggaaggactgcaggtggaatgggtttgaggagggaggtcaggagctcacatttagactgaggcgaaggagtctacttgatagtcaagtggagatttgacaagtggagattttgttttgacaggtagcagctactgaagcctcacggcctggagataggcctttgctagagaaatgaaactgtcagtgcccatgtggcgtttaaggccacatgactggctgagctcaccaaggttgtagtttgaggttggaggagggtcaaggtctaagctctcaagtactcccaattctaaaataaatcatccagcaattaaatacttgataaattaaatacttgataaaaattgaagggaagaaagaactctataggttaaatcctattacaacacatttcatatgacagtttctattctttcatgaagggattttgagtggaattcaggttatgccaaacattgcttgaaaagactgaagtgtttaaagaatattgactcaatgtgttagtaacaatcacaatcacaatttttattttgaaagacaaattatacctgaaaagggggaacagactgcatggtctaagtctgaggaaagagaaggattaagaaaaaaacaacaaaacaaaaacaaacaaacaaaaaaccccaagggaggaacagctggtgcattcgcaggaaaaccaagagtgccgaatgtcccgggattcgattgaagacactgagcactaacccttggatctcgcaaggtgtgggtcactggtgacctggagcagggcattttctggggtgttaaggtcagaagcttgatcagagttgttttcagaaagaatgcgaggagaggattttgaaagagtcaatagggtaatgcttacatggggtttactgcaaagaagagcaaagtaacagggagggagctgagaagagcggcagatcggagcatattctaagatggaagtaaaaaactgcatgcgtacatgcagatggcaatgatccagaaaagaggggtgaaagcatgataatggaggagagagaagagtgggaagcactggtaggcagtgttctccaagaggtggaggcgacagatacaataaagcagaagggtcagctctggagaggagtgtgaaggtttaaggaagtgtgcaaggcagagcctgctgagggcagatgcagacagatgggggtgctgcgatgggagtcagcagaagttctcacaggtacatttttagcgatatgcctgcttctttgtcctgataatgctgaactggtttttcccgccacataattggaagggaaatctcgccagtaacccctaaccccatgaagtatcatgttaacaatcatactcgcctggcattcttaagataactgaattaattatgttgttagtatcattttgttttggggtggtttccatgttatatgctgctgtgtcatcatgatgtacctgataagaaatctcaagagttttacaatcttgcacaatacgtaaaagttatcatctttccagtttctaaactcatttttaaaattcatgtgactttcagtagttttattaaaggtgtgccagaatcatacatctgaaaataatgtataaagaatcacccttgttaagcatttccctttaacaagatcaaatggtaacttctaacagttcttttagagattaaatttcttctttataaaatatgttttaaatatttacatgtcattttggggattatttttcagccaaaacgatctgatgttttgggaaaatgtaatgatataattccaaaaatgaattaggaacttaaatgagagtcaatatgtatcaacaaagtttttctcacttattgttaaattttcaatttttttgaatataaattacaatgcaacttgaaagtataatttctacagttcttaaactcacaaggtatggcaaaatggcaaaacaagacaatgaaattgctttcttaaaaggaacagaatggagaaaatgctgaaagtctcaacagtatggggttcaatagaaaaggactttgttaagacaaacaaatgaaaaaaggagagatttcatgtggatctttcgcggggaggtgataaataataaattactgatcaggctaaactccacttgaactaaagattgttttaaaaaaagcaacaaaaactagaggataattttttattctttcttaaaatgctactatttttttcctagaatgcatcttttgagttttccactcagattgtgaatttggtccaataggatggaaaaggataggatggaccttcacaagtactagattctagtttaaatgtgaatttgagaaaagcacaatttatttatcacaaagatgacagctcctttctctggacagtcataggtcccctaaaagatgataccagtttttacagaggagagaaaggaggactccctctaaggtgtcagtagatactaccaggatcaatgtggtcagagggagggatatccttcaaagtcgggattgtccagatgtagaatcagcatcctttgtggccaggagtcactaagcatttagcctggctttcaagtaagggactttgactgtggttgatgaatggaagtggccatctccaattctaactctgagattacgaaagctttggatatgtcactaactctgggtatttaaagtcaggcaaattaattaaacatttcagatcctttagtttccttatgctagaggaggtcaaaaacacttatgtcttcacagtattgaatgctctaggttctcaaataggcaggatacgtctacattatccagggcatataagcaatgaataaaattcactgtttatatcccttcagaacatttaagctttaacaggtaagacagactacaaaattagtatttccttgggggatattttgatgaagttaaaatttcttttatctacatttcttatacaaaataatatgctaaatgtttgggtacaagagtctaaaaatgggctactattgatttattaagccaaaatttgtcttggaataacatgtcacaaatccatgtcatcaatgtgctcctgacacacagtattaaatccactgaggttacgagaaacagaggtaaagagtgcacacccacctcaaggtctgtgaaaagcgtgtgattgttctgaagtatggcatacatgcagtgtgctacagtgaccgcatgcttccagttgtgataaggaacccgccgatagttcttcttcacagacataataaaacgacacaacttttcaagctcaaagctgcatggaaaagaaattgttatgactgaaaccagtagagaatcactatgttgtaggagaactccctagtttaggtacatatatgtctgtacccttatacatttgcaactctaaagatttccaccctgactgaatccatgagcactggaaactcattcaccagttcccttccagttctctagccaaaaagaagtaagaggataaagactcttttatggtatctgttgtgatacagtaactgtcccaccagcgaaaaaatatcagtattagtacacagtcacccgtcaccagccctcatgatcttctttagttttacgttcatttcctaaaccccacagtgctcaaaagacaacaacacagcaccatcttgctaaagggtattttgagctaatattttccaaaaagaatattcagacttgcaaactgcaaatatgtatatcatgagacttttctagagttactatactttcaaagtaattccaaagtattaaggtttattacacactcaaattattaagtcacaaatgaacatatccaaatactgacatagtatataaaataatatgatgtatattttattacatatagttatactatatttttatattttttatattatgtacttatttaagaccctacaaactctcaaaatagacttgagacagcttaaaacaaaagcatatataaaacaaggctttctaaaataccagggaggtcaagaattcataaaaacttaaaaaaaaaagtaacctgtgtttttctccactgaaaattttcaaatgtctttgaagtataaggtatggcattttaagaattccaactggtcaaactctcaactgcattctgagaattaactggagttaggtatcctatgctcatccttttgaaacactaatttacaaaaagtcacagatagaaaatacacaggcttcaagaagaatgacaatttagttctagagaaactaagaggctctataagacatttaattcctaaatgagtaaaaaagagcaaaagaaaactattccttgcatttaaatattgtgtgtttacactgaaaaggatcagttataaagtcaggaaaggcctctaggacaggccaaagtgggtggggaaaagatctgcaatgaaatggtgccataatcaaattactgacaaagtatcacactttgaataagaagacatgtttcttttcgatctattctaatagatatatgatgttaggttgaaagttgatgctaaatttacacgtggtgttctaaacatttattattattattattattattatactttaagttctggggtccacgtgcagaacgtgcaggtttgttacataggtatacacgtgccatgatggcttgctgcacccatcaacccttcatctacatttgctatttctcctaatgctatccctcccttagcctcccatcccccaacaggccccagtgtgtgatgttcccctccctgtgtccatatgttctcactgttcaacttccacttataagagagaacatgttgtgtttggttttctcttcttgtgttaatatgctgagaatgatggtttccagcttcatccatgtccctgcaaaggacatgaactcatccttttttatggctgcatagtattccatggtgtgtatgtgccacattttctttatccagtctatcattgatgggcatttgggttggttccaagtctttgctattatgaacagtgccacaataaacatatgtgtgcacatgtctttatagtagagtgatttataatcctttgggtatatacctagtaatgggattgctaggtcaaatggtatttctagttctagatccttgaggaatcaccataccgttttctacaatggttgaactaatttacattcccaccaacagtgtaaaagcattcctatttctccacatcctctccagcatctgttgtttcctgactctttaatgatcgccattctaactggcgtgagatggtgtctcattgtggttttgatttgcatttctctaatgaccagtgatgatgagatttttttcatatgtttactagctgtataaaattcttgtcagtagtaacccctgtctctttcagttacccagctgaaagaaactctagcctctgtttttatgaaagcttttcagattttttaaccaggctacaaccatgttgctagagcccctacagagaatctgaaaaggctgcatatttgtataataatctcagcccttttttattggaatatttaggaaaaaaagtaatttatacatgcagtatttaaaaataattacaaacaaagatcgtggtgaggcatatatgtagaaggaggaagaggttatgtcacccaatatttcaaaaagtaaattttaaagtcattcataccaggatgtcccacaggaccgatgaaccatgtagacaaaaattccaggccacatgttttcaaaaggaccaatgtcaaagtggaatctgaaattttaaaagggcagtttatcactaaacgtgattagaataaacacagtaagtaaagaaaagcatttaacttgtttgtaccaaggagctaaaaagacactgggagctcagccatcccttttcctgccttcttagccacatagctgttactgaaagatttccaggaagaaactaaacatattgccttagaaatctagtccaatatttgagttattgattttctattaatctgtttgaaaatgatgcttcatttgttgtcagagaaataaaaagtacaaaaaggtatattacaaatattagataaatatacaatcatagaaaaggggggaaaagccttttcagaagtatttttggagttgaaactgttctatctcctattttaactgagataacaatttcactaatataaacaccagagttattacctatttttcatttgctaatttagttaccaacattagacttgaataaacagtatggtataatatatactataatttcaattgtaaggtaaatattagctctaagtcacttctgaaggtttcctatgtagatagtgttggcttacacttacaataaacatacaaattatcataggccctaccctctagtaacttaaatatattaacatagggttaaaaaatacagtatgagagtcaaactatgacaaaattcttgaatttaatttggaagtttaaatttatatggaaatgagaactgtttgatatcttctgttaaatgccattttgagtgttaaatattaaatggtataaagtatgcaacagactaatgagaaatgctaacatttaggttaactcatttcaaaactgagttcagattttcttttttaaggtaatgagatctggcctttatttccaaatcctatcataatatctggaatcacttcagaagcagacaatggcaacacatgaaactccacatgtaatatgtgtataataattgtgactctaattctataatctgtctcactttaagttcaattcaattaaaaatggttcctgaagaaactgacagagcaacatacttacaattcaatttctttgcagagacgcacgggaagggtgaattgcatgagaccttgccactcttctgaagtacaaatgctatggtaggacagcttttccatcgttacccggtaaatgcactctgagtggcgaattctatgatacatctagaaggcaaatccaaaaaaaaaacccccaaaattaaaagaatatttaaactgttttgtcacggaagttcagaatttggtattaaagaatcagaactagaattaaaaccaaagtggatttattattatccgtatttccatatgcactgggatgtgcagacatgactttgcagattcaaaagaaatgctttttttaaaaaatggtatctctgctttacaaatttttatcagacattatctctgggtgatgagattacttggcatttgtcttccttaaaatgctctgtatttccgcatttttaaataaaaattaaacacattttattatcagaaaatgaatatttgtacttttaaagatcatcgtaagatctaaggtatttctcaatctgttacaacaaaacctttaattattgcatttcacctgcacatcaaattcatcttccttgggaaggttttatcatcattaccttctctggtttttagtcttgactgtatattgttactgttcttaacaggactgaatttggggtgttattggtgttccagcaatgaactcaaatgagtaacacaggtttgcattcgtcagtcatagactgtgtctacagagtaagtatataaattggtaattacattaatcgaaaatggataggtacattttgccatcctgttaagttgaaatcttgtgtatctgtatctgtgtgcaaatgttttacaaataattataaattaatatgtgagataaaacaaaaacatgcagtggagccaaaggaatggatcaatatttatacttgtgaattattaaataggtgagattaattaggaactgtctaaagtaaattaatactgaaaacgtggtgacaagctagagtagcttttgtaacattttgcatttttaaaataacattttctaaaggatagttcaccatctataggtaagactatccagtctacataaaaatataaatgaaggctgggcaaggtcactcacccttgtaatcccagcacttttggacacccaggtaggtggatcatctgaggtcaggagttcaagaccagcctggccaacatggcaaaaccctgtctctactaaaaaatagaaaaatcagctgggtgcacgcctgtatctcagctacttgggaggctgagacaggagaatcgcttgaacctgggaggtagtgattgcagtgagccaagatggcgccattgcactctagcctgggcgacaacggtgaaactccatctcaaaaaaaaaaaaaaaaaaaaagaatgaagctaaatgggtcaagagtaaagatactttctttatttcacaatttaaaaatatttagcttccttcttggtgatctcaaagtcctcttggtctagaggttactaaaatgtttgattgtgaaaaccttatcagtaaacaaattgtggcaatgcaaacccaatgaatgaatacacagtaattatgtgcacacaaactgtgttcatgtattatttacatacatagaaatcagaaacattaaaattaagtgggtatatttttaaatattttacttactaaataagtctttgttcttactaaaaaattacatatttttaaatgaaagtactatatttaaatgttattaatcatcaaatgctttatttaatacttttggagataatgatctaagggatggttcactttaatttatttcagtatttagattttcagttatactgtttgagaaacatattccttaagaagtatgtcgatccaaatggaataaagtttgtattggctgtggctaatgcctgtaatcccagcactttgggaggcagaggcaggcagcaagactaggctggccaacatggcgaaaccctgtctctactaaaaacacagaaaaattagccaggcacggtggcacacacctgtaatcctagctactggggaggctgaggcatgagaatcatttgaaccagggaggcaagaggtggaggtttcagtgagcaaagattgcactactacacttcagcctgggcgatagagcaagactctctctctctctctctctcaaaaaaaaaaaaaaggttgtattggctgttcttaaacattacacttatatttttgtttcctaactactaatatgtttggttgaaattcaaatgcatttcctttgttctttatgtcaatcagttgaccctgcaaactaatcagccacatttttatatattaccaatatgggttcaaaatcaatgaaaactctttgtggagaagatttctatcagttaaaacctgcttcatataacaaaatcattaaaattcaattttaaaggtagagagaaaaaaagggggaataaagaacagattaaacacatagaaaacaaatggcaagatggtagatttacacctaaacgtaaaatgtgaatggtctaaacatcatgactagaagtcaaagactgtcagattgaataaaaaagtatcagccaactatatactgcttacaagaattctactcgaactataaagacatagagtaaaattaaaatgatggaaaagatatactgtttaataccagtcaaaagaaagttacgactttattaataataacaggctaggttgatttcagaacaaagattattactagaaataaagaaaatcatttcaaataacaaaagggtcaggtcatcacaaggatataacaaccctaagtattacactacctaataagatagttttggtatacatgaagcaaacaacgacagaactgcaaataaaatagacaaatagaaaaatccacaattatagttagagatttcacaccaccctttcaactgaactactcatacatcaacccaatcaaaatcccagtaggcttttctataggaaattaaaagctgattctataatttatatggaaattcaaaggacctagaatagccaaaataactctgaaaacaaagaataaaggtaaagaaattatactgcccaaatccaatacttattataaaggtttttttattatactttaagttttagggtacatgtgcacaacgtgcaggtttgttacatatgtatacatgtgccatgttggtgtgctgcacccatcaacccgtcatttaacattaggtatatctcctaatgctatccctcccccctccccacaacaggccccagtgtgtgatgttccccttcctgtgtccatgtgttctcattgttcaattcccacctatgagtgagaacatgtggtgtttggttttctgtccttgcgatagtttgcggagaatgatggtttccagcttcatccatgtccctacaaaggacatgaactcatcattttttatggctgcatagtattccatggtgtatatgtgccacattttcttaatctagtctatcactgttggacatgtggcttggttccaagtctctgctattgttaatagtgccgcaataaacatacatgtgcatgtgtctttatagcagcatgatttataatcctttgggtatatacccagtaatgggattgttaaagcagtgtggtagtggcatcaaggggcacaaacggatcagtggaactaaatacagaaataggaccacacagacggtcagctgattttcagcaaggctgcaaaggcgaggccataaggaaaggatagtcgattcagcaagtggtgctgcaacaaccaaatatccaagagcaatatataaacaaataaataaaaactttgacccttaccttgtaccatatacaaatatttacttaaaatgaatatagacttaactatagaacctaaaactataaaacttctagaaaaaaaaaacagaggagaaatgtcttaacgaccttaggttaggcaagtatttcttcaatacaatgttaaacatcataataaaaggataaattgatcaactggacttcttcagagtttaaaacttttgctcttagaaagaaaccattaagagaatgaaaagacaagccaaagactgcgagcaaatatttacaaataatctatctgataaatgaaaatgacctgtatccagaatatataaagagctactaaaaatcaataagaaaacaaaccaccacaaacaaaagatggacaaaagatgtgaaaagacacttcaccaaagatggtgtacagatgacaaatgtagaagaactggaacacatgctgtgatttatggaatgtaaaagagtacagtcactttggtaaacagtttggcagtctcttaaacagttacagacccctcccatgttacccaccactgcacacataaatctttacccaagcgagatgaaagtctatggccacttaaaggcttgtacacagaccaactgtttgtttgtagctttagtgtaatagccaaaaactggaaatcactcaaaaatctatcaacaagtaaataaattagttatggtatatccatacaataaactactactaagtaataaagaggaattaactgtttacgtacacaacaccagcaatgaatcacaaaattatgttaagtgaaaaaagccaaataatacagattatataattccctttatacaaaagaattttagaaactgcaatttatagtgacagaaagcaaatcaatggtcacctgaagatgagaagggtcaaaagaaagggattactaaggctatatttattatactgattatgttgatggtttcatgggtatgtgtgtatactaagttgtacactttaaacagttgtacgttattgtgtatcaataaacctcagtgaaactattttaaaagtttctgctctgtctttttaagggtatagatgtcataatttgtatacatgacatataaatttcagcaaaaaagtcacgtgacaatgaaaatactggcaaagatctgttttcaaagtgctctcttcacagcatgaatttctttggaaaccaattattttttcattcagtgttaatgtcactggcaacttgagggttcagattaaatgttatttctctgaatatatcttctaaatactttcatttgtcattagaagaagttagcaaatttggaatctttgtctttttgtgaaagaagcatgtatacctaatttattaactgaacaactgtaccaagcattttgctgcaaacggcaaatctgtgggtagcacaaacgaaaacgcatgaacattctgaaatcatcttcataaccgtgattttttttctaactgataaaataatcttccttagtaaagttgagaaagagcacagataggtttagaagcataggctggacactgctgtcaccttttcctagctgcgcaaggcccactctgtgagaggagactgcttcctggacaagacatgaccttctagtgcatgaactttctgaaagctccatccatgtattaacaatcaataaaaaattatttaatatcatttacccaaaaacatatcaagacccaagttttcacattgtcctcatataccttaatggaatgtcacttgctttccactttagagatgatagcgtagattctgctaggaaagtgaacaatccacaggatttactcagtatttactgtaaattggtattacctgtaatacagtgcaattctatggtaaagatgttagtaagagtaactatactaggcagtaaactaactgctactatagtcactaattctattgagcacttgcgccaggaagtatgctaagtgttttgtatgcattacttcatgtctcacaaaacttctacaagatagttattccttttattgtcattttatatgtttatgacctaaaattagaataaattttatttctattatttttacaatttttgatattaatatattgaaaatacgtaaaaatttaaattaaaatttttagtcatttatttttatatttgtaatcagtgtaggtaaataacactaattacaaaataaaattaattaaaatcacagcacaaaataattagttttagaaaatttatattacttcccattttctaaatgacctttaatatgaatagtagaaaataatataatctaggattattagtagatgattttatcatactcatgcaaactactgatgaaggtagaaaactatgttgtctttttaggtgcattttgtataaattatttgcctataacactgcgtaaataatcttggagtcactgtccaagtagaagagaattctagcagaaaaaactgctgtttgtctaaaactgaaatatattttgatggcctatcagtcttaggcacgaggatattgaaaaggtatatgtgctcaaaaaacaaaacgataaagacaacctggaaacaggactgtaagagcatgtctaccacacattaaaaatacatccattcacattttataaaatggcattcctactcaactggcatacaaaaatatttaattagtgattatttagaatgttgttattggggcctatttacacaataaccctcattacacttagaaatgactgtgtctatgagacaccctaatatttgtaattaatgttcatagtaaacctagagtcactttagggtcgggcaactcttagaaatctaaactctggaatcatctacttggaacaaatctcttgtccatcatttactaattgtatacatttaggcaaatcacttaattctctgttccccaggatctcatctgtagcctaaggacactgtagtacttagccaagaatgtaacgttcaatggaataacacggggaaaggctaaggaaaagcactggccagtgactgtgaagctctcagcgctatcagcaaccgttatcttagatgggtatcagcactgtgttgccacatcatttggctcttttgtttgattttggtgataatcaacaagagagtctacttttctgttgtggcagtggtgcaccgaactggcttgcaagagccaattatgcacatttcttcccaactctgcattcattatggcgcatgggtagcttgaaattgtccatattgagggaatgtacgccagagaaacagggaaacacacaaatcaggacccttctgtttttagagaggttgctgttaaacatttactgcacaccaactggtattctttaagatacaagtagtttgactttgggaacacttgagatataataattgttctactattataaattgtgcactcttttcccctatttaatttacatttaaaatcgaattgacaaaatacttattaaactacatattttctatatgtttgtcaatagcattaaataatatcattagtcaaattaaattgattctctaagcaagtcctaaaatcaaatacatactccacatacatacggggaacactgaataagagacctgtaaccacccttctactctacactgtcatgagatctactttttagctcccataagtgagtcagacgtgtgatatttgcctttttgtgcctggataattttatttaacctaacgaccttcagtttcatccatgctgctgcaagttacgcgatttcattcctttttacggctgaataatgttccattgtgtataatgttggttaaggggtacaaaaatacagttggataaaaggaatatgttctattgtttgatagtacactaggaaaattacacttaataatttattgtgtatttcaaaatagctagaagattcataatggtctcaaaacaaagaaaatataaatatctgaggtgacagatacctcagtcacaccgatatgattaccacagtcacaggtatccaactattctacatactcccaaaatatgtacaactattataaatcaataaaaaggaaatgctgtgctgtttatttcatagcatagagcagtgctgcagccgactaaagaaataacagacccatcgcagggtgtggcttgaggctcccggatgtgaagggaaggtccatgcaggatgagacttccctgtggctgcatgaggagaggagctgaactgagaactccataagcaaaaaagaagccttgtctctacttggggctatgggtagaaaataaatagtctccatccattgagaatatggaaatcaagcctgaaccatatgtagttgtagtttccaaatttatcctaacatattgcaggaatttcaagctaaaaacttaacagaaacaaaaacctggacccagatcactgaaagcctggggcacatggaaaacattacatatatctgagcatgagggtctctcacaagggagataatttgagagaaatttgagtaggtaaacaagtaaacgatgacctgaaaaaaaatctaagaatggaaagatgaatagatattagtaccctctacaaattgagctaatgaaaaacacttactgagagatttaaaatacactgttgcaaaaatacagcatttggtatgtgacttaccatgcttgcacaactattctagtttatggaaaccacagtaccaaaatgcaaaaacaaaacaaaacaaaacaaaaaccacaaggatttctttctgtttctttctcagtagagttgtatctttgacctaatcgtgggtggaagtatttaaaacactttcttaaagacaggcccaagcacctactgtctatggcaccatagagagttctttcatgctgaggactgcaaaggtgacaatagtttcctctaacgtgtttcagtggatttgaaagcactgggaacaaattaaaaaaaaaatgtgtgtgtattatgttcctgtgaaataagagacagctgaattcaggagaaagtaggggcattggaaaaatgactctctagctgtgtgccccaaatgcacctcagcgtatagaagacaactggtgtcctaaggtaggaatactgacttctctcttcctctgtaagctcagaagttccatcttagggcagacataaaaggtacctctataggctcttccttgctattttccagtaaataaatgaagcaaatcaaattttaatgaaaagcaacttggcctgtggaaacaacaaaccagctatatatttaacaatgaattgaaattttataaaattggctgcaatgataattcataaaatataatgactaatgtgaaaacaaaggatgcaacactgactgtctactatggactatgcactgttctaagagtttattcatatggactacgcactgttctaagactttattcacatatctcattttgtcctgacaataatcctggggaataagtattgtttccgtttatctgttgagggaactaaggctcaagaacataagctgacttccccaaggtcagaatgttggaaagtaatagatcaggttgtaaaatgcatgtctgcttgattttaagttttgaatcctactacacacacattgagaactcaaaaagtagggaaagaatgatttggaagggtggagggcctagtgtcatagctgaaggagagctgcatctactgcagagcaggcgcttttggaaatgatacctttaaggtcaaataaaactggaaaattgtcctgtagtctgtgccaaggaatatttcaaatatataaacacaggacatgaaaccacctaggatgtagggtccattaattcttaatctgtacctagcatctaggagtgattaatgcttatgtgtggaacgaacaaatgtccatgtcagttataaattttataaccttataaccaaaagaagaaaaaaaaagactgaactcggctgaaattagttatctataaacttgtagacttggagaagtattaaacttttattttcatgtaaccccaaaaataattcagtttaagaattgttattcattagtatctaagagtattcaaattcaagatgagggaaaaggatgtgtgtgtgtgtgtgtgtgtgtgtgtgtgtgtttctgtgtgtgatcatgtcaccactaacaggagatagttgaattttaggagataactttgtgactcaatgcactggtataagatgtatttttgatatttcttagaaaacttttcttgggaatatacaatactcttaaggcaatagttcatcatctataattacaaatttaatttacataattctccttggaagtatgtcccaagtgttaaactttctgttaatcgattccaaactctttcatgaaccctatccttgctctaccatctatattactttatcgatgaagttttgggtttttttcctaaactttcccccttcatttctgacaaaattaacctcaccgtctttgatggttaattctaagtgtcaacttgactgggttagaggatgctcggatagcaggtagagcatgatttctgggtgtttcagtgagggtatttctgggagactggtactggaatcagtgcactgagtagggaagacctgcccttatccaatgcagtagggcaccatgcaactggctgaggacccagacagaacagaaaggcaaagggaaggcaaagtgtctctctgttctaaagctgggacacctaccctgtccttgaacatcagatctccaggatctctggcctttggagtttaacttgcaccagctgcaccccagcttctcaagcctttggcctctgactcagggttacaccatcagcttccctggttgtgaggctttcagacttggactgagctatgctactggctttcctggttctccagcttgcagatggcctattgggggactttttagcttccataatcatatgaaccaatttccctcctaagtcctcgctcgtgtatctattcatctatatatgtatcctgttggttctgtttctctggagaaccctaatgcaccctaatccatattttatatataaaatgtaaaaacacttcgtagtaattgtcttccctgtaggcaaccttaggaccttagggaagaacgatgtcagagagaagccagcacacttagcgagcacggggaccagtctgcatgcattcaaaccctggctctatcacatacttgctatgtgcccttggggaaattatttaaattctatacatccattttttttcttataaaacgtggagataataataaccacactcatggtattgttgggagaacatacaaaaagagatttcgtatgtaaagtgtctagaacaattcctgtcacacaataaagccttatatcaaataagagttgttcttatcatagtcatctttatatccaccatctggtataaaaaagataggcaatacttggtggttgaattctggaacgaataaaggttcaaccacttattcaatttgtccctaaccaactaatttcattttaatagcaaattttgttcatgcccctttcatgttaaatgtctttctatccaaaatgtacagagctaatctgttttaaaagatttatttttctaagcaaaagatgtaactgatactactgtcctattagcttttctaaggcatattaaatggtttctttaaaatcacagtataaatgagtaaattaattgacttggatttaaaagatgttttctgttgatagtacttcccagtatgttagctcaataaatgaaagagagatgctgccaatcagagacgttcccctttaattaaataaaaggaatgtattcaagtatttctaaagatgaaataaaggaaaataaaaacataataagcattaacatggcctatgtgccctgcttcttagataggctcttaatcaaacaagaccacaataaaatatgccattacattatcatgttcagtattagaaacaagaattttcatgtacaaaacatgcttctattacggacacaataatttgttcaacagcagaaatactctgaattccccaagatcaacacaattaaaatgacaataacggtcaacaattaaaaagcacttcatgctgcacaaagatttttcatatttatgatcttgatcattactaatgtatgttctctagaaagtagaacattcaggaaaaggtagggaacccgcagatgtgattgtttgggacaacgcataatacaaggtgtttttcctaattttcatatgatgcttgggaaaaaaatgctcaaaacagcaaagcaaaattgctcaagaacaaccgcaagcatctcggtgccacagtgatgaccagaatttgggtcttggtcattggcagtagttcgtggcatcaaccttttcaagtgggtaaggttctagggatcccactataaagaaacgcgatgctatcttattgaaaccagcatacatttggagctattttcttttatttttttatttacatggatgctttcttcaacaaggcaaaaaatatcattgtaaagaagacatgtgaactggtctttctgaattggaacaaagttttgaaataaacccagccaccagtcttcatcagactggaaggccagggagaagagggaagaaggaatcattatgaagctgtggactcaaatctcttattccttttgagttggaaaaacttcaaaaataatataatttttatgagctttagtaaggagaaaaatatactgcagttaaaaaatggggcagggcgcggtggctcacacctataatcccagcactttgggaggccgaggcgggcggatcacgaggtcaggagatcgagaccaccctggctaacacggcgaaaccccatctctactaaaaatacaaaaaattagctgggtgtagtggcgggtgcctgtagtcccagctactcgggaggctgaggcaggagaatggcgtgaacctgggaggaggagcttgcaacaagccgagatggcaccactgcactccagcctgggcgacagggtgagactccatctcaaaaaaaaaaaaaaaaaagaaaaaaggtaataaattccacagagagcttgcagctgcactgaatatattttcaatgtataccttaaaggtaatcagctttggctgggcgaggtggctcacgcctgtaatcccagcactttgggaggccgaggcaggcggatcacctgacctcaggagttcgagaatagcctggccaacgtggtgaaaccccatctctactaaaaatacaaaaattagccagacatggtaacgcatgcctgtaatcccagctactggggagcctgaggctggagaatcgtttaaacgcgggaggcggaggttgcagtgagccaagatcacgtaattgcgctacagcctgggtgacaaagagtgaaactccatctcagaaagaaaaggtgtctacagccataccaccctgaacgcgcccgatctcgtctgatctcggaagctaagcagggtcgggcctggttagtacttggatgggagaaagaaaaggtaaccagctttggtccagtgcgggtgactactcgacagaactgctgctccatatactacttgtcactgttggagaaaaccactgttgtgatggggtttgaagtgtttagaaaaattataatcatttccaatatcaactaatactagttattttaccaaaattttaccctaaataatttaactaaataatcaatgtaaaaatggaatgcctattaaaacttttcagaagttttttttttttttttctgtgtggtttaatcatgattaaatccaggtattatgataccacaattagtgacttagaaaagcatttgaacctgctagtctagttcttaatttatgtattcttgaaagtatacaacaatatttcaagggatacatggacaaatgaataaattttaagatgatcaatttccatattcttaactttcacacatattcttactcaaaatgactttttcccacatcccattttgaaacagccctgttatcaaattgctgtaatacaaagcggcaatataaaatgctggtattaatgagggctaataaaggtttctgaaactttcctaaaatattaaaggtgaacttcagtaaattctcaactgatagctcattaaaataatttttggtgtcagaattatcagtactttttggcatcttagctcaggtagaattaagagaaattgtgataataaaactttattaatggaagcaattcttacagcttccttaaaaaataagagggacaagttggaataagattgatgctgaatagggagagccaaatttctcactgtaacaaaaaaagttccgaagatgaaaatgagatggctagagcattctgtggtattagactggaggttaggtatcgtagagacagaaagagacagacagaatgaacggacgtagagatttatgtataaactctcttctaaagaagtcagtgagaaagtgggggtaagttcctgtggagaaacctgcagacaggacctttcaagtgcagacggttaataggctcagtgacgaagcacatgcctgctaacaggatgcactgaggacacatccgcacgtgaactcattgtcacaaataagaccttcatataattgtgaggaaacaccagacaaatccaaattaagaaatatccttggccgggcgcggtggctcacgcctgtaatcccagcactttgggaggccgaggcgggcggatcacgaggtcaggagatcgagaccatcctggctaacacggtgaaaccccgtctctactaaaaatacaaaaaaatagccgggcgtggtggcggtgcctgtagtcccagctactcgggaggctgaggcaggagaatggcgtgaacccgggaggcggagcttgcagtgagccgagacagcgccactgccctccagcctgggcaacagagcgagactccgcctcaaaaaaaaaaaaaaaaaaaaaaagaaatatccttaaaaaacaacaggtgtatacgctttaaaaatacccaggtcatgagagacaacactaaggaatagttccagatgaaaggagactcaagaggtctgcagatgagataacaacacagtacttgtgatgggttagattgtggcccccttaaaattcatgtattaaagcctaagccccagtaccttagaatgcagctgtatttagagatagggcctttaaagaggtaactatggtaagaggagatttaaagcgtgggtcctaatctcatatgactagtgtcttcataagaagagtctaggacacaggcatgtacacagagacagcagaaaccatgtgaggacacagggagaaggcggccatctgcaaaccaaggaaaacaggcttcaggagaaacacaccttgatcttggacttccagcctccaaaactgtgagaaaaaaatttcctgttgtttaagccacacagtctgtgatgtttattacagtggccctagcaagctaatacagtaccaatgttaatttcttgatttttaaattatgcagtgaaaaaataagataatgtccttgtttttagagaaaatacaaactgaatcatttaggagttatgagacattacatctgaaacatactctcatatagattggagaaagatagtatctatttaacagagaaagagagagacagagaaagtatatcaaagcaaaaatggcaaatatattaacatttggggaatatggataaaggtatacagggaactttatttttgcaacttttgcttttgtctgaaattatttcaaaatgaaaagtataaaaattatgctaaatctagtttcatttaacagtaagaaaaattcacgaacagttatattaactattgctgttttaagccataggtatctaagaaaaaagttttcaattttttttttattttttgacatctatcaaaatgttataatagttgacttgatcacatatgtgataatactaataccaccacaatccaaaatgaattttaacacttattatacatgttttagacatacccatgtattatcttataaatagaaattatcttagggtaattaataaaataaagcataaaatatattcaacttttgttggataacaaatacatattcagagagtaaacataatgccaaattttcccatcctaagatcttgctattgtgttttttaatatattataatatgtatcaagcttctatgatacttaaattccattggctacatttaaaaatgataaaacagtcaatattcagaataaactagaaattacaatctttgcgacttttaaactaaatgagacaagcataagctgtcaacattatttatgagagacacatagatactaaaaatgtttgaagcaaaagtgtttgacagcattcctagtttatttctgaggagctatgtaacagaaactgtcccccaaaagggcaccaggaatgcgtgaggagagaggacgggtactctcactaaatagcacaaactgaattaaaaacggttaccctcggtcaccagaagttaagttttaccaatgcttgtccctaggtatgtctccgcttgtcctatgagttacacggttactcctatggaatccagtcctactcccaaaaaagcagtttctctaattgattaagggggcaactgaatgtatgttgatttagctctatgaaaagatcaccatactaaaattttccctaacctcagaattctagtaatattattaaaggattactagagtttacagaatactaaatgttccattcatctaaaatataacaatgtaaaagacagacaataaattccactatttttaaagtgagacttgagaatgcacattgaacttcattttacccttcagtgaacacggtacaactttcacgaggactgagttaacaccgagaatgcatgtgacatggacaacctggtgcctcactttttgtcacaaacagaactttcctggtgggtgtccaaacatgagctatgactatacttttgtgtaaggatctcaaatgaatgcatttgacaaacagtcaaggtttaggtagcattttctttcttcatttcagtagataccattaaatataagactgatgcctggacatgttacctttacagtaacttcatttttcttcttaacaaattcccaccttgaaataaacgcaaactattaggagactgttatttttccttccagggcattttatgacattttctaaaacatgtacaatcaggaatcacttacttttcctggtttgtaaaggaaatataaatgaaaaaaaaaaagcccttaagctgctttatgaaaaagattccaaattaatattgagtagtaaaaaatggtatttaataaatagtacttacattagcacagtgtaaggctaaagcacaaaagacggcaaacattttgaagttgttttcatctgttttagagaaggcactgccactgattttgttgaccatctgcaccacacctatcacgctgcctcggctgacgatgggcatgcacaggatgttccgcgtggtgtagcctgtgtacaagtctacttctctgtggggtgacagaaccaaaaataacaacaacaacaaaagggcagaagaaataaaggacacagtcagtcataaatctcccctcaatctttgcaatttacatatgcttctattgcatatgactaatggcacttttagcttctacattcagggacagtaacattccacagagttttattaaaacctttccaaaaatattctaatctgttggttcttttgtctccaagtgagttttctaggatagtctctaagaggctttcagcttatcatttgaagtatccagcattactaagtaaacagaccaaaaaaaaacgtggattcagaggagaaatacaattaaatttggtaaaataacataatcctttgaagttgatcgtgtttatgagagatataacttgctaaaccaacttatagtgtttccactttaaaaacttagagcagtggtcagcaaaccgcacccaggggccaaatcagccctctcctgtttataagtaaagttgtattggaacacagccacaccattcattcacatattgtctgattctgccatcaccccacaaggctgagctgtggacttgtgacaaggacattagtgcttataaatgcaaatatactgaccatatgatccttaatagaaaaggcttgctgactcctattgtgaggacatgtttttggaaaacaggactaaggtgcatagaaacagtgacatagctaacggtaggtagttacatgggagtcttcagagcctggcttctctcatttagcataaaggtttttgagattcatccatgttgttgcatgtcttagtggttaagtcctttttattgctgagttatacctctattgaatggacatatcgtattttgttcattcattcccagttaatggacaatattatttttaatagccagtttgggcaattataaataattctgctttgaaggtttgcatacaagtcctactgtagcaccatatgttttcattttgcttgtagtactatctagaagcggagctgattagtggactgcacagtaagtgtatgtttaacttttcaagaaactgcaaacctgttttcccaagcggttgtaccatttcatattcccaccaacaatgtatgagggtactcgtttctccacatcctggccaatgtttgctaatgccaatgttttaaagtcccagccattcaagctgctgtacagtgaggtctcatgtcaactacatctatattcccctcacttcgagcatttttcatgtgtttggtgatcagttgtatatctccttttgtggactgtctgttaaaatcacctgccctttgtattaaattgggttatcttctcattgttatgctggaagagtttttatatattagatataagtattttgtcagatacatgttttacaaatattttctcctaatctggtgcttgcattttcattttcttaatagtctgactcatacatttttacataaagattggacataaggatgagcaaatatatttaatttttaagtactaaatgatgagtttggacttttggaaaaaaactttcagtgtacccttaatttattgacaatatacattactagaatattcctatgtttttataggagttgtgtatatttgacatcaattgatcaaataactgaataaacttcctattgcttatgttatttgtctcttaaagtaaaccacgagttggaattaactaaacactgctgtcaaactactgtaaatattattctctaacagtcacagcatcaatcctgagactttccatttctagcgatttattaaaatcaaattacataattgggtttgcaactctccaaagaaagtcaaaacaaaacaaaaaatctttataagccttcctaatatccatctttaataatatccaataaaagatgtaacttatttagttactttgggtcaggtaaattttccagacctttcatgaatattatctgtgatcttaaaacaacagcaacaaaattggcattatcatactcatcttaaagatgaggaaactgaggctcagagagattaagtaacttatgctaggtcagttgagagctaagaaatgacagaaccgtgcttcaaagctagacctactcatctcaaaagcatgcaaatttcttactatgtgttgcagcctttgagcatatgatttgacggagaacatgtttgttacaaaatcatgacactataatggaaaaaaaatcccacagtagctctataaattaaaactaccgcctatcagttgtttttataacattctaaactcctgtatctagatatcatgatacattagtggattagaatccatcattttataaatatctgaatatactgactattgatagcagagttggttcagagaagaaaactaaggaagaaagaactgaattgggacgtggagaactcaggctccacggaagaggtttcagctgagtgggacatcacagaagaaatcaatggagtgtcgacatcagctatttcttacctgttaaagcgtgggtctgcataggcatctggaatgttcaggacttcccctgttcttgctacttggccagcaattcctttctcaattgaaaatctgcatatgtaaaagagaaggacatgctaattaaaatatggactctgtagaataattcaaaaatattccattgttaataatattgaattaaaagcactgttttacttaaatgcgtgtattacttttacgtttacatattctaaatcaccttatgaagtacgtaaaaataaagcagaaaaccattacacagtaatcacctgagaaccttaaaatattaactcacaaactgagatcaaacaatcaactagtatcctcctgctctgaacaataataatcccttctatttgcgaagcaccttataatttacaagacgcttcaacataaatttttttagtggattctcaatgaggtgtgaacgaaggcctatatgggttcagtaatttgccaacattcataaaatatcagtggcacaaggaacactagaatgctggtctctaccatcgtgctttctaccacacatataaccaaactcacaggttacacgtgagcttgagatattatacagaactgaattttatggtgtttgcaattcaagcactatacagaaataacgcaatgtacaacttctagtatttttacctaatttgttaaattttaaaataatcaaaatacaaggattgtctgttttttatatctaatatcagtatttttcctttgcaaaaatattttcatacttatatttttctcattactataccatcatcacacaggcactcatttcaaaacttccttaattaacaaagatgtctacaagtcacaatatctacattttacatagttcaaaaataatttccatattattacattgtcaacattataggaaatcaccattattgaaataaagctagaggactatcagaaaaactcaaaagatagttcacacaaaagagaatctacttaaaacaccaaagagtgaaccaaacactgcataaaactcatggttgtctttttcctggttttcttgtgctttgaacaacataaacacaatgaattagattgccatgagcaaagggtatcagaatccatttgatgatttatgcttctttgcgttggtctgagagcagtctgaactataacttttgttcatgctctctgtggtttgctatctgtggtcaatggaagccataattaagaagccgcccttacataaatggctgccattaaccagtcatctgagagttacagtaaatcacactctgtttttcttacgcttataaacacaggctttaaagttgttattttcaaaattaaatcaatgccaacagtgttaggaaacactcaaatcttcagcaagagaaatgacttatctaaatgactatatccagatgctatactgaggtctaacagcaacaacaaaaaaaaccaacaacaaacagacaaaaaaattttaaaacccaagtaccaatatagtgcctataaatcagagttaatggacatggaatacacaggaagcgctgaggggcagacagtggtggggccccacggtgaggcacaccttgagtttccctgacatcagtctccttttatgatagaacgcccaaataaacagcaatccttaattaagaagacacagtgttttgccagaatggtgttattaccagagaactttacggtgttatacagaagatgagttaaacgagacacatacagcaaaagaaatgcaaatgtctaaaattattttctcagcttctgaatgttaagctcgattcttaaacgttttgtcagagtgctccttgtgtaggtttccaggtgcgatatgagcaagcccccatgcctccatcaacaaaataaactccattctgttcatttaagtgacaacggctgccacttaaaaaaacaaagacttcagtttcaagatgcaacacaggtgtgctatgtgattgattaaaacagctggtcagtcacagagtgtatttaagtcatcaaatataccagatcaatttctactactgtctggactgcgagacaggccaccggttgggaagaagtaggggccgaattgcataagcacaccttttctcttggacatgggaaaacctgcagattccaggtggagtgtacctttacctacctgggagcactagaaagtttttccaacatgatttccaaaaggaccgcctccggaagacggcatttccaggagtgacgctaaggcttcctaggcgcggtttctcgggcactgcctgcaatgtcattcccagaagtactaccttcaggaggcgggtcctggtgggaatgatatcacagtatgacaagtattgtcagcatacctgtgaataggcacagaaaaatgggtaacggaacgcctgcacatctaccgtaagaggataggacattctacttctagctgtaccttatctctttggtcttcttgaagacaggttttccttccttttcctctccaatatcaaaaaggtctgaatataactccttgttcttatggtccacctggaaaagcgcacaacgatcggcattcaccaggttttttgcatatatctaaagacaaatgacaaaataagaggaagacaatgagacattcaaagaacttgcaggtaaactttatcataaaataagtattaatttcagctgtcctatactctaattggttggtattagcattataagtaaataaatatacaagtatataaatatttcatatatatgatataaaagtcactgttacatgctaatactaacagatcccaacagaatacacagcggatatgcatccatactgctgtgctggagggaagcatatcagtcgtgtattctgacaccaactgacacttctgttttagttggtaagcagctgctggcctaacttcccagtgcccttctgccatccaaggccctcttccagaacctctcaggccttccctggtgcctagatctgagcctctgtcagcactacgaccaccactcattctgattagttgaagtctgtgatgcagcaggtgtaaaagctatgaaatataacctctaaggagatacatggctttcatatttgcattagctgagttttatttgatgtactgtctaataaaaatttgtacagattattaagtgtttactatgtgccaggaacatttatacaatttatatgaattgatttgcctgctcctcacaataacaatattaacgcaggaaaatcttttcccattgtacgtattaggaaaattgaggcactgagaagtaacttgccccattattacatgaatagtaaatggtagcagtatttgaactgatactagctgttcccatggcccatgcttttataacaaatatgcttttccatttctaaatggaaaccatgtattcatttcattactcatttgttcttccatttccttcaacaaatatgtcttcaatgcctaacatatcctactgtcctgagtgggttggggctacagctgcaccattaatacagtatttacctctattgagaattctggtaacttcaactatccagatcatagccatgaaattattcctcggagaaaaagaattcatccttacagtaaaacagccatcacaaagtctctgcaagaggaaccttgcagccagggcaaaatatagcatctcatataaaatgtatagatttaatagaaataagtctaagttaggtaactgtcttcatcctattacacgtttgtgctcactactactatagaactattacactattacatgtttgtactcactgctactatacaccaaacaaatactggctgtgcccactacgcagggactgagtatactgcctagtatcaggacctctaggttacttctcacctcccttagcctgtgagctacagaaacagcagaaaccacttctcttttcccacagtattccaaatgctcagaacaaggctgagttagggccagcgaaattttgtggtccaaaccctgctccctgcttgttaatgtaaataacatttttattgggacatagccgcgttcattcatttctttatttttatggctgctacaacagcagagttgagtagctgcaagagagtatggcccacaaagcataacaatttactatctggccctttacaaaaaaaagtttgccaacaaacccctggcttagaacatataggatctccataacccaaaactctcaataaatatttgaggaaaaatgaatgacataaaggcacagcgagagtgatggggctgagtcgttggcaaatacagaagaatcactcatctaattcacaaacccatgagattttaaattattaagtaacaagaatgatcctgcattattaaacattaaattatattcagtgaaatctgtatctgcagtgtttgaggtaatgtcagttgcttaatattttggcataaatatgttaatatttgtttaaaatctggatcaaatggacaatgtttcagaaaataaaataagcttagaaagtgctgaaaaatataaatccaaccagaatcataaagataattcaaaaactatcaaaaaatattagcaaaaaaggcaccagcctaaaatggcttcaaatattaattctttaaaaatcttcaacaaattcccgtacaatttatactgatctacattcagaaaagaacaattttttccagttgtttttacaatgtatgctgcgtcactgatactgaaaactgacaaagaaactataaaaaagaaaatcacagatttacttttgaaacagaagaaaagttataaataaaaattcaacccaatcaaatttagcaataattaaacaaatatgacaatattaaaaacagagtttattctgaactgtccagtagcataaagtctattatcataattcataatagcaataagacaaaggagaaaaatctgcgagattatcgtcatggttgtcaaaaagcatatgatgagcctgggtgtggtggctcatgcctgtaatcccagcactttgggagactgagatgggcagatctcttgagcccaggagtttgagaccagcctaggcaacatggcgagaccccttctctacaaaacaatataaaaattagtcaggcatggcagcatgcatctgaagtcccaaacactcaggaggctgaggtgggaggatttcataagcccaggaggcaaaggctgcagtgagccatgactgagccactgtattccagcctgggcgacagagcaagaccccgtctcaaaaacaaaaacatgtgatgccattcagcaatcattaatgataaaaactttagtaaaatggaataaaagaatatatagaaaacgtaataatgttttcctcaaaacaacagtccatattataccaaacggtaaaataacaaaatcgctgccttaagatattaaagttaagaacaagacaaaggtatgttatcacaatcattagcatgctagtaggcaagaagaacatgtgaggtatacatatttgaagagataaaatttttcttgtttgaggataatgttatttcatatgtcaaaaaaatcaactgacaaacaattataggcagtaagagggcttctgtggctgggtgcaggggctcacgctgtacttccagcaccttgggaggccaagccccttggactgcttgagctcaggagtttgagaccagcttgggcaacatggcaaaaccctgtctctactaaaaatacaaaaattagctgcgcatggtggcatgcgtctgttgtcccagctacttttggaaggctgaggtaggaggatggcttgagccagggaggcagaggttgcagtgagcagagattgtgccactgcactccagccagggtgacagtgccagaccctgtctaaagaaagaaaaagaggcttctgttttaagatgagcatttctaaacatatgttcaccttttcactctccccaaatattaatgtttaactttgaaatgaccctcagatgctgaaaaggagttaaaaatatctaaaattttggtaatatttataaagtccaaacatcaggtcaatctaaaagccacccctactcccttatacacacacatacgcatacacacacacgcatacacacatacgcatacacacatacgcatatacacacacaggcatacacacacacatatgcatacacacatacgcatatacacacacaggcatacacacacgcatacacacatacgcatacacacatatgcatacacacatacgcatacacacatacgcatatacacacacaggcatacacacatacgcatacacacctatgcatacgtttacctataagtgaaacaacactctttatagcaacagtagattttaaattcagttaaaatgtatcttcaaatttctaaggaaaacttactttaagcctaaatgtatttaccaagtcaaactagcataaaggaaaataaagatatttaagaagggtacagtactcagaaatgtactatctttgaactattttagaaaaggagatgggctcaagcaaaaatgaagaaatagataaattcaaggacacatgggaagactcggggttcaagaaaaagtgaggagcaaagaaatcattaaaactatactaaaactgtaacacttgttagtaaatgatatctaagaaattacaggcatcatcatgaaaaattaatttaagaaacatgaaatatataaaaatatttatatatctaaaactatgtaagggtagtaggtaagaagagtaaaaaaaattaggaaacaaatgtgcttcatttattatcttgttggtgaagtgagtgatatgatataaacactgattatttattgattttgatataaaacttcattttaaacataagacgacagctgtcagggctattgctgccatcatgtaaagagaaattgcttgagactaaggactacacaaaagtaagttgaactgagaaacagagaaagacatattcatgaaaagattatttgagcccccatgtccgctaattatataagcctgaacattcaatggcttttcagcagtctgagccagtaaatcctctcttttattatctcacactaatttgagttaagtagttgatgttttcagatcagaaaggaaatataaagtacctacaaatttataaaaattgatttgaaaatctaattcattgattcccaaccagcagctgagccacctggccgcagggcgtctggaaatgagtgcaggtatgtttgttggttacgagttctcacaagctaaagacgctgcaggtctgcggtgcccaggataacactgtgccagagggaactgctctgcctaaatgtcagcatcaacctattgagaagcactgacctagatgaactgatcacctagtaatttaagaattacccagattaggccgggcgcggtggctgacgcctgtaatcccaacactttgggaggctgaggtgggtggatcacgaggtcaagagattgagaccatcctggccaacatggtgaaaccccgtttctactaaaatacaaaaattaagcaggtgtggtggcgcgtgcctgtagtcccagctactcgggaggctgaggcaggagaatggcagaggtagcagtgagccgagatcatgccactgtactccagcctcctgacagagcgagactatgtctcaggaaaaaaaaaaaaaattacccagatttgcttgtctgaaaataataaatcttccgtattataaaaaagatcctcaaaaaagtctaacctcattccccacttgtttcctctaatccagggttatcttttcaaaacacatatctgatcttgcacctctagcttacaagccttaattaaaaactccctcccaggcctgggtgacttggcccttccaggacctttctacacaggagcacactgttcccccatcccccaaagtagaaccctctttcctctttgcctgtgtaacttccacacatccaccagaccaaagtcacagcatcaggaaagcttgccacagcctccccagctacgttagatcccatcacaagctttcagggcactgttatgctccttaataggcctgactctgactagtttcatagttatgttgatatttggctcatgtctgtctccccacagattagaacctcaatgaggacagaggctgtgaagggttttgctcaccatttgataactccagttactatgtattataggaatataacagattcccaagaaacattataaaagaaaagggtgaatgaaaacttgaaggatccaatgtcatagaagaaattgaaaagagaatcagagatctaccccaataagactctaatggggtcttagctgatttatatcaaacatcaggtgaacaaataatatgtacattatttaaaccactttagtccatagaaaagaatggaacatttctgagctcattttataagtgtagcataacccaataccagtactatccaaagatagaaaaaaagaaccattgagcaatccgatgtatgaatatagatgcaaacttggaaataaatattaacaaccaatccaggaataaagaaaatattacaattaaatagcctttataccaggaatgtaagagtggttcaacattgagtaataatacaattgtctactccaatcattttgaaatagcttataaaaatttgataatacccaacaccaaatcagatgcaaactcacagaaaattaggaatagaaggaaatgttttaaaattgataaattatatctgttgtggacccacaacaaatatacatagcaatgaaatgtgagaagtacacacatcaaggaaaataaatatattctcctgttgatatctgttgtttccattcaacagtgttcattaggttccagctaatacattaacaaacacaaagaaataagtactgtaaaaactggaaaagaagaaccactagaatctctactattgtgcattataaatcactatcttgaaaactaaagactataaactggaaaaataagttaactatgggggaccataatcaatacattcagtcaacaattttttaaaaaaaactgaaaataagaaaatgtctttggctaggaagacgccatatgctgaagatatcaattcaagttttctataaatttaggacaattccaatataaattacacaccataatgaactgagattcatcacaggagtgcaaggttactttaacatccaagaatcaattgatgtaatatacactatcaatagaattcaaaataaaaaccatatgatcatctacactgatgcacaaaaattgacaaactgtaacatacctgcatgataaaaacacgcaataaagtaggaaaaaagggaatttcctcaacctgataaaggccctctatgaaaaacccacaaaaaaatcatatttaacggcaaaaaactaaatgcttcttccttgagatcaggaatgagacaagaaagtccacactttgccacttcttttcagtattgtgctgtaggttctagccagggtaatcatgccagaaaaagaaagaaaacacatctggattagaaagtagggagtaaaactgtctctaattatagaaggcatgatcgtgtgtgtgtgtgtgtgtgtgtgtgtgtgtatgtatgtaatccactaagaaactaagaaactattggaactaatatatgagttcatcaagcttgcaggatacataatcaaggtataaaaaccaatgttgtttctacacatttgcagtataaaatcaaaaaataaagaaaacaattccatttataatagcattaaaaaaataggaataaattggccaaaataaaagcaatacttgttctcaaaaaacacaaaacaccattgaaaaaaattaagatctagataaatggaaaaatacctcacgttcgtgtattagaagtcttaattgtgttacagttgttaagatggcaatacttcaaattgctctacagattcaacataattcctatcagcattccacctgatttctttgtagaaattgacctgctacttctaaaatttaaatgtatttgttaggtacccagaagagctaaaagaatcttgaaaagttagggaactcacacttcttaatttcaaaacttactacaaaaccacagtaatcaaggaagtgtactggcattaccacagacatatagagcaacagaacagcatccagcgtccagaaagaaaatggcattttatgttcaactgatgtgctggggaaaacttgatagctacatggaaaagaatgaaactggacctttaccaaacatcatatacaaaagttaactcaaaacagatcaaagacctaaatataagagttaaaaaccctacaactcttagaagaaaatatctgagtaaattctcatgatctctaatttggcttagatataaaaccaaaagcataaacagcaaaagaaaacaatagctaaattggatttcatcaaaattaaaatcttttgtgcctcaaatgacactatcaagaaagtgaaaaggcaacctaccaaaaagggagaaaatattagcaaagcaattatgagacaagggagttacagctagaatatatgaagaactcttaacaagtcaataataaaaatacgaagaattcaattaaaaagtggtctatggctctgaatagacatctcccctaagacaatatacatgcagccaataagcacatgaaaagatactcaacatcattagtcactagagaaatactaatcaaaaccacactgagatagcactttacacccactataatgaaaaagtcagataatagtaagtgttggtgaggatgtggagaaatcagaacccttgtgcacagctgctgggaatgaaaagtggtgcaactgccatggaaagtttggcagttcctcaaaaagtgaaacatagaactactacatgacccagcaattccactcctagatatataccccaaacaatggaaaacaggcattcaaacaaaaacgtgtagaggcatgtccacagcagcactatttacaagagctaagatatggaaacaatgcaaatgtctatcaactgatgaatggattttttaaaatctggtacgtatatccacaaaatggaatattatttggtcataaaaatgaatgaggtactgacccatgcataatatgtatgattttgaaaacagtatgctaggtgaaagaagccaggcacaaaacgctacatattatgtgattcttttcagataaaatgcccagaattggtaaacccatggagaaagaacgtagacaatgattgcttagggctggtgaggcaagtggaaataggggcgtaaggaagtgataagctaaggagatgatagctaaaagggtatcaagttgctttatgaggtaatgaaaatgttctaaaattgattgatgatagttgcacatatccgtgaatatagtaaaaaccactgaatcgcacactttaaatggatgaactgtatagtatgtaaattacacttcaataaagctgtttttaaaagaacatattaataatacaaagaacgagcagtaagtgctccttgtacccctagcataagctcagtgtcagtctacattataactttatatttttcttaaagctactcactgatttacaaattccttcagttgtttcataacaagagaagttattttaatgtacaattattttatttttgtctagataaaaccatagaaataacttatcacataaagaatgtgctgaagttaataacctatgttattctctaattacctttagtaaacttcctgtctctacaagatgttgcacaaagcacacttcatatttgtcttttactatgttaaataaaaaaaaaacttatcagtatgcatcataaaatctctagatgagaaaactctttattgcagaagagtactgtagaaagaacatttattaaagcacataacagggcacaaatggtaacaagaaggcctgggcatgcatggcatccacccatacattctgacaactagaagccacttctgaaagaagtctcactagagacctaaaagtactcagtagcatagggaaatatgcctataactctacgtcatacagctttaggctcaaaagtgcctgacagccatctaggagagaggaataattaagactagaactaagtagaatgaacttgaagatcaggaaaaaatcaatcgagaattccccacatgtcccatatgtaagaggtgttttgaagaacataaaaagaaaccaaatgtcttttctaagtatagctctccattaataaagaaaagctctgagatttttaaaaatgttattcaaacttactcccccaaaattaacgcaagtgacaaacagatcaaggtgaattcctaagccaccacattttcataatattgaaagtgcctgtggatgaataagtttaaatgttatgccatatattagcaccatgggcctaagggttaaacagaatcatactcagaacaaaaacaacctaccattatgtgttcaagtagagaatctattgcaactatgttatcaaaatatgttctgaaaaaaagaaacataaatcctgtaagtaatttcattagttcacagtacatattacactttgaattcatttcctggttttgtctacatttaaataaaaaaccataaagataaatgtcatttgatttttctgctttggcaaaaaaaaaaatcagtactgtaatattattttaaagagataaatgaaactttatgattgacctcagcatgagggctctataattccagagaatgcaatcagtatttattttattgataagtatcagtgtagagagaaagtctgttgcatttaacaaagtatgcagaaataaaattgcatccaccatatttaatattttcattaataactctgatctaaaatacaaatatttaaatgtgctaaatctcatcaatagttaaatataaattatcactgaaaactggagaaagttagcatttaaagtgtactgagaaagtaatgtaattaatttgagaagaaatgtcagaatacaagtaatgctatggatctaatgactttatatgagtatatattcattgttatgaacagcgagtaaatgtttcagaggcaaatagtgcatatactaaaatgtcaatctgaaaaaagataaatcgatatgcatgtaacgtatggaaaatgtaaagaaggactcttaagatagactgcactggctaggtagtgtttaacctagttggctcaggtatccaaggggagctttttcagtcccatacttctttaattttattatttcaaaaactaaatgtaacataaactagtaacttcaaactaattaatgagcatcaagaataattactgatgggtaaactgttaggtgcatatacagtgacatgtgaaacataacatgtcatcgttgttgctggaggccacagaggaaaaactacattattcctttagtgaacttgtaggaggacatgaccctaaagttaccacatcccggcgcatattttagatttcagtgattaattacatgggtcagatatatagatgcagactcctgtagtaaataaaaccaataaaaatatgtgatttaataaatatctattatataattgcttccactgccagccaaagggattttttctaggccaaaccagcgaaataaaacattttctcagaaatgataactgagatactatacatgggaaaatttaaataataataataatgatgcttaatttactgacattgttagaaaaaccaaataggactttttggaagaaaataaaccagaatattttccctcctactgtagccagtattctcctgcataaatagagatatttagtgtctttaacatattctcagtctatttagaaaacatacatcaaatggaaaattaacatcatcacatatatatctgcaatccttcactttagagtgaacgtgaatgagaatataactctacaatccataatatgattaaccgttcccagactacttgtaaagacggatcttcagttatcagctgcaatagacaatggtctatttctgccacaggctgcccttaatttaaaccattgattaataagagctactatccctagaaatgaacacttactttgatacgtcgagtaggaagtcattcaattctgtctgtttggcaaggcctctgcatacctaccatataaaataataggtacaattacaagagatttctgcttatttcaaaataaaacttccagaatactaattaccttatttattgaaagaaggcctaacacaatcacttgggttataatgtaataataatatcaataaccattaatatttactgaatacttaaatgtgctaaacattgttttaagcactttctatttattgtctcaagcaccacaaaacattataggtttggaatttacatttcataatggacttataaagatgttaagaaccttactgaggcttcagaattaataagtgatagaagcagcattcaggtctggatagtcgacccaagtctctctttagaactactttacactgtatttctaaaaactgtagttgagcacatattccacctacacctgataattcgagtcctttctactccttctattatcctacagctcgatttttcttcctagcatacagttcttccctcatcaacctcaatttgctgaaacagaagtagaaaaataaaaccaccaccaaaaaaaataaaaagagagaaggagaagatacaaagaacgctatattgctaccatgttcttgaactttaaagtctaaccaccagtaaaactataagtagttggtgatttttaaattagatatcttcaaaagaaccagatatcttaaagttagaatgtttcatagatcacttagaggaaaatttaatttaggaaatggaatcataaaaatatcaatgcaactccagtaggagattgttcctaggttttcagtggaaaacaaatactacagcaggacatatgccatttattgcattaattatatatgtatttattttatatatagatatatatgtatgtgaatggacacacatatattgcaaaatatttaaggcagggagtaagtaaatataactgattaagttaaaatttctagaaataacagaaaattgtaatatcccaaaataaggcattgggtgacttaacctctattccggtcttcaatgcctcactccaaaaacctcttctcccttaggaagcccctgcaaaaacaccccaaagactcacctgcacctgatgtattgctactgaagcccaggcaagatttgctgttgcaacctaaaaaaaacaagaaatacatacctataagtaataatacataacgtatatatatatactatatataatatactatatatcatatgtataatacataacatatatatactatatatagtatactatatataatatatatcatacataacatatatatatatatacacacacacactacttgtagtcatctcaacaaaggactcggggatacatgtatatgaagaattttctgacatcactgagcttttgaacattttccaaacacaaagcaccaaatatttacaaggtttttcttttatattttccccatctatttaactgactttaatgttctcttgttcatcttaattttggataaaatggaaaacaaactgattgttaagagagctgtagcccaatgattttcacaaaattactacttttcggtttaacaaaaatactattgaaaagcaatctaatgaccactttaaataatgaaatatttctaaaatgtaaaaatcatacacatatatttatacacaagctaacaagttcctcaaaattactagcttttctacttcttttattattcactcattcaacaaatattcatgagtgtctattatgtaccaggcactattctaggtgctggagatactgtagtaaataacagaaatggagtggccttcagtgtacttcagggagaaggacaagaaatgaaataagtgtagcatataatatattagatagtgacaggtgctatagagaaaaagcagaagaagagagaaagaaacattggataggagccattcaaatgtacatgaagtgttcagggagggccttatagagaaggcaacatttaaggaaattctgaaggatgtggctgtgagggggataagtggagagaagaaaaaatgcaaaggcctcagttaagtagcctgtcagccttgcctgaggatccagcgtggctggagcgagtgagggacaggtggggtcgcaggagatgggttcattcaggcaagtgaacaggagtgaggccactgaaggaaactggtttatactggatgtgataaatgtatcattttaatatttgcttttagtagtaatgagcctattg

SEQ ID NO: 606 - DNA, 324479 bp, Homo sapiens
catccccttatgatactcatcctctaacagcaattgaacttcaatacaatgagtcattcctgagttcactcgcttcacattacatatgtttctctataaccacaagcatcctggcttggtagtgctcccacagcaccaaaaatccctgaggaggctgacaaacattgtgctgactcatgctggagacaagccacagagaacttccatcccccaccacatcagccacggagccagcccagcctctgcccacccaggcctcagtccccagtgttaagttctgatccctgatgctggcctgccagtggccagtcaagattctctttctgaaagctagtattttatgaggactgactgttgctagacattacactaagcacattatatgttgtacttcattttaccctttcaacaatcctattagtagcttactgtgggtctgcaaagccttactcaaaacatatagggctagaggttctcaggattctgaattttaaaaaaaatttgtaaaggcttatggctctcaccactgttattcaacgttgcattaaagtttctacccagagaaggcaataaaaggaaattaaagctatacagattggaagtgaagaaataaaagtctttattctcaagaatacaagacactatgtatagaaattgtaaggaatgcaaaaaaaaaaaaaaaaaaaagccctacaagaacttataacaagtttagcaagattgcaatatacaatcttgcaatcttcctaaagattatatacaaacctaacagaattgtatttatatatactgtcaataagcaattcaaaatgaaattaagaccacgattccatttaaaattgcatctaaaaataaacaaaataggaatagacttggcaacagttgtaacatctgtatactgaaacctgtaaaacattgctgaaagaagttaaagacttctttaaatagagacatatacaaagttcatagattagaagatgcaatattgttaagatgatagtcctcaaattgacgtatagattcaatgcaatccattaaaatctcagatggctttttatagaatttgaaaagctgatgctaaatcttttatgaaaatgcaaagaacctctagtagacaaaacaatttttttaagagcaaagttggaggatttatagaacctgattccaaaactgtcagtaaaactacaataattacaaagtatcagccaggtgccgtggctcacatctgtaataccagctctctgggaggctgaggcgggtggatcacttgaagtcgggagtttaagaccagcctggccaacttggtgaaaccttgtctctactagaaatacaaaaaattagccaggcatgatggcacacacctgtaatctcagttactcaggaggctgaagcagaatagcttgaacccaagagagtccagctcaaaaacaacaacaagaacaaaagtatcacattggcataagaatagacatgtaaatcaaataacaaaatagagaattcaggtataaatcttcatatttatggctgattgactttgaacaaaggtgacgaggcaagtcagtatagcagcatattcttttcaacaaatggtgctggcagaagaaaaaaaaagtacttggatccttacctcacaccatgcacaaaaattagctcaacgtggactatatcagggtttctcaacatcagcagtgttggcgtttgctggggtggataattctttcctgtggagagctgtcctgtgcactgtagaatgtttagctgcatcctggcctctgcctattagatgccagtggcatccctcccctgacacacacctagttttgacaatctctgtctccagatattcccaaatgtgccctggagagcaaaactgtttccagttgagaaccattgacctaatgtaaaaaataaaatgtacagaagaaagcatagcaggaaatcattctgacctcaggttaggcaaagctttcttagatatgacactaaaggcataattcattaaaaaaataagttgggctttgtcaaaattttaagttttgctcttctgaagaaaccattaaaaaaaaatgaaaagacaagccacagactatgaaaaaatacttgcaaatcatatatctgataaaggacttgtacccagaccatgtaaagaactcataactcattaataaaaggataaagaaaaagctgaagacaattcatgcaagaagatatacaaatattaagcacattaaaatgctcaatattattagtcactagggaaatacaaattaaaggcccaatgaaatacctattacacacccattagaatgactgtaaacaacaagactgataattccaacatctgaccaagatatggagaaactagaactctcctacattgctggcatgagtgcaaaatgatacagccactttgaaacaccatttggcagttgcttaaaaaattgaacattcaactaccatatgacccagcaatttcactctcaggtatataaccaaaatacatgaaaacatggatctgcacaaggtcttgtatacaaatgttcatagcaacattattcataataaccaaaaattagcccatcaactgaaaagtagataaacaaaatgtatatccacaccatggaacgctactcagcaaacttctaaaaagcaacaaactactaaacacgtgcaacaacatgaatgagcctcagaaacataagtgaaagaggtcagacacaaaagactacaaattgtaagattccatttagataccatttctacaaaccgcaaaactgtagaggcacgaaacagattcatggtctgctgcagctggggatgggagtgggaacagagagcaaacattttgggatgatggaaacattctaaaactggattgtgattttggttacacaactgtatacatttactaaaatcaatgaacagaacacttttaatgggtaagccttaaggcatgtgaattatacaccaataaagctattttttttaaaaaaaagagagagagagaacgagagctacatggcagccccagggcaatagctctcagatctcccttagagaaagaactttctcttccacagcaatgagtgcaggtagctaacactgaccaacctgcatctggtagttcatttaaggtcggccttggctttcaagttaaggccatggtctttctctgcagtccccagccaatacgtgggcacagaaaggcacagggcatggctgattcagcccaacatgaggctccacaccctagaactccctgtggagttggccgatactgcctgtgacctgcaatgtggtctaagctgtcagacctccacagtggccagaaggttttccatacctgagcctgcttctacccacttttatttttcccaggagtcacgcttagtcatctcttgctctttgaactccatgtctgtatcagctacccagaggacccatcagacagaaagtaatatgcagataacagcccaggggaatctgggcagcactgtgaaaccaacatttcttcagtgaaacctagaacaaaagtggaataaataaaaactaactgtctcatttcagcactggcagtctcactctggaatctgtgttcatgctacccaggcctatactacaagctcgttcagccataacagggcaactgtgaggctgttggatgggatgatgttggaagtaaatgctcagtgctgccaagtgaaaatagcactcaggcagaagtcttctcaccaaggcaatttacttttatagaagggtgcatctcgcggatggaacaatggcgagagcacactggacaagggaggggaagggggccttatttctaatgcagctagccctactgctatatctttcccccactgactagggttggaccgcacagtctaagctaattccaattggctattttaaagacagcagaggtacaagccacactggcaggacagttacagaacaggtgactaaggatgactaaggacagaacaggtgactaaggatgacgaaggacagaacaggtgattaaggacagagcaagtgactaaggttgactaaggacagagcaggtgactaaggacagaacaggtgactaaggatgactaaggacagaacaggtgagtaaggacagaacaggtgactaaggatgactaaggatagaacaggtgactaagggtgactaaggatagaacaggtgactaagggtgactaagtacagagcgggtgactaagtacagaccaggtgactaagaatgactaaggacagagcaggtgactaagtacagaacaggtgactaagggtgactaagtacagagtgggtgactaagtacagagcaggtgactaaggatgactaaggacagagcagatgactaagtacagaacaggtgactaagtacagaacaggtgactgaggatgaataaggacagaacaggtgactaagggtgactaaggacagagcaggtgactaaggacaggtgactacggatgactaaggacagaacaggagactatggatgactaaggacagagcaggtgactaaggacagaacagtgactatggatgactaaggacagaacaggtgactacgtatgacttaggacagaacaggtgactaaggacagaacaggtgactaaggacagagcaggtgatagaggctaggagcgggctgtttactgaaactaggggtaaagagatgtaaagaatgagaaagttaaactttaaaatggagaacaaagaacagggaagctgaatatactgacacattggttctttggagaggaactcagaactcagcgtacttaacaattttctccctcttgaattttaaaagacattaacaggctaaacttcgaagaggaatttattgtttcctacagatgacaattaataatcaatcttgcaatgtttactgaggtcactatcctcagtgctatacgtgttctgtgtcccatagacttcagggtaactacatggtccttaaacttacaatctaaagtatttccatgagaccttccttaatagacgtttgttctcagccttctttcaatagcaacatcctttgttcacatgaggatgcataaagaaatacaatacgtaaaaacatgttatcaggaccgctctcattaagctgggtagggggtggtcacacgagggtttcagatcctcacccaaggatctcatctttctctgcacaagggtaggctgcacagcgcctttgtagatacttccgagattgcttgaaaactgccggtctggcccagtccctcctatcactgacaaagaagctgagatctcgaaagacacgccacccatgagcagtaactcagtgcaaagaatctaaataccagaactcctgacccacaaggctttctctgtgcatccaagatgtcccaaactgaaatggtctatgcacgacagagaactttgatcacactcagaaaacgtctttgaaaatgaaacatggcacattgcagagatgtcacaaatgagacttcccttgatggtccctgagagcgtctttgtgttccatgtagctgctcccattattttgggcagacattgacagtctttgatgaaacatttttcaccttgagttacagtaaatgttatcatctcatgtttttggaaatgccattcaaggacttgagagatcatttctagataattgtttataaccatgccccttataatttcatttgagattatatgagaaaaatctaagcatacctatttaataaaggatttggacaactgcatctcaaactttaatacaaattcaaatcacctggggatattgttaactggcagattctacttcagcacatctggggccagaaaggctgcgtttctctcccctcccctcccctcccctcctctcccctctcctctcctctcctccttccttctctctctcctccttccttctgtctcttctctgtcttctctctctcttctttctttcaagatgggtctccctctgtcacccggctggagtacagtggcacactcatggctcactgcaaaggctggattctaacaagctatccggtgatgtggatgcagtttcagaagcagggagttagaatacgcaatgggatattataaatgtacatttcatttacttctgcacaagatgtaatgtcttgttaaaccaaactgctatttttttttttttgagacagagtctcactctgtcacccaagatggagtgcagtggcccaatatcggctcactgcaacctccgcctcccgggttcacgccattctcttgcctcatgaggtcaggagattgagaccaaattgctatttcttacagtgttgcaaataccttgtgagattcttatcaaggtattggagaataactagggcactgattatgagaacatcagaattgtcagaggcgtcctaactagggtgactccatcctgaataaagcctggatagagccaaacctgatgggggacattccctgagggatgatcactctcagtcacaggatgtttatagttgagggaacgagttaatgatgctgactacctacctaaagaaccagaacttacagaaatgtcccagtatttgaagaacaaacagcattgttagtttaagaacagggttcgttttagagataacagcacattcataaattcttgctgaaatcaatagttgcacaagaaaataacagtattaatagcctgtcgtaagctgatcacaaatctttgtaatatattacactcttctaagccaacaaagatcaaaacagacaaagaagggcattacataatggtaaagggatcaattcaacaagaagagctaactatcctaaatatatatgcacccaatacaagggcacccagattcataaagcaggtccttagagacctacaaagagacttagactcccaaacaaaaataatggaagactttaacaccccactgtcaacattagacagatcaacaagacagaaagtttacaaggatatccaggaattgaactcagctctgcaccaagcggacctaatagacatctacagaactctccaccccaaatcaagagaatatacattcttttcagcaccacactacacctattccaaaactgaccacatagttggaagtaaagcactcctcagcaaatgtaaaagaacacaaattataacaaactgtctctcagaccacagtgcaatcaaactagaactcaggattaagaaactcactcaaaaccactcaactacatggaaactgaacaacctgctcctgaatgactactgggtacataacgaaatgaaggcagaattaaagatgttctttcaaaccaacgagaacaaacacacaacataccagaatctctgggacacattcaaagcagtgtgtagagggaaatttgtagcagtaaatgcccacaagagaaagcaggaaagatctaaaattgacatcctaacatcacaattaaaagaactagagaagcaagagcaaacacattcaaaagctagcagaaggcaagaaataactaagatcagagcagaactgaaggaaatagagacacaaaacacccttcaaaaaatcaatgaatccaggagctggttttttgaaacgatcaacaaaagtgatagaccgctagcaaaactaataaagaagaaaagagagaagaatcaaatagacgcaataaaaaatgataaaggggatatcaccaccgatcccacagaaatacaaactaccatcagagaataccgcaaacacttctatgcaaataaactagaaaatctagaagaaatggataaattcctcgcacatacaccctcccaagactaaaccaggaagaagttgaatctctgaatagatcaataacaggctctgaaattgaggcaataattagtagcttaccaaccaaaaaaagtccaggaccagatggattcacagcagaattctaccagaggtacaaggaggagctggtaccattccttctgaaactattccaatcaatagaaaaagagggaatcctccctaactcattttatgaggcatcatcctgataccaaagccaggcagagacacaacaaaaaaagagcattttagaccaatatccctgaggaacatagatgcaaaaatcctcaataaaatactggcaaactgaatccagcagcatatcaaaaagcttatccaccacgatcaagtgggcttcatccctgggatgcaaggctggttcaatatacacgtatcaataaacgtaatccagcatataaacagaaccaaagacaaaaaccacatgattatctcaatagatgcagaaaaggcctttgacaaaattcaacaacccttcatgctaaaaactctcaataaattaggtattgatgggacatatctcaaaataataagagctatctatgacaaacccacagccaataacatactgaatggcaaaaactggaagcattccctttgaaaactggcacaagacagggatgccctctctcaccactcctattcaacatagtgttggaagttctggccagggcaatcacttaggagatggaaataaagggttattcaattaggaaaagagaaagtcaaattgtccctgtttgcagatgacatgattgtatatctagaaaaccccatcgtctcagcccaaagtctccttaagctgataggcaacttcagcaaagtctcaggatacaaaatcaatgtgcaaaagtcacaagcattcctatacaccaataagagacaaacagccaaatcatgagtgaactcccattcacaattgcttcaaagagaataaaatactgaggaatccaacttacaagggatgtgaaggacctcttcaaggagaactacaaaccactgctcaatgaaataaaagaggatataaacaaatggaagaacattccatgctcataggtaggaagaatcaatagcgtgaaaatggccatactgcccaaggtaatttatagattcaatgccatccccatcaagctaccaatgactttcttcacagaattggaaaaaactactttaaagttcatatggaaccaaaaaagagcccgcattgccaaatcaatcctaagccaaaagaacaaagctggaggcatcaagctacctgacttcaaactatactacaaggctacagtaaacaaaacagcatggtactggtaccaaaacagagatatagaccaatggaacagaacagagcccttagaaataatgccacatatctacaactatctgatctttgacaaacctgacaaaaacaagaaatggggaaacgattccctatttaataaacggtgctgggaaaactggctagccatatgtagaaagctgaaactggatcccttccttacaccttatacaaaaattaattcaagatggattaaagacttacatgttagacctaaaaccataaaaaccctagaagaaaacctaggcaataccattcaggacataggcacgggcaaggacttcatgtctaaaacaccaaaagcaagggcaacagaagccaaaattgacaaatgggatctaattaatctaaagagcttctgcacagcaaaagaaactaccatcagagtgaacaggcaacctacagaatgggagaaaatttttgcaatctactcatctgacaaaaggctaatatccacaatctaaaatgaactcaaacaaatttacaagaaaaaaacaaacaaccccatcaaaaagtgggcaaaggatatgaacagacacttctcaaaagaagacatttatgcagccaaaagacacgtgaaaaaatgctcatcatcactggccatcagagaaatgcaaatcaaaaccacaatgagataccatctcacaccagttagaatggcaatcactaaaaagtcaggaaacaacaggtgctggagaggatatggagaaatgggaacacttttacactgttggtgggactgtaaactagttcaaccattgtggaagtcagtgtggcgattcctcagggatctagaactagaaataccacttgacccagccatcccattactgggtatatacccaaaggactataaatcatgctgctataaagacacatgcacacgtatgtttattgtggcactattcacaatagcaaagacttagaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcacaaggacaaaaaaccaaacaccacatgttctcactcataggtgggaattgaacaatgagaacacatggacacaggaaggggaacatcacacaccggggcctgttgtgcggttgggggagggggcacagatagcattaggagatatacctaatgctaaatgacgagttaatgggtgcagcacaccaacatggcacatgtatacatatgtaacaaacctgcacgttgtgcacatgtactctaaaacttaaagtataattaaaaaaaataaattacattcttctttgccttaatatgctatataggcaagcattacgtttaaggtgctcctccttgcttttcgaggacaccctactcggtaatagtttctaataagcagttttaactttactatactctgcaacttgccctgaattctttcccatgtgagatccaagaactcgctcttggcatccttctgggacaagactcttttttttttttgagacagagtcttgctctgtcgcccaggctggagagcagtggcgcgatctcggctcactgcaagctccgcctcctgggttcacgccattctcctgcctcagcctcccgagtagctgggactacaggcgcccgccaccacgcccggctaattttttgtatttttttttagtagagacggggtttcaccgcgttagccaggatggtctcaatctcctgaccttcgtgatccgcctgccttggcctctcaaagtgctgggattacaggcgtgagccaccgtgcccagccgacaagacccttttttagataactgagtttaaaagtacatctaaggaggctgacgcaggagaatcgcttgaacccgggaagcagaggttgcagtgagccgagatggcgccactgcactccacccagggtgacagaaggagacgccatctcaaaaaataaaaataaaaataaaagtacatctatgtcaactgggagcctgatataacttgtccgggcgtccgtgtatttgaggtctgtgcgagcgtttgtctgtttagtgtgtaaactcgtgtaaccaccactgtggtgaagacacagagcagctccgtgaccagaaggttctgtcctggggcccttttataaccacggaacccaccagcttctgtcccttccttaactcctggcaaccactcatctgccttccacttccataactctgccattaataacctgttactttatttcacatgacaagtagtgacttaattgcagataaagggaacattcatgtttgcgcttttcttgtcattgcttccttatgtgaacctttctctgcttacagggaatcatatcgagaagtacagtttctgtttggagagaatggaaagagaaaagaaaaataaacacaatggtctcaatgttcgaaaaagcatgcagtggatataatcacctaaacctaaacacccttttgcacaacagacctacagatagtgatggaaatgtcacaagcttccttccaaaagcactgcagaactcctaataaagaatggaaatcctcaggcggtggggagtcaagagaggcagccgggatgccgagtccaggtcctggggtccggccgctgccaggtagggcagagcaggctcttggggagcagaggcttgggttttcatgtcgaacaggatcagcagatgaggaagtggacctgtgaaaagtcgctggcattgcagctgagatcccctaaagaaaagcaaactcctggaaggacacgctgagaggaagaggactaggaaaaactgcacaagaggccaaagaagccagaccggcccagagctccaatcagggagagcaaaaaagagactcaacaggtttaagttcatatacggtcatacaggccatgttttctgaactaagcataatgtaggaaattaattgtatgaagaaatccaaacactaggctgggcacagtggctcacgtctgtaatccaagcactttgggaggccaaggtgggcagatcacttgaagccaagagttcgagaccagcctggcctccatggtaaaagcccatctctactaaaaatacaaaaaaaaatagcaggcatggtggcgcacacctgtaatccggccacttaggaggctgagacacgagaatcagcttgaaccaggaggcggaggttgcagtgagcccagatcgtaccattgcactccagcctgggtgacagagtgagactctgtctcaaagaagtccaaaaactgtatttgtaggttgaaaacataaataattgatacatcaaaagaaatcataatggaaatgaaaaaatatttagaactgaaataaaaccttctgggacatacctaatgcaatagttagaggggactatgcagccttaattgcttatattagtagtaaagggggaagaaacctaaaactttgttagctaaatattgaatgaaataaactggggagggccaggcgcggtggctcatgcctgtaatcccagcactttgggaggccgaggtgggcggaccacgaggtgagatcgagactatcctggctaacacagtgaaactccgtctctactaaaaatacaaaaaattagccaggcgtggtggcacacgcctgtggtcccagctacttgggaggctgaggcaggagaatcgcttgaacctgggaggcagaggttgcagtgagccgagatctcaccactgcactccagcctgggcaacagagcaagcactgtctcaaaaaaaagaaataaagaaattggggaaatagctacatagtaaatcaaagaaagtgataggaagaaaataatagcagaaagtaacaaaatcaatataaagaaaaaagaatcaattaatccgaagatgattctttgagaagactaataaaatagacaaatttccgaaagtttgaccaagggttggaagaaaagaaggaacaaaacaatgttaggcatgaaagggaaacgtaactactcactacacttacatacgcctttaagttttcaaatcttgaagaattttgaaagcatatgacaataataaacaatggaaagtaaaagaaaatctaaaaggatgttacattagaggttatattagaaataattagatataattcagcaaaaacagacttaaatcaaaaattgcaatgaaatagcgtgaagtctgggagggaatgcaaaattttgatgccctctccccgtggaatctgaacacatcaccctcccagggccaggacatcaatcagtgcgttcatgaactcctctaaagaacttccaccaaggctgtgctgcagagttttttattgatgtgtcattatgtgggcatgagattgattaaatttattaagttggttgattgacctcaatctctggtcctctcctccatccccatggtcatgatcaaccgaagtcccaactttctaaccaagtgcttggtccttctggtgaccagcccccatcctgaagccacctaggggccaccgggggtcacctcattagcatcacaaagacactcctagtgctcaggaaattacaagggtttctgaagctctgtgccaggaactagggaccaagaacatgtatctattagcctcatttaacagatgtccatttttgttacaccacacatggcaagcctggtaaggagagccttccccaagaaggtatgtaagcaactaggaactgggtgggatgtttaatcctctttcatggaagaggaaaaataattggaaataataatacatggcatgacgagaaaaaacttaaaatcccatgttgaggccgggtgcagtggctcacacctataatcctagcactttgggaggctggtggtgggcaggttgcctgagctcaggagttcaagaccagcctgggcaacatagtgaaaccccgtctctactaaaaatacaaaaaatgtgctgggtgtggtggcgtgcacctgtagtcccagctacttgggaggctgaggcagtagaatgacttgaacctgggaggcagagtttgcctccaaaaaaaaaaaaatcctatgttgaacatgttatgtttgagaggtctgagtgacatccgaattaagatgtgaagtagagtggtgtgtgtgtgtgtgtgtgtgtgtgtagtccggacactgcatgaggacaaatcagtaggtgtgtgtgtcttttacgtctcaggaattgataagctcacctggaaggagaaagcaacagagccccaagctttagccatagggaactccaaacattagatctggtaaatgtagagaagctgtgtctggcaaaagaaatacttcagctgagttaaatttaaaggaccttcattgggtaatgaacggcaaatcaggcagcccccagaatcacagcgaatttagagagaccccagcacagccgaagaagatttatagaccaaacaaagggaggtaatgtacagaaatcaggggtaatgtacagaaacaactgggttggttacagctcagcatttgccttatttaaacacagtttgaacactcagcagtgtataaatggttgaagtatggctgctgggattagccgagactcagctattgttacaggtgcatactcctaagttaggttctcaatcttgtctacctattaagttagattgcagttcgtccacaaggactcgaatataaaagtactggagtccttctctggccatatttagtttgctttaacactacccaagatagagagttcaaagtcacaaaatctaagaagaaaacatatttcaagaagtcactggttagttaactgttgaaagctagctgagaacaatagatctgagtagaacctctttaggggatcacattgctgagaagtaaagctctttgtcaaccaaaaatcaagatcccaaacatctctcatctctgctcccttccctccaatgtgattgttcctccccttctttgcttctctttgttctttaaatttatttttctatattcaactcaattctttttccttctcttccacctcctatgttcccttcctttctggaggcccaaatgatttcattaaaatcaaggtgtcagcagagattccttactttctggaggcgctgggtgggaatgcgtctcttgtctcttctgggatctaaaggtaccgccttccttggctcatggccccttcctccatcttcaaagccagcaacggcaggggagtcgttctcatcttacttcactctgacactcactcttctgccctctcttccccaattaggaacccttgtgattacattgattaccttgggctccccaaaataacccaggtggacttgttttaaagtcagctgattagtaccttttccacctaccacctgaatccccccggccatggaaggaaacatattgacagattttcagattagaacatctttgaggagaccttactctgctgccaacactggcccctgattgcctcacactaaatccaggacggatgcactgaccatgggttctcactggcacccagcctgaaacctcagataaggcatttgtcttctcagagccagggtttcttcaactggcaattttcacaataatccctgtctggtgcctgagagcacaggatgatggccagggagtcgacgcccttctgaaagggggaagaagcaaaggcatctcggtttgcagtattcagtgagttatgctgactcaaagacacgaatcagacactgactggtaggaacccccagcacagattaagaagtgcatagccaacaggcctgactccaaacaattcaaacaacaaggaaagaatagagaacttatcattattgtgtctgtttgacaaatacttaattgaccataatgtaaggctggaatttgcctattttaaagttacctgtggttgtaattaaactgttttgttcagtgttctcaattctaattctactactttatttaaaactataaatttttgtgtcaggaagacaatatctacttttatccctctaatatttaaccccttaatggagacagtaattagaattattgacctgaaactacacaagatcatacaaacattcttcaggctaaactattattttgtttggtatgagttcccagtctaagcgttaatattttcccaaagcctcaggaccttgcagggaccaaactccacctagaactctaagatactggcggcagctgtcaatttcattaatctggtttcaatttttttaatatttggattacagcttatctatgggaactcatagttgttccatctttaatattccagatagacgatttactgaaaaagctaattcagtattgtctcccgtgagccagccaatgaaacctcagccaacgctgaggagggagcactcgaggggaggaacgccatcctgggctctctagggctgttgtctgtcaacagcgagatgagaacaacgggcaacagcagcagctccgtcggcccacggccgccccaggggccctgggagggcgggaagggagacactgccagacctcagagcttggcaccaagagccagttatcagccagataatgtactcaaccaatggcgagaaacccgaccatgaacttattgggaactggtcacagaaaagagaaggactctttgtcctgagtgtgtgaggctgtgatggtaggagccgcagggctgtgactcacacgatgccacaaggttccttccaaaaacaactggggatgctgtgtggggaaagggctgatggcacagtaggaggtaacgggctcaaaactgacctcctttttaggggtgaggaaaagactgtcacctcatcttgtggcttcagagcccagaagagattgtggagcagcggttagagacttacggaggaattctgatatttttaactcttcggcactttgcttttcttgagcaattcccacaccacccctttttaaagatttattagattcaggggctactttataatatccttggagcccaaattagactttaagcacataacatatctgagcttgaggagtttaacttcttcaacaaaggagcaaagagatttggtgaaatgacccccatggtccctaatgctgatggacccaccgaagttagcctgtcaccagaagcaaagggatactatttttaagatatgaggatcttttccacatttctgttcaaagcagtaactttgcagcttcatctattgaaggcctcatctccacctgcttttcctaccctggattcacagggcttgtggtgccctctccctgcctccactcaccttccaacaagtgctggagtttgattcacaccaaacagaaatagccaaaatttgtaagaactctattgggcagctcttctgtatcaatgactgtacaggctccaagggccagaaataatgaagatacagcacctatctcagcgagctgacagccttgaagggggatgaggctggaaaacaaatgacaacacagtgtgataagttcactgcagaccagggagagcgacaactttgagaaagggtgattgcttttaaacggaaaggaaaagagcttgggaaatacttccagaagaaactgacatctaacttaggtgagttttctttttttttaggtggggtctcactgcgttgcacaggctgcagtgcagtggctattcagaggcatggtcatagctcactgcagccctgaattcctgcactcaagcgatcctcctccctcagcctcctgagtggctgcaactacaggtgcatgccaccatgcctgactctctaacataggtttcaaaggaagcataggagttccgagtggaaaagagaccaagggagaggcccgtgccagtcccgaaggtgaggggaggtctgagggcctcaggattgctggaacttccagtggaagggcacgttgaggggacgcaagtgaaatataagcgttgggtagttaagaaaggctattgaaattttccagacaagaaatgttaaggcgcagaacacagtgctcacagagagggaaaggaggaggtggattagaaatgaaattttggaaatgaaattatttgctgcctgagtggctacgcaggaggagcagggggacagagtcaatctggatgagtcttggactcaggcataaagtgtcagcagtcttgggaggatccacatcctcacgggaaccagctccttcagctaaagggaaaaggtgcttggtgcttcagccggcccagagcgtgccctccatggacacaaagaagccaagttcttgttgctaaaggtgttcaacagagaaatgttggagggccaattaaaggcaaagcccaccactttataaccacattttaggcatattaaacattctagaatgtaatcatcagacttctaaactgagccatttgtgttatccaagaaagtaaatcagtgacttatgtttgcagcaatataatgaacattataatggacccctgaaaatgcagagtgaatggtagggaatttgcaagaaaggtagagaaacgctctaccactggagacaaggtggagaagcaggttgacatccaagctggggaacatcatgttgaccgagcattgtgtatacacagggcgtgtgtgcatctgcgtgtgtgtgcatgtgtgtatatgtgcattcatgtgtgtgtgtatgggaggtgggccgggacaggggagttggaatggagaccaacctgataaagctgacactctggaagggttagactcccaggaagaaagttaagaagggagaaggataacatctgcacaaaggcaaacacaaagcaacatcctttgtcagcaacatccttaggcacctggaagaagcagacacacaacttccaggaataatgtccctgaacctgggcttctgatgattcccaccaatatgaccatcaattagaatgcgtgcacacacacaattccaaataaatcatcaagacaatcattaggaaaaataacaggaccagatagaccaagacttcaggtgttggcgtcatcagatacggatgatacatgttaaaagaaataaaaggacggaaaaccatgagaacggaacaagaatgataagatggaattgaaaaggaggcagatagaacttacagaaaaaattttttaaacttagaatttaatattgtttaaaacgttttaggtccccacataaaaatagatggcctgggtagcaaacctaagccaagggcaccttatgagctccttacaaggggcaaattactgccagccacgagccccatgaggttccaggttctgcatgggtggaagaaggaaactccaggcagcagcagacagctctgggaacagcagaataccacacagctcaaggttattctccatcttttgctctgtattaccaggaagcccagcagggccaactggacgaaagcgcttgggttttgcccaatgcaactgcatataatcgagagcaagggacccacagctggaagggcccaagagtctggagctctctatctcccatgaactctcaaaactgacccatctgagtgcctgtctgggccagggccctaccccgaggagaaattcctgggagtagaatcaaaatcaatcaagacaggcatgacagagacaagagaaaaagaaggtccacaccaggccaacaaatccctctgttatgaaccagatagtaaacatcgtaggctttgaagtccagacggtcttgctgctactactcggccctgcggttataaggtaaaagcagccacacatgacatgtaaatgaatgggcatggctgtgtgccaaaaaaactttatttatgaacactgaagtttgcattgtacacaattttcacgtgtgacaaaatagtattctttgtttgtttgtttcaaccatttaaaaatgtaaaaagcatttttaatgcacaggctatacaaaactggtggtgggccagagtttgatttctgtctcctggtgttgatgaaagaggctttgagaaaaagatgcaggaaaactcaagacaggatgccatgctgcttttggacattaccaaaaacagcagaagagggagccccgcaaaggtaaaagagcactcctacacccagccacatcctaaaggctcaggcaaatgaatttcccataaaaataagcaacagaaaatatccaagtcaaatcccatacaaaactattataagaaaaaggtcctaagaagcagaataacagcccaacagacaataagagcagacacaaagatgtggccgtcatggggctcagaaggcccaaagtgcagcctcagaagccaagtttccccctgaccttcccttgccctcctgtctctcacccctcatgctcccctgagggaagctatagaaactagaattcttcctctcccgaggtgagtcataaaaaccagaacccctttgcctcaaggccagccataaagcctaaaaatatgactctagcctccccctgcttttctgtgtaacagctggcaataaagaaattaagaccctcattgtagagggaccctaccctatgcccaggaggagggaatgtggcacagagaggctgagaaagatctgaacgcagaggccttgctgagtttccccacaccatctattacattcgatcaggacctttctgtccagtcttacatttcgacatggctggctgtgcttcatcaaatctaagtatagaaatgcacagttcaccctgtatctttgggtcttcattctgaaggttcccacatcacatcaaactatgatgaaataaatgtgttatacttttctcatgttaatctgtcttttgttataggggcactggtatgacctttatgatggagaagaaagtgattaccccctttctgcctctgcagccacaaaacagatcaaaacctatttcagaacaagctaacagactctaagaaaattatgtaagacatgaaagtatgtgaattgttacagcaatcagaaaagaattaaaaaatttaaaaatgcattttaggagcaaagactaaacaacaaataaacacaacatgtaatgccctaagaaaaacagagggtgaaaatgaggaaagttttcttgtgtgtttgtttgtctgttttggagacagagtccactctgttgcccaggctggagtgcagaggcacaacctcaactctctgcaacctccacctcctgggctcaaccaattctcctgcttcagcctcccgagtagctgggattacaggcatgcaccaccacgcctggctaatttttttttctatttttagttgatatgggatttcaccatgttggccaggctggtcttgaattcatgatctcaagtgctctgcccacctcggtgtcccaaagtgctgggattataggcgtgagccactgtatgcagctgataatgaggaaagttttaaaagtaaaaaagaagtgaaaaaaaaatatgtcagaaaaagtggaacatattgaagacaggcaaaggagatagaacataggaggtctcgaggaagataccaatgcaaagaagaagactgaatactaaaaacgacaagaactataccacatttttaacactgaatttaaaaaaggatttgaagctacatattgaaaaattataccacacactcgaaaatattgaccccaaatggtaaaattaccaaacttaaaaaaaaaaaagaaaaaaaatcctttgaacattttattagttacctagggctggcataacaaaatacacagcctgggtggcttaaacaagataaatttgtttgctcacagttctgaaggctggaagtccaagatcaacgtgttcgcagggatgatttcttctatggcctctctccttggctgcaaagggccatctcatcctgtcctcatatggcctttcctgtgcacctgcattcctggtgtctcttccttttcttttaaggacaccaatcatattatattaccagcccctcttatggccttaattacctccttaaaagctctgtctccacatacagtcacactagggattagagcttcaacttataaatttgggtaggatgcaattcagtctacaacagatatcccaaacaagtgtgtaaggtataaggaaaaaaaattaattatcatcacgcttgtcgacagcaatgctttatgctatgagaaaatgaaatagcatattatttatttaacatacaatatttatatacaagataaatcatacagaatacaaatatacagtaatgcaaatatatacaaataaataatacaaatatcatatgttattatatgctattacaatatacaatattaaaataacatataataattaacatactcaaggaaagaatatatgaaacaagaattttatatctaattaataaaagacaaacttttatcaacatgccagaactcagggactattattgctgagtctttcctgagaaatctagtcgacatcaagcttcagacaatcaaaatggagagagagataagtgacttatgcaatggtagtaagtaaataggtggtacgcctaggcaacataggaagatctcatggaaagaaggaagaagggaggaagggagggaggaagggagggagggagggagggagggaaagagagagagaaagaaagaaaaaaagaaagagaaagaaagaaaaagaaagaaagaagagagagaaggaaggaaaggaaaggagaggagagataaactcccaaatttttaaatggtcaaagataaaaaacattttatgaaaacataatctgctaattagaggctgcagtgtgctatgatggcaccactgtgctacagccttggcaacagagcaagaccctgtctctgaaaaaaattttaaaaaataacacattagacacagctcaaaagagaatttgtaaactggaaattatatccaaagacattgctcaggatgcgtaacagaaagacaaattaaaaatacgcaagagaagttaagaaaatgaaaaataaagtccaacatatattcattttaagtttcagaattaaatagtagagtaacagcaagacagcagtatttaaagaatatttaatagactaagaaataatggccaagaatttttcagagttcaggaagcaatataatatatcaagcaagagaaataaattaaattcatacatgatgaaatacatagatgaaattcataaatagattaaattcatacatagataaaatagtgaaaaaacagattatctacaaaagaatgtcaataagactgacaggagtctttttaataacaatggaacatggaagaaagtgaaataccttcaatgtgctagaaaataattatagatttaaaaatcacaaatccagtgaaactaccaaaaatgaggtagaataaaggcactttgagataaacagaaattgagactgtttgccaccaaacttaaaggcacatttaaatgatgtacttcaggaagaatgagacgctcccagaaagaaagtctgaaatgcaatgacgtttggcagctaaacaaaatggtaaacatatgactaatctaaatacatattaagcagatactgataattacacaatctgtgaggttaaaaacagagattgattcaaaatattgtatcccagtagcacacaagctagaagcagtgatcaacggaggaaaaccattctaagacaaggtctccaacccctgggccaccaacggatatgttaggaactgggctgcacagcaagagttaggagccgtgggcaggcaaatgagcgaaacttcatctgtatttacagctactccccactgctcacattaccacctgagctccacctcccatcagatcagcggtggcattagattctcataggagtgtgaaccctattgtgaactgtgcatgcaagggatctaggttgcatgctccttatgagaatctaatgcctgctgatctgtcactgtctcccatcacccccagataggaccatccagttgcaggaaaacaagctcaggacacccactgattctatatgatggtgagttgtataattatttcattatatattacaatgtaataataatagaaatgaagtgcccaataaatgtaatgtgctggaatcatcctgaaaccatccccctgcaccctggtccatggaaaaactggtccctggcgccaaaaaggctggggaccactgtcctaaaatctttgtgttattcagaaggatggtaaatagtccttcactgtagactgttaagtatatataaacaatttccaagataatcattaaaagaaaagaagtataatacacatctcccaaagctgtaaagaaaaataaatggaatacaaaagcaaatgaaaaattgtagctgacactgtcctttgagcaaacagaggtttagaattagtcaaccaataagcctcttgagattttccatgagagcttaggatggtatttgactgtttagaagaggcacgcgagtggctgtctttttgatagacaaagaggacaattaaacggaaggaacagttccttaggcattcctagttggagctgtaatttatgaacatttgatacatccccgattattcaaatattttgtattaatttttaaatctgcacccaatttaaaagttccatgggtagcttcagcagggaaaatggacttttgatggttacatccttctctccaccaccccatctcctgcccccgaatcctccactgcccccctcgctgtctgaatgatgcttatgggagcacctgacggccaggcagggcagtgctcctgtgtccaggacgggggctgctagtggagactgcttagacattttaacagtgagaaaagatattttatgtttggaatttaacagagattttggttgatagcatgagggctccctttagccctcctgatcctctaattcaacgagaaaatttccctcaccatttctccccagtcacagtttctttgtatttttccaaaattttaactgagttatcggttgtcttcttcagttttacattgtaattttggcagataatttctttggcagataatccaggagataataactcctggaccagcggattttaccaagaggttctcatttctttggttctagagaacagccgcaaaatgtcaaatcctctagtctttctgaccagctggatgccatagttgttgacagactgctgcctagaagtaaaagaattcaaaagaaatcactcatttctgcatctcaacagttacaaaacaccaacagcccccaaattacagggtgttatataagtcaatgaaccaagcatttgggattctacagaaacactgtctcagcgggtactggcttcctggcctgaccattatataactattatccatagcataattgaggtgctgtatatttgaaataaatgataaaaaaatgctgtagattatccgtttttcttagccattttttccaataagacatagcccacagggccctggataattaacctaggcctcctccatttttttgccaggccatttagactttctcctaaactgactactggcctgagggagggtgtggagatgggaggagctggtcccattgggtggacactgtgtcgagttgggaggagggtctgtggcctccccacaagaaaggcaccttctctctgcagctccacccacaccctttagagggagcaagaaaaggaagcagtcaggcaataactgaaccccactggcctgcagggcagccagtcagtgggcagacataggggccatagtgggccagggccccccattcttaggggcagacataggggccatagttggctgggcagggggtcgggggtggagggtggtgcagggtggagggagaaaaggcaattcccacaggatgacctgcagatcctccaagcatctgaagattgggagggaccgaacatttcacccaggtcaatcattcttgcctccccacccagagttcaaacttctgataaaatattcagttttagctcaaatacttccaatgtcctggctgctcccattcgggggaccactgggatggcagagcttgagaggattaagacttgggggattaagaaatggagccaggttgcagtggccctaggaagaaaagagagcagagggagtggatgtgggaggaatcagggcttctgcagtagaaaaggaagtggattaggaaagtgttccagaatatgggtgttcccaatgcccgaggaacaatgggtaggtagagacacaggcctcaggatcccaggtcggcagtgtggctgccaggatgccctcgtgttttccagcctggaatatgggtagcccaaggcctctttctagtttcctccacacccctgcagaggcacagtgaggttcatgtggccaagcgctccaagaagcagtgcagctatgactttacaggggaggtgatgccagcaaaggcatgacacactccatgggggcaaaggttgccaggacaacctctgcaaggacaacctctcccacagccagggtctgaaggggataaaagaagctctctgagggctaagagtgatgtgcctgggaaaagaagtgtggtgtatgctaggccagtgcccccgaacccccagcactggggctactgtggtacatgggaagtccacccgccaacttggctgcaagatgcccaacccttttcagctcccccaaccactgagccactgcctcagaaagagcttcaggtcttttgagtgcacccaggcgagtggggaagacaaagggtaaatgagtcccttcttccaatgagacccagaaaagtagcaaggggtctgttagtcctagaatggcagaggtgggatgggatctgaggtcctgcatcctcagctctctatcagtgtttgtcagagatacagggacatcccctgtgcctgcaactcaatgaggcaccatataaataatacaaagggcagggagaggttgaagatgcaagaaaacacttaagttcttctctttctctcctctcttcattggaagaaatataagatttggatcacaaagactggaacagacttaaagggagaaaggacaggacagattaagtaggggtgaaattttaaggcaatatgagaataaaaaagaaacgtaaacattcagataagtaataggcagctcagacaagagtgaaaaagtgaagaggggaaaatatttgaagaagtagttcagatcagtttcccagaatgaaaagactgacctcagatttaaaggactcgtagagcaccacaaaagagaataaggaaaacctcacctacacgtactaaactgaaatgtaagagcatgaaaaaaacagagaaattctaaaagcccacagaaagaaagaaagaaagaggctatatgaaagaacaagaatcagcttgatatcatctttgttaacagcaacaatggatgcaagataactggaatcttattttcgacatactgatggaaaagaacttaaaaatgtagaattttatatccagccaaactatcattcaaataagatgagatgatgaatttcctcaggcatacaagtgctttcaagattttgtagaaaaggtcacattgaaaatagttttgaaaaactaactaaaaagtgaaggaaattcaagagatattccaagaaattcttgaaggaaaaatgactttataccttagtagagttgttatctttacaaattgataagactaacaagaaaaaatacatccttacaactaagaattaaaagttagttaatgccaatattaatgggttggcagaagatggcaagaacaaaagatatgagagcatagtaaagttcttgtcttattagaagatatttgtagatatcaaactggtttaaaagaagctcaaacctaagacctgtaattagaaaacttctagaagaaaacaggggaaacactccaggatgttggtctaggcaaagagtttatggttaagacctcaaaagcataagcaacaaaatcaaaaatagacaaatgggactatattaaactaaaaagcttaggtacttcaaagaaaacaacaaagtgaagagacaacctgtctctgatcatttgaatattggccaaacttcacctgatgaggggctaacacccagaatatacaaggaactcaactcaacaacaacaaaaataattccattaaaaactgggccaagaatctgaatagacacttctgaaaagaagacacacgaatagccaacaggtacatgaaaacatgctcagcatcactaatcatcagggaaatgcaaatcaaacccacaatgagatatcatctcatccaagttaaaatggctattataaaaaagtagagatgctggcaaaaatatggagaaaagggaaccctgtacagaaaacagtatagagatgtcccaaaaaaactaaaaatagaactaccaaacgatccagcattcccactactggatatttatgcaaaggaaaagaaatcagtatatcaaagtactgccatgtttactgctgtgctttccacagtagcaaagatatagaactaaactaagtgtccaccaatggatgaatgaataaagaaaatgtggtctgcatacataataacataccatttggccataaaaaagaatagaattttgtcatttgcaataacatgaatggaactggaagtcattaagtgaaaaaaggcaggcacagaaagataagtgtcgcatgatctcactcaaatgcagcagctacaaatgtggacctcatgaagctaaagagtagaatgatggataccaaaggctgggaaggacgtatgtgttgcagggtggggttgggggtgggggatgatgagaggaaagtcaatgagtacaaacatacaattatgtagaaagagtaagttctaatgtttaatggcatagtagggtgactatagtcaacaatgtattgtatatttcaaaatagctagaaaaggctttgaaatggttccatcacacatggttactcctcgaagtgatggatatcctaacctaacctgatcattatctactctatgcatgtaccataatatcccatgtgccccacaaatacgtacaaatcttatatatcaataaaaaagaaaaattaaaagaaaagaaatagactgagtggggctggtggccctcccacctacactggcttcagcactgacttgacccagtggtattacctgcaaagaggtgcccacgcaaaactgcaaagccagagtggtttcccagtccctctccctggccctttatgagactcctccttccatctcccttgtgtggccccatagggcttgctggggtcagcaccctgctcaggccagcctgtaatgtccagagtttgttcccaaatcagaactagcattccttgaccatcttcatcaatgatctgaggaaagttaagtcacactgaggttaaaaagtcaactgcattttaagagattagtagcacagatgaaagggactaacaggcccctttctgtgtggggaagctttccttaattacctcattcaatccgcagaaccactattagagaagaagaaatgcctgctattaagggttaagtaacttgcccaaggtcacccacgtctaagtagcagaggggagattcaaattccatctctctggttccaaagcctatgttctttccaaataaattcccaaaagacagaatgagtgagaggactctctttttcaggatggaaaggctcttcatctgtcagtgacttccgcttcacaatattttgcgtcccgtagccccctacttcgtccgtagtgaaaccaaggcatgggattagtgttgcagccacataccactctctggcaccccagggaaatctctgtaacagagtctttacttggaagaggggaacgtgggttggcacaagaaaagcacaatcgcaaatcacgaatgtgccagccccaagtgcttgctacatcttgactggtacacaatttcctttctggagtgcccacttgagatgcttgccagcaggtaccaatgaaaccaggataactcacaacagcttctgagggaaaatgggaggatttaaatcagtgtagtacatttagttgttcccatatgaatgttcttaaaccaaaatgctaactctaagattatttagaattaactaataatatatactacctttgccaaaagtaacttacccccaagataacttatccaatgggggtaaaaataacaaacgaattaaatataatggctgcatgcttttcatgaaatgaattagattctcaaagtataggcaaaaaaatatagtcatggatagacgagaaaatttaaaatgatgtaaaaaattaaatattccatctaaatctaattatgttaatacaataaaactaagttgaagggatttagtgagggaagtggagttcagaatctcacataagttcacagttaaaactctaagaaatatgtcacattatttactgttttcaaatttaatatatcttcagctaaccatgatattcagagacaggaatgtcatagttttctgaattccctggttaatattgtaaccagaaaccctgcttgagttcaatccacctttttgaaaatctttcaaaaatttttctttgttttcttgtcctagtaaatacactgtactcaccagaaatctttattccagaacctcagaattattgtaccatgttgtttgtagaaagtctatgagatagggctaaatttgtagcaaccctggaacacagcctgttgctttttagataaatgtctgataggaatacactgagttgtgagtaaactcttccaagtagaaatgtgggaagtaaaaccaagggatctatttgaagtttcagtgagtcccatctcagtaaatcaaggccccctcaagttttccaattcgattaaatacacattgtctaagcacctacttgacatggaggcttaaaaaaataggtataatccttgcacgtgagcagctcagaaaccaggataaacaaatagctgtcattgagtctgtcacatagaagtatatcaagtgcagtcaggataagtattaaattggatgaaggattaagaaggaagaatgggaaagagcattagggcagatggcacttggattggtctagaaaacgtgtaagagatttctggacagagcaaagggggagaggccattctggaagaaggtaataacactgataaagacatctagatagaggtatctagatggcacttacagaagtagtaatttacccaaccatgtagaccagagtgtgtggtgtgagaagcagacaggatggctgtgatgccagaaatggggactggaatgagttagtgaaaagctggatatttcatgctaatacagcttgtctgaatttagtgagcactggcaagctatcaatagctttcatgcccgagaatggggagagtcaatttgtgtttgggaaggtcattctggtaagagtgtggtagatggcttgggtggggcaagactggagaccaaaagatgtattgggttatggcaagtggctgtttagagattatgagcatctggactagggctgcggcagcaaggatggaagggaagagagagatcagggcacctttttgaagtaagatcaaaaggacttaccgattgcctgatttagatggcagggagtccaagtgggtagatggatagttttacttccataaaataaggaagacagaggatgaagaggcttagaaatgagattattaatttgaatttgcactagataaatctgaggtgcccagagcgtgtttaaatggagatctctaggagggagttcaatcatgaatcccaaaaagagcatcttaatgccacacttaatgactcagagaagtttaatggccatgtaatactaaataatacaaatattcaacatatgcaatatgcaaataaacactgagagaccacaaaacccatttggcactcccaactgagaagtttgaagatgtacgtggtgctttgtttgtgatccaggcctgattccccactatctcaaggctctactgaacccctcttaactttacccgagcagaaccccatgaaacaactgcctttgctgcttttgctggctccaattgatctcccagttgaggctcaaacttgttgattccttaacaagaaaatcatggtgacccagttatgtgttctgtttagtggatttcatctttctctgtctattttcaggtgctgactatgtgcagctccccagtcagttcttcaaggcctgcagatgcccagcctctaaccaactctgcttctttctacagcgcattctgtattcacacccattagactccatgggctatggaagtcattcccctgtgcgtgtgtgctgagttcaatctcagctccttgcctgggtacagccctcactaccaatgaccatgcagatgtactagattgtttgctggcttaaaaaaaaaaatagcagctttcttatctgagcatacaaaggagttttatcgtaaacattcaagcaccgtgtataatcaaattacccataaaaagatagggagggtcttttcattattgctgtggtcctgctgttaaatcgctttgaaatgaggtgcagtgaacgatgggattccttcgaggattctgccatagcggccccgggatagagcacgttggaaaattgatccagtgtaaagcaagatttgttaggagatggagactagtgaagccaaggacagaagatcactggctgaatcacttgttttcttgtcatgactccaattcagtggatttcaatcctggctgcagatcagagtcacctgggcaggttttgtttttccccaaaatactgtgcctgggctcacagtcccagaaattcagtaggaccctccccatcccccatccatgtgtacttttagaagaggcatcattctggtgccttttacacctgacacatgaaacactagtgaccataaacatgctttcatttaggcaacgtgtgaatacccagagtatacaggaaggagcggggaatgcggcctggatggcatggggtggactctaggaagcaatgacacctttcagagacaaccctcactactcgagggtttcctgggtgtttctgaagctgcaactgggatcaggccttagttcatgtgcctcaagtacaatgtagtccttcccccacctctctccccatctaaaaaatatcaccaaatctactcagagacacaagtccacctgtaggagaagaggtggaggcacatattcccaatcctgggctaacaaggcctaggggtcactgtagtgggtcgggagctgtgaatgttgcagggaggatttaaccggaataacaaggggtgttgtgtccctagggctctgtccctctttccccatccaaagttctgtcatggaaatgatgaatgaaggcatgggacctttgctgtcaagccgtcttagctggggacagtgactcccagggccaccatcagtgagcatgcctgggacccaggggaagggaagctgctctaggacctcggctctgaggacacacagatcctgctcccagtggtcccaagcctccagttgtgatccctatctgttgacaatctggactcagccccactgttacaaagaaccatcccctgggcaggcacggtgattcatgcctataatcccagtgctgtgggaggccaaggtggatggatcttttcaggcccggagttcaagacaagcctgggcaacataatgagaccctatcttgaaaaagagagagagagagaaagtgaaagagaacaaaggaaggaagggacggagggaggaagaaagacagaaagaaagacagataggagggagggagagagggaaggaaggaaggaaggagggagggagggagggagagagggaaggaaggaaggaaggagggagggagggaggaaggaaggaaggaaggaaggaaggaaggaaggaaggaaagaaggttggtttaaaaagaaaaagaaaacacaaccatcctctccaaccagccccactgaagtggatcctgcccatccaaacaggatgaggcaaagtccagcagacttgagccgataaggttcaaggacaaggcacaggacgtagagtcatattccacaacatcctctccaaagcctctgggctaaaagttttacatcttgatatcatccaacgatgtaaaacaccacttcaacttccatgaaggccaagttgactctgtgagctgctatttctgcaaatttctcaagtggtttcctcgggccctttaagggagccaacagcttctgcatgagaccagtcatctcttcattaaccagtttagattcccttaaagccactcttaggttttcttttgggttgtgtgcttgtagatatcatctagaggtttgggaaactggttctaagtgggaccatatagtcctcagagttcggtccagtcgagagaaggggcataaggggagggagtgaagccatttagagttagagaggccttagagagtacttggcccagtctttcatttcagaacagaggaaacagagacttaaagaggttaagtgtttgttcagaatcacttcaaatgttgatagcaaaaacagggcgaggacttcaggagcctaactgtccaccccaagttccttctggttaatgcggcacatgtggtttccaaggaaatcagtcaactcttcagcaggaggaggcgaggctgcagagcagaggttacttacggtggtgcaggcagacacaccatcgtggccacaggaaacgagtgcttcaaatggggctgctacaggaacaaatagcaaggacactggcgtcagaggtggcgtaggacagcatgtcacaaagtgacaaatggatggcccacgcagcccgcgttttgggagctgagaagaagcaatcactgggcttaggtggatggaagttatcaggtaagtttcgtcctccagtttgcaggcatgaatgtgtcatgctcacttagaggtttacgctgcatttttacgtgatactacccaggcagcagaatggaatttaataaaaaatgagaatcgtagttgaaaaggcttcagagtattttgcatttacaattgcatttcagaagtctgatttttctaacctgattgacacaaaagcatattgagttctgtgagttctatttacagatttgcattaatgatgattaataatgtctgctatttaagtcagattttgtgtaaggagtatgcaaagaatgagctgttgaggcagcaacctgattttgttgtttttttcaccactgcatttatccattctttaattttttttttaattatttgagacaaggtctcactctgttgcacaggctggagtgcagtgacacgatcacaattcactgcagtctcaacctcccaggcttgagcaatccgcctgcctcagcctccagagtagctggaactacaggcatgcaccactatacccacctaatttttttttattttcttttagagatgaggtctcattatgttgtccaggatgacatttatccattcttaatcatctcttcatttttatacaaagccaaagttcacattattactggggcaaaatttccccccagttttccccctagttagcaatcagtccttcccttccttccttccttccctcccgtccctcccttccttccttctttccccccagttagaagtccttcctttcttcccttccctccctccctcccgtccctcccttccctccttctttccccccagttagaagtccttccttcctacccttccctccctcccttccttccctccctcccttccttccttctttccccccagttagaagtccttccttccttccttcctctccctccttctctctttcttcctttctttcactcctctcccctcccctcccctttcctgtccttttttctttttttctctttccttttctttctgagatggagtcttgctgtgtcgcctaggctggagtgcagtggcgtgatctcagctcactgcaacccccgcctcccaggttccaacgattctcctgcctcagcctctggagtacctgggattgcaggcacgtgccaccatgcccagcttatttttgtattattagtagagacggggtttcaccatgttggccaggctggtcttgaactcctgacctcaggtgatccacctgcctcagcctcccaaagtgctgggattacaggcgtgagtcaccgcgcccagcagaagaatttcattttaacatgcaaacacctcaacaaagccaactgagcctacttctaaaaagcctccagacatatcccttcctctccagtcttgctggccactgacctctcccaaattctcatatgcacttaacattcattttacagcaacaacctcctaactggtctttttgcctccagaaaaaaaaaaaaaaaacatattcagcaactaaaacaattaaattcctaaaggccaatagattatatattctacactgcataggtgtaaattctgtgccatatattcaaggccagagcagagtttgaggttatagcctggcagaaatttcagaaatgggtattcccccaaggaaggtttaaattctgcgtttgaagtccagtaattttacctggccttctttttattcagatgaccaaccagcactggagatttactagcccgtgtgcaaatttttgtcaatcccacttgtcattagaaatcccacatgctacagagagaatgcgatttgcagataactcgaaaacataagaaacccaaacacaaatcacttaatcggagaaaacattactctcttaaatttaaacagttttttttaaaagccagatgtacttattgtcatttccagaattactcttataagtatctggttatcataaccacagaaagacagtttattagttttaactgctggataaaagcatgtagcattttcaagatttctggtttcacccttttaacccaaagagtaactataaatagatggcaaagtctgggatttccacagctaagtgctgctataaatagttttaaacattttcccacttcatgctttcaaaaagaacattctccacttcctttcttggataacctctgggaataaagtgaatcacattcagaattttattaagggagtttaacaaaactattttaatgaaccttttagcaactctaaacatatctcagacgctgaaaaaactgagaataaaatgatttaacaaatgtgttaatttaaatagatatttaaattgaaatagatatttttgacaaatgcatttagaaatacatttctaaccaccgaagtggtgactaaacgaaagaaacatatttctttcaacattccttccatgataacatctagaaaaaggggtgtgaattcatgcctgttgtcaggtatccaggctgacttctttctcagggaatattcataagacagagacacaaagagatacaaagatcctcagttctttgtgaaatccctgccatggatcgctttcccaagggacatgcctgtggccgtcaaagcaaagcgagcactgtgcaggaccgtcccatctctccacagcagaaagattcctaatgcctgccttctagcaacctctgctggtagttatttctgactgggaagaaagtagaattagccagtcttccccatggcaggaaaattaagcaaagaaaaaacagccacgaaaacaggtcatatcagtgaaacacatgtttctgttttatattttaatgaaaagggacaatggaaggattataaatgatttttaaaatattcgtgttttctaaaaaaaaatagctatttttgagcagttttaggtttaaatattgcacaaaaggtatagagcgttctcatatatcctgtcaccctcaattttccctatttttaatatcttgcaatagtgtagtacatttgttacaattgatgagctaatattattattattaatgaaactccacagtttacattagggctcactcttatgttgtacatcctatgggttttgacaaatgtataatgataggtatccgccattataatatcaacaggaatgatagtttcactgccctagaaattccctgtgctccatccatgcaccatcttcaccacaacccctggcaaccactgatccttttactgtctccatagtattccagaatgtcacatatctggaattctacagtagcagcctttttagattgtcttcctttattcagtaaaatgcatttaagtgtttatccatgtctatacatagcttgatagctcattgatttttagcactgaataatgcccattgtctggatgcaccggagtttctttacctgtcacctctactcaaggatatcttggttgtttccaagttttggcaattatgaataaggctactataaagatctgtgtgcaggtttttaggttgacatgagttttcagccctttggggtaaatgccaaggagtattatttctggatcgtatggtgagagtaggtttagttttgtaagaaactgccaagctgtcttccaaagcgtctgtgccattttgcattcccaccagcaatgactgacagttcctgttgctccacatcctcgccagcctttggtgttgtcagtgttctggtgttaattgctttagtttttcaatatgtttttgtctcctaggtatgtagtggtatctcacggctgttttactttgcatttctctcatgatatatgttgttgagcatcttttcatgtgtttattgccatctgtatattttctttggtgaggtgttaagatcttttgtcctttccttaatggtttgccttcctattattgagttttaagtgttttgtatatattttgggtataagtttttatcttatatatactttgcaaacatagacttttttcccctaaatcctgaatatagtggatatcctaaaaaacaatccttcttctttgtttccttcattcatttagtcattcagtcggcatttgttatgtaacctactacaaatactaggtgccaagagtacaggataaaaggatggtcctgacacttaaggagctcatcctacagtacggaatgttaagaaagtatagatatgctgcaagaagtatcacataaaccttgaggacactatgctaagtgaagtaagccagtcacaaaaagacaaatactgtatgattccactcatgtaaggagcctagagtagtcaaattcatagacagaaagtagagcgggggttattaggggctgtggagaggtgggagtcaggggttgttgtttagtgggtgcagggtatcagttttgcaagatgaaggaggttgatggtacaacaacatcaatgtgcttagtgctactgaaccgtatacttaaaattggttatgatagtaaattttaatttatatgtattttgccacaaaaatacattaatttaaaaactaactgttatgcagaagtgtggataaatggcacaggaaaacaggtacaggagagattaaacttctacaagatgtatataatcacatagatcactatactaaatacggcaagagcttcaggtcaatttgtcttttattctttaaaaggttttctggggccgggcaccgtggctcatgcctgttatcccagcactttgggaggctaaggcgggtggatcacgaggtcaggagttcgagatcagcctggccaacatggtgaaaccccatctctactaaaaatacaaaaattagctgggcgtggaggcgtgtgcctgtaatcccagctacttggcaggctgacgcaggagaatcgcttgaacccgggaggcggagtttgcagtgagccgagatcgtgccattgcattccagcctgggtgacagggtgaggctccgtctcaaaataaataaataaataaaaatataaataaataaataaatggttttttgatataagtgcaaaagatgagacaaagggaatggcacgctagaacctatactagggacggaagtggaataaaaagcaaaatgtatgctttgaagatctaaaatctgaaaattgagcaagctttcttgcatccaacatgacagcagaggatcagttgaacaaatccgtgtccaaaagaaaaaaagacaagccattcgcttagcggaggaaaacttatcctaattaaaaacaaaatcccaaccttgaaagagccacagatcttatcgtgatcttactaccgttataccaacattcatgtcattaaaagcaattatctggagcaattatccaactatatacatatatatgggcaagaactagaagaaaccagagaattaagaaaatagtttgacactgatatattcatctaatattatacttagtgtcttctgtgtgccaagcacagtcctgggtgtcagggacacagcagtgaacaaaacagataaaactccttgccctcatgtggtttatatgctaatgtggaagacagaagataaactacatagataagggtggtaggttgtcttcaaagatgactgccaacaattcctctaattgctgcacacacttgccactctccccatcaagaggtggaatctatttccctttcatttgtatctggttggccctgagacttgctccaacctataggatatgatgcagtgcacacatgccttttacaggaccagctcctgagagacctcacagcttccacactccctcacttgaagcctagagtcatcaggtaagaagtttggctgtcctgctggagggaagagactcagccagcccccagctgaagtgcagatgtctgtgtgaagccaggtgggtgtcccagtcccagctgagcttccagatgaaggcaacagcgttgtgactcccactggcaccatgtccagcagaacgaccatccagctgagcccagtcaaatcacagaatcttgagaaaccataagttgttgttttaagcccctaatgcagctaactgaaataataggctaaatgtagtgtaggttcattactgataacccagggcagtgctagagcctgtgagtattgcctcacaagaggcaataaattttcaggagttctgtgagccattattaagaattacattatataagcttataattacaaacatttaaacaaataatattcaaatatgtgtaactattttactactatctcttcttgaggttatttgcatgcactgggtctgcacagtggaaataccatgtcacggtacgctactgtgcatctcttcccacctccatgttcagccatggtatgagtatttacaccagggaaactagcaagctctataaaccagagcttgattgttttcttgtttctctggacttaagaaaatgatagagaaaaatgttaccgtggattaaacttaaaagtgtattatggcagggtgcggtggctcatgcctgtaatgccaggactttgggaggccaaggcaggcggatcatgaggtcaagagattgagaccatccttgccaacatggtgaaatcccatctctactaaaaatacaaaaattagctgggcatggtggcgcatgcctgtaatcctagctacttgggagggtgaggcagaagaatcactagaacttgggaggtggaggttgcagtgagctgatatcgtgccactacactccagcctggcggcagagcgagactccatctcaaacaaacaaacaaaaactgtattatgtctataactgccacattatgaatagcacaaaaatttgaggaaatattcttccagaaaagcatcaatcaattcaggaaacaaatgggtgaggttttaatatacatctttgtagccattttactttggtcttcctcataaacataaataaatgcagcaatcaacattcatgctggaactgtattcacttgacaattgaaaccagaggttggctacaagattactgcaaaaattaacaaaaatgctctatgagaattaattatttggaacttataagacatacagtagggagtagtgggtttttttaatttataaattgatgccttttctatcagtaaaatttataataagcttattccccagatatatatgtgtatatatatgtgtatatatatgtatatatatgtgtgtatgtatgtatatatatatatgaatgtcttcccctgccctgctccactccccccacccctgctccaaagaaccagtcgttaaacagttaccagcattcttccggttatttctcactgcagtacaacctagcctctttagcctatcttcactgatacattagtaaatcaaatagagtgacttcacctagttggtttctacttcatctcttctcaaaccacatttttgttatgtttaatgtgttttatgttcagcatattacatccttctctttagaagcctggtggaagtatttctttagtggcaggtgacgtggtgttctggatttcaaagcatttccagtgatgctgtgccatgctacactctaaacagccacttctcactccccttcctagcgcctcggggccaagcatttgctccctgactcctgagagctgagggagcctctttttctataaaaacagtcttattcgccacattcagggcactagggtctggacagtcattcccaacatggtcagtctctatgactctatcaattaacatatctctggaccctatgatgggtttttgacagtctaagagattactcacatgtattagatcagcagacattcaaataagcataaaagaataaaaataagtgaattaagatataaatgggggtgtaagccattacatctgttttacacatgaacctgcaaatcgggcagggctctgggggctggctccttgggttgacctgcagggctggtggtgggatcatttacaggctcgccccctcacatgtctggtgcctgggataggaagactcaagcatacagagttgaagggaagaattaaaccatttctaactttaattttgtttactttcccacactgcactgatgtacatactttaaatttagaagaagtccaatttacctatttttttcatttattgccagtgcttttggtgtcatttccaagaaattactgccaaatccaatgtcatgaaggttttcccctgtgttttcttctacgagttttatagctttagcttttacatttaagtctttgacttattttgagtcaatttttgtatgtggtataacggaagagtccaacttcattcttttgcatgtggatatccagttttctcagcaccattaataagactaccctttccctggagagggttttttggagcccttgtcaaaaatcaactgatgatatatgcagtggcttatttcttggctgtcttctctataccattggtttctctgtctatctttaagccaagatcacactgtttaattaccatggctttgtagtaagttttgaaatcaggaactgtgagtcctccaactatagtcttctttttcaagattattttagctattcagggttccttaatattccatatgacagacaggtggagtagtacacacctgtaatcccagctattcagtaggctgaggtgagatgattatttgagccaaggagttcaagtccagcctgggcaacatagtgacaccatgtcttataaaaagagagagagtgacagagagagagagagagattttctgtaaactttaggatgggcttttctgtttccataaaaaatacaggccacgagcagtggctcactcctggaatcccagcactttgggaggccgaggtgggcagatcacctgaggtcaagagttcaagaccagcctggccaacacagcgaaaccctgtctctacaaaaatacaaaaactagccaggcatggtggtgtgtgcctgtaatcccagctacttgcgaggctgaggcgggagaattgcttgaatccgggaggcagaagttgcagggagccgagattgcgccattgcactccagcctgggtgacagagactccatcttaaaaaaaaaaaaaaataccattgagagagatttcattgaatctgtatatcccttcaggtagtattcccactttagcaatattatgtcttctagtacatgtacatgggggtaatttttcatttacaatttcaatattttgggggttttcagtgtacaagcctttcaccccctaggttaaatatattcctaaggattttagtctttgtattgtaaatgaaagttttaaaatttcctttttagattgttattgttagttacagaaatgtaactgattttttgtatgttgattttatgttgtgcaattttgctggacttgttgattggctttcattcaaaaacgtattttgtcttcatttctgaaggacattgttgatgcacatagaattctgggatgacagagtattgttggaggaatggggtttggctgcttgtttttttctttcagcacttagaagatgttccactctcttctggtctccacggttccagtgagaaatcttcaaatttttcttcccctatatacaatctgttgttttcatctacctgctccccatccctcttcttcttttcctcttgcagttattgtgtcttggcacaatatttttcatgtgtatcctgattagggttcatggaagtttgtttttccctgaatttggtaagttttaagcatgccattatgtttcaaataatttttccacacctatttctcttctcctctgggactccaaggatataaaggtgaaacgttttgatattatcccacaggtccctgaggctctgctcattttgttttaaatctttgttctttctctacttcagactggataatttctattgatcattttccactgtttctctgacacctccattctactattaagcccatccagtgaatcatcttcttgcactatgttgtatttttcagtcctaaaatattcattttgttcttttttatagttttgattttcctactgaaaactcatttccattttttcatttatttcaagtatagttataatagctctttaaactttgtgtgctaatttcaatatctgggtcatctcatggttgccatttgttgattgtcttttcccttgggaaatgggaatagttttctggttatttgtatatcaaataattctgcattctatcttggacatattaatatgttgagcagctctgggctttgtgtgatcatgctgattttttgtggtttgttttgcagcctgttttggttcagacggcaagttcctttttgctttctgtgggcggtgttttctatctcagttctccaggcttttcttatgcttctctgggtctgttctgtgcactcacagctctggatgagctcgagagttggctagattcatacacataattagggggtgcccttctccaatgcacttctctctgagatgtcccccacatggtctgactcccagaagccccttttcctggttcctctgatcataatgatagttttatcttggggtttcagctgcccccatcatcaccacagtagtatagctgtgcaaggtgagctgcccttgtggctggaccaaaatagaaaaaaaggaagaaaagaaacgtaaatagggacttcccatcccctgcactcttgacttgtttttctgtggtcagaaaggaagggtttctttctctttttttttgagacagagtcttgctctgtcacccacgctggagggtagtggcatgatcttggctcactgcaacctctacctctgagattcaagcaattctcatgcctcagccacctgagtagctaggacgacaggcacacgccaccacaccaggctaatttttgtatattttgtagagacagagttttgcacggctgttctcaaactccttgtctgaagcaattctcctgccttggcctcccaaagtgctgggattacaggtgagagccaccacacctggctgaaaggaaggggttctcttaagagtttttgctctctgtgtccactgtgaagctctatagttcatgctgcaggccacccttgtgtggaaggcaaaagatgaagaaagaaaaaaaacttggaaactcactggtattggtcatttttcaagtttttatttctctcccctgctgttgtttacttttcagagtcttcaggtagatgctttttgttctcaaaattagttgtaatcagtggaagagttagcgactaaaatattctcattgaatttagaaaagagttctggtcaatctcactcactgggctgttagctccaagaaggcatggaccatgtctgtgatacatggtaaggtcaaaataattgttaagttaattaatattgggcaaagaaaaatgaacaacaaaatattgaagtaaatttttgaaaactttaatttaggttcagtggcacatgtgcagatttgttatataggtaaactcataacacaggggttcgttgtacagactatttcatcacccaggtactaagcctactacccaatagttatttttcctgatcctttccctcctcccactctttaccctcaagtacgcctctgtgtgtgttgttccccctttgtgtccatgtgttctcatcatttagttcccagttataagtgagcacatgtggtatttggttttctgttcccgtgttagtttgctaaggataatcacttccagctccatccgtgttcctgtaaaggacgtgatcgttctttctatggcttcatagcattccacggtgtatatgtaccacattttcttcattcaatctgccactgataagcatttaggttgagtccatgtccttgctattgtgaatagtgctgcaatgaacagttgcctgcatgtgtccttatggtagaatgatttagacttctctgggtatacacttagtaatgggattgctgggtcgaatggtagttctgtttttagctcttagaggaattgctacactgttttccgcaatggttgaactaatttacattccgacagtgaataggcattccttttcccccacaacctcgccggtgtctgttatttcttgacttttaataataaccattctgactggcatgagatggtatctcattgtggttttgatttctctaatgatcagtgatactaacttttttcatatgcttgtttggcggtatatatgtcttcttttgaaaagtatcttttcatctcttttgtattaatttttaaaaacactttatgtaaacagaatatatgtagtgtgtctaagtgtgagataatgttgtaggagtgatatatcttttgcttaagacttgcaattaatggcaaaatttctgtaggcacaccatggtttagaaagatttaaatgggaggaatttttttaccgttgtaatattaaataataaagctcttggcagaaaaagataaatctgaaagtaatatactattgaggaaacaatagaaattggcatggagttacaaaagagaaagaaaatcatttaaaaatccaagtttcaagttttgataacaaaagtaacaataatgtgccgtagagaaaataaaggaagcaaggaaccttattatcccctcttaacaatatgtgacacaagccttgacagccgaagtcaatggaagctgtacctttgaactcttctttgaggtatcagtgcctgtccaaaggagacaaagccatcagaaagacatggagaaggccgggcgcggtggctcacgcctgctatcccagcactttgtgaggctgaggcaggcggatcatgaggtcaggagttcaagaccagcctgaccaacatggtgaaaccctgtgtctactaaaaatacacaacaaattagccaggcatggtagcacacgcctgtaatcccagctactccggaggctgaggcaggagaatcgcttgaacccgggaggtggacgttgcagtgagctgagatcgcgccactgcactccagcctggccaacagagtgagactccgtctcaaaaaaaaaaagaaagacatgcagaagcccgataataaaacggtcgcaggccaaggccagagacacatatctggggtcatctgtccacagagagtaacattacataagatgctgttgacatcttttggcagaggcgaagggggattatcacgggggtcccctcgtaggctggaagagtgattgatgttcaggcgcaaataactatggctcattccagtggtttgtctccagtgttttctttacagaaatgaaaggaatcagggcaggggacatttccaaaatatatatctttcaacagaaaagaataatttgtttaaatgacagaaattattagaagattacagaagagagaaatggtttggttaaatctttttttttttttttttttgagatggagtctcgctctgtcgcccaggctggagtgcagtggcgtgatctcggctcactgcaagctccgcctcccgggttcacgccattttcctgcctcagcctcccaagtagttgggactacagtcgcctgccaccacgtccagctaattttttgtatttttagtagagatggggtttcaccgtgttagccaggatggtctcgatctcctgacctactgatccgcccacctcggcctcccaaagtgctgggattacaggcatgagccactgaacccggctggttaaatcttaagggtctcattgtttcagaatttttgaaatgatttataagaaaaaaaattttgaaaaataaagtgattttcaacacattttaaataaagcatatagatccctgaacactaaatatgaccacactgttaagtattaaaagtagtgttgaaaaataatattagactataaaactaaaagctaggagtgaaggaaaaaatggaagacaatttaatgtttttaaaaggcaagctaaatgcaaggggtttattggattggtgcccggaccatccatagcgaacggcagcaagtatcattcgatcatacacagaaagaaaaataggtggtgagtggtggaggtgaggagggacagctggcagtcatgacgcctgcaacacacttccccagagtatcataaggaagctggaagcaaagccttctacattcctacacccctggccgaccgatcgaaaggtcttcaaacctgtaattgtacactttagtttgcaaggcaatcaaagactggatttcactcacaatagtctttcaatgtgacttttgtcctactggatatgctataataaaacctaagttacaacgcaaagaaagaaatcaaaacaatcactataaagtccattttctctgccaagatgagtggaagtatatgaagtcaaatttgaatctgcatggaggattgacaatatgtacaaacacgtaagccaaggtgaggacatagtggaggagttaaaggaatggtgagcagtgacctgggaattagaagtcgtggggcttggccccagtgccattggtaccagttgtgggacctaagcagactgtggctcgcttggccttgatgtcctggttgttaaaattataggctggctcaacatcccaacaaccctttctggctcctcttatggtaacttttgcataagtggaaactgcagaaaagagaacacaaagcctctgacatgcagatggcaacgctttaatatcaccaactcagaggttccaaataggcaacaggccctgcaacctaatcaccatcagtaggaagggctagtgggctgagcacggtggctcacaactgtaatcccagcactttgcgaggccaaggcaggaggactgcttgaggtcaggagttaaagagctccctgggcaacacagtgagatcatgtctctacaaaaaatttttaaagttagctgtgagtggtgacatatgcagtcccgtctactcggagcccttgagttcaaggctgcaatgagctatcatcacaccactacactccagccaaggtgacagacaaagaccttgtcaaaaaaaccaacaaacaaacaaaaaacaagaagcagcaggaagaaagaagaagaaaaaaactatactaacacgaaagttgtcaaattttgtagcctggtcaacatagcaagaccccatctctaggggaaaaaaaaaattgccaggcatggtggcatgcaccagtagtcttagttactaaggaggctgaagcagaaggattgcttgagcccacgaaataatggctgtgtgacccgagatcatgccactacactcaagcctaggtgacagggtaagaccctggtctctaaaaaaaaaaaaaaaaagacttgtggatacagctaaagaagtacttgcaagaaaatgtatggctttaaattcatttctgagaaaaaaaggttaaaaatcaacaagcttccaactcaagaagctaaaaaccatcaaattaaatacagagaaagtagaaggaaataaataaaaagttaggtcagctgggcacagtggctcacacctgtaatctccagtactttgggaggccaaggtgagtggatcacgaggtcaggagatcgaaaccatcctggctaacacagtgaaaccctgtctctactaaaaatacaaaaaaaaaaaattagccgggtgtggtggcgggcgcctgtagtcccagctactcaggaggctgagaggggagaatcgtgtgaacctgggaggcggagcttgcagtgagctgagatcttgccactgcactccagcctgggcgacagagcgagattccctgggcaacagagtgagactttgtctcacaaaacaacaacaacaacaaaattataaaattgacaaagtccttgcttgtttgttcaatggggagaaggtgggaaaacaagatcaccaatatcagttatgaaaaagaggacataattacagagataaagaatattataaacaatttttttgctagcaaatttgacaacttagatgaagtgaacaaatttcttgaaaaccacaacttatcaaatttgacacaagataaaataagttcaattgtatatatctgaaagccactaaaacatttaatttttaattttcaaaatcagtgtgtatgtgtgtgtgtgcgcgtgtgtaaaatctacacttaaaaacccttctacagagaaacccaggctgggctccaaaagcttagcattgactttagcctaaagttgtgcctaaccacagagggtctgtgcagcactgacttcatcttggccccccgtacttgcctactcttcacagtcttttgcctcatttcattctttgttttattctactgttttgcatgcatcattgtaagtcactgtgcagcttctttgcaacaaagtgaaatatagtcatgctatacttaaagatggagatactataaacactgtacacttacaggctacattacatttattttttaaaatctatttcttcaataataaattaaccttactttgctataacttgttttaaaactaatttttaaaaacgttttgattctcataacagttagcttaaaatacaccttgtacagctgtacaaaaatatttcctttcttcatatgtctattctataagccatttaaaaacctttctattactttctaaactttttttattaaaaactaagacacaaacacacacatcagctttggcctacacagggtcaggatcatcaatatcactgtgttccatctccacatgttatcccacctccacatgttatcccactagaaagtcctcaggggaaataacatggatggagctgtcatctcctatgaccacaatgcatccttctggatttctcctgaaggacctcactgaggctatttagcaagtgctgctattttcagaaatatgtcttcggtggtttgcttggtttgtttcttttttacatcacagatttgcctgcaaacagataatgcaccatatacagtcctctctattaatgaaaacctttcagtgttgggctctatgttttcaaactttttaaggagctttctgaggtctacaaaagcttctgccaaacccttcattgttactcttcttaggagttcttttttctctgtttcctcttctcttgcctcttcttcagctatgcattcctgttccagttccaacagctcctcattcttcaattcctcaagaaccacctcaaagagctcctctacatcatcctcattcacacctagttggagtcgtttgctatgacaaccacagccttggtttttgcaacctcctcatactggctaatcctttgaagtcatagacaaacctcttgagtgtcttcgtccagattccattcatacacgccttggtgaccatgccaaagttcttgatgcagtcatagtaagggaggagaccacccttcatattgtcttatgcccaatttctgcctccaaagaaagaagtaaaaactaaaaggcagaaatgaaatccacaggcagacagcccggcgctgcctggctgatccacaggcagacagcccggcctggtagttgaagatcgacccctgacctaactggttatctatagattccagacattatatggaaaagcattgtaaaaatccctgtcctgttctgttccgatctgattactggtgcatgcagcccccagtcacgtaccccctgcttgctcaaacgatcaccaccctctcacgcagaaccccttagagttgtgagcccttaaaagggacaggaattgctcactcggggagctcagctcttgagacaggagtcttgccaatgctcccagcggaataaaccccttctttctttaactaggtgtctgaggagttttgtctgcagctcatcctgctacaatagatgttgtaatccttctagagttgcatcagtgtcttctcagcatcttcctcagccacagcaatagcctaggcaaaagtccttctcaggtagcaggccttaaaggcgctataagtccttggtccattggttgaatcaaagaagtggttttagaggagaaacaccacctcaatattgggatgaagatcaccaataaagggagtatgtgcgggagcattaagggtaagcacaatcttgaaaggtaccgtacgttcttctccaaacaatgctggcagcttcattacttcctgctctcccaaagcattaacatgtatgtggttttgggtttccatgtgatatggtttggctgtgtccccacccacatctcatcttgaattgtaatcctcataatccccaggtgttgagggagaaaccaggtggagatgattggatcatgggggtggtttgccccatgctgttctcaggacagtgagtgagttctcatgacatctgatggctttacaagcatcttgcatttcacctgctggcactctctctcctgctgccttgtgaagaaggtagctgcttttgcttagccttccaccatgactgtaagtttcctgaggcctccccagccatgcagaactgtgagtcaattaaacctcttttctttaataaattacccagtcttgggtatttctttatagcagcatgagaatggactaacaatacaccatggtaccaattatgactgtaattctctattacttctgtgctccagtgcttagttctgtttggcaattattttgttgtttccagtgacttaattatgtggtctatgacttaattaccttggatccaatcaccaggtgctgaaggggacaatttcctagtacaaacctggttttgtagctctatctcatagagcagtgcctccagggagtgaaaccacctttacaagagaaaatcatgatggtgaaggagatctgatctaaccaacccccatcttgcctttaacctccaaactgctcttaatcattcctgggctcaggctaagctaactttaggagacatttagtttacagtttaaatgataatatctcttccccaaaactaaaccgcctttgtaaagctaacaaaaggccatcagatagagagatgaagggagcctgagttctgctcaggagaagatgtgaatggttaccagccattattccagaggtcacaagatttgaaatttccccaactactcctgcaggtaacatcactattgtagaacctaagactggccttttgagatgtcctttcaggtatttgcatttttgacaactgacacactgggaccatcaactggtcttgtggcctcacctagaagtagactcagcacagcatggatggggaccattttccacacccctatgattgcatccccaacaaatcagcaacacccaaactatccttgaaaaactgtagcctctgaacttccagggagactgatttgcataataaaactctggtctcccattccgctggctctgcatgacattaaactctttctctattgcaatccccgtcttgataaatcagctctatcttggcagcaggcaagatgaacccattgcatggttataggggcacctcccatgagtgggaaggattgggaaagcacccatgtgcatccacacagcggcagtgtgccggggacttagcatggcacacagattccctcacatagagtctaaggtcaaaggagggggtggccctcggagtggccggccaggtcccacactcactcgctcatgtgctccctccctcgaggggctgagtgcagtgggccgagtagacccacccctgctgcaagtctggtaaagggggtcgaaacaaatcccgtgtcagtatgggatctaattgatatgcggcaaataactggagggcacagctaggcaagggtctcagagcaaggtgaggcacaaacaattctgtgagaagcacctgtgggatctattgtcctgagagggctgtttacccagagaagcctcctggtgtgctgggaaggggctagcccggcagtctattgtttgcataaatggacatttaagcgattcctgaagaaaacaacaagttattgactggttttatagccttatcttcctggacaagaatttcctgcaacaaagagttgagaaaagaaaagaatttttatctgaggaatgctagtccttttaattatcaggccaagagagacattaaaataagatcacagaagtccagcaaggaggtgtgtgcctgtagtcccagctactcaggaggctgaggcaggaggatcacttgagcccaggagttcaagacctgcctgggcaacatagctagaccctgtatcatgaaaaataaaaaagaacatataacaagaccatggtcacatcctccttcccccttgagctatatattcatctcttaaaactgtttgctattgccacaagtagctataaattaacctaataatgctgcaactgacactataacccacaggctacagcttagcaatacatagccaatcactaatctatgttatttatgtgaaccccaaagagatttcctgacaaaccactttgtatcagcccactctctgtccccatttccctttaaaaatccacttgtaatcgccgctaattggagtgtatattcagggtaacttgaaactatgctcccgggttgcaatcctcaagcttggccccaaaacactccctatttatgttaattttgccccagcttcttccttttaggtcaacagaatcaagtcacattgaagttggcttagtcctgacagtcaggtcatggcacacctaggcatccatggtctgggtagagctgtgtactgaggtcagagaagcagctcatggtacagccttgcaggccacaggcaggacttaatttggatttttttctgggctgggagtatttcaagcacagaagtgataagagtttgctagggctgctgtaacacagtaccacacactgggtggctttaaaaaaagggcatttattgtctctcagtgctgggagcagaaagtttaaaaacaagctgtcaacagggttggttctttgtgaaggctgggaggaaaatgacaccaaatatttcaccccaaaatagacttctttgacatacttcaaaatggctattcagaaggcctgtaaacacaagaattgccctgcaaatctaggctccccttttgagttggggagaggggaggaggtttgcatctgcagaggaaataaagtgaagtcaacaacagctgtaagaaggctttctctgaagcccctttgtccagatctaggaaagatgacctgagagtctcaaacctttaaaatctgacatacacttcccatcgcctacctaccctctattcttcctgagggctgctaccttggtttcctctgtataacaagactgccttaggtgcgaggtctcctcttctctcctcccataacctgttttgcttctcgctctaacctcaagatggtataaaagcatcaactggcctggagcggtggctcatgcctgtaatctcaccactttggaaggccgagacaggcagataacttggaggtcaggagtccaagaccagcctggccaacatggtgaaaccctaaaaatacaaaaattagctgggcgaggtggcgcatgcctgtattcccagctactcaggagcctgaggtgggagaattgcttgaacccacgaggcagaagtttcagtgagccaagattgtaccactgcgccctggcctgggcgacaagagccttgagactccatctcaaaaaaaataaaatcaaaaaaagcatcatccaactggccatttgagtttttcatattttgtatgacttctgtgcctgaatgcatgttaataaacatgcttttttttccttgatctgtctattcccagcggtgtttttgtttttgttttgagacggagtctcgctctgtcaccaggctggagtacagtggcgcgatctcagctcactgcaatctccgcctcccgggttcaagcgattcccctgcctcagcctcccaagtagctgggattacaggcacgtgccatcatgcctggctaattttttgtattttagtcgagacggggtttcaccatgttggccaagatggtcttgatctcctgaccttgtgatccgcctgcctcagcctcccaatccagttggctttataggatcaaatcagtgaagtctgagggggaaaaataaaccctatagagggaaggatctgttccaggcctctctccttggcttgtggacagcccccttctccctgcaactcttcacaccatcttccccctacatgtctgtgtctaaatgtcctcttctcagaaggattacggcccatcctaatgacctaatgacctaattttaattgggtacctctgtggagaccatagccaaataaggtcatgtgctaaggcaaggcagggggctagtccttcaccatgagtttgggctttataacattgtgccattgtgcttaaaatactattttcaaaaacaataaaaaatttaggaaaggtagcattgttttacttattttttcacatctttcagttagattcccatacctgcttctgcattcaatctgctgccatgttttgtgctttgctgttgttgttgtcatttttggctgaagtatataaagaaaatccagccttatatagatttgtaattggaaaaagggagggtttttttggggggtgcaggggaaccgggtctcactctgtcctccaggctggagtacagtggtgtgatctcagctcactgcaacctcctgggctcaggggaccctcctaccttagcctcctgagtagctagatgagactacgggtatgcaccaccacacatggctaatttttgtattttttgtggtgaaacatggggtttcgtcatgttacctaaggtggtctcaaactcctgggttcaaacaatctgcccactttggcctcacacagtgctgcgattataggcatgagctacctgtagtgcccagcctggaaggggtatttttaaagccttttcagataatgtgactattcttctttcatattacactaaaactcaggaactggtaattgcttaaaggttagtagccatgtaaagtctgaaattatatcaatgaaatttttgtagttaaattaaaacctattggtatatcttgtgcttgcaagagccatttacccattcatcattttaaaatatcatgcattatttaaaaaacattggtttggtttactgcattgtgccaaccttccaaattctgacacattgcatcatacagtattgaaaaatcacaatggttgctattaccacagtcctcatgaaaaaggtcttcaagaactgagaaggtgtcaagctcatagagcaatataagttttccaagattcaagttttcacttgaaagcttcaattttattgttggcaacattacccactgttttcttttgaagtgaatttgtttttgaaaaaagtgtctgccagactcaccactttatctgctagttattctttcaagcaaaagtgatgttccacgaaaaaagtagctctcagcttgcagctcagaggttgtttcctacaggggagctattgagctttggtatgcttcccatgtgcttcatgcaagttccatttagtcacatggagtattcataagatgtgtactccacagttgacatttaataaaattgactttttttttttttttttttttttgctatcacattcaggctattcttaagcgtttttctgccatgatcacattgtgatgaagaacatgatggtcactagtaggtaactttctgtgtcattgccttactctcagtgaggtgctagtggatttacctacccctgcttttgcatcaccactgtaaatctaatagtgaaaaggcaaatgatgtctcagtatcactgtgaaaacatttttcccttggaccagctgaaagcatcttgaggagcctgaaggcttcaaggtccacacgtcaaaaaaacacagccctagactgatggtggcccattatgggtggggtcagcttccccctagatcacatgggttctgttgggaggggtggcttgtctgcatgaccatcttagtcacctcaaggagggaaggggcaaaggattgccaagcatctactgcgtaagtagatagctgtaacctctgggtaagaaagtgggattgggtgcggcatgagggaaatgtccacatttcattcaatattcaaaacataggattgcttacactttttataacaggaatgccttcttgttttatctgtgcaaacagcaaaataaaagcatgaatgggaactgaccaaagttttatttagtttttacagaaataggatcatagtgcatgtattatccagcaacttgctttgtcacctagtgtcctggagatctgtccacgactacgcatttagtgctacttattcctgtccaactgctgcataccatttcacttatcagtactgtgtatccacaaagctattctgctactgatgtgcacttaggtagatggactgattaaaagggtatctgtctgtattaggctgttcttgcattgctataaagaaatacctgagactgggtaatttataaagaaaagtggtttaattggctcacattttggctggctgtacaggaagcatagtgctggcatctgctcagcttctggggaggcctcaggaaacttacaatcatggtgaaaggaaaagggagagcaggagcaagagtgagtggggaggtgctacgtggttttcaaccaccagatctcgcgagaatcactcactatcctgaggacagtgccaagagggacggtgatacctattcatgagaaaactgcccctgtgatccaatcgcctggcaccaggccccacctccaacattgggggttaagactgataatgagatttgggtggggacacagatccaaaccatatggctgtccattcttagaacatactgtcaaatttccttccaagaacactgtacatgagggattcgtttttctctccatacatggtcaccaccaaaggctaagctaccatcatcctttctagctgggagtctagctatagtctccaaactgtttaaaatatactctccacaatgcctgaacaacttttaaaaagatcaaatataagcatgtcactcctctccttaaaatctcagtagcttccctgtcctttgggataaattctaaaatccttatgtgtcccccaagaccctgctgtcatctggttcttgcctatctttccagactcaatccctagcatccttgtctcctttccttaccccaattatttctgtaaaaacaatcttcaaatggaggcatgcgtatccctgagaatatggacacgtggtcatgaggagtttcaagggattcagttttcagatcccaactcttctaaaagtgatctgtctgaggactcctgcagtccaggcccacctggcatttcataatggctcctctcccccctggcacatcctaaatcttactacattgtgctgccctgctgaggtagaaaggtgtaataaaccttaggacaccaacagagataacttatttaagagatgcatttcttgtaacttttttttttttttgcctacaattccttatcagattttgtgaaacacattgattaaactgtgtattgctaataatagtaacagttcaatccagaagaaaatttgcttcttaggaccctaatgatacagtctgatcagtaaaaaactttgaaggatagagcatattcaattatgatagaatcctgtggtagaagtgaaataaaaatattttcagggagaaaaataatcaatgcaaaattttcaactggtcaaaggcttaagtatttttgaaatgaatgatggggtggatattaagtcactataatatttataactcactgcatacatttaaaaattttctgtaatcactttattttcaaaacatcattcataactcatcagaacttcataactacttaaatttataattaaaagcctttttaaatttatcattaaaagcccccctctccccacctttttttttctttgagatggactctttctcttttgcccaggctggattgcagtgacgcgatcatggctcatagcagctttgaactcctgggctcaagcaatcctcccaactcagcctcctgagtagctggggctacaggcatgcacaatcacacccagctaattaaaaaaatatatttgtagagatggaggcctcactctacaaagcgcttaagtgatccttcctccttggcctcctgaagtgctggaattacaggtataggccaccatgcccagctgagaaaaacatttaaatatcagtttaagaatgtgtgatgggaatacacagcattctttcaaggggcatctcaacaaattttaaaaagaacactgtggcccactccagtgctatgcatgagaatatggtgatttctcagcttcaggcgttcaaatgtgccattctcccatggaaagcccactaagtccctcaagcttcacctgaaataccatttcactgagaagtcttccttgtctccagactaaattagattgccttgatatatgctcccagagaaccaagaatgtccccttttcatcccacaggtaactccttgttaaatgttgtacaaggaaggcatagacagaattcacctttcactgttccactggtgcccagcagggtatgcaaaggaggaaatcagctgtgctctgaaagaagcaccattccagtaaaggggaggaaaaggtcatcagactgcaagggctcaacaaaagtacaaggtaaggaggcagagggtgtgggctgattatcaactaagaggtttgcacggaaaaagggaaaaaaaaaaaaacagaaaaacagggccgggtagtggcagaaagagagggtggatctgtgactgttcgcaggaagagaggagcgggagcaggacagacaataactgatagtcaggagctgggtttggagataaagagggaacaagagaaagttaagttctgtgttttcatggcaaacattgcacaaaagtttacaacttcgtgactaacagtaatctggggtgattcacaacaaatttacacataaacacatatttactgactttatacacagcaatcctaacgtgaacacagaacctgctttatcttttcgcacactgttctagtgtagagatgtctggtctcagttaaagaaagcataaggagcattagttgtgcacactgtccacacctgtgacttttttccaccagtactaaacctagtgcttcttacagtacaggacaatgacagccacagaaagagagaagctccttttactgtgtaatgcttcctgctggccttcaaatacttgttacttgagagatctccattcacctggctttgtccccaaaggtcatcatctaccaatgatgttgttatttgatgttaatcatgtataaagaaagtagctaccatcctggccctgattagaacttcccactgaaataccgtcctgcctaaaggtagcacaggctcccattatggtggtggtggggagggggcgggaatatatatatatatatatatatatatatatatatatatatggtaaagcattcggcattcttttaaagtacaactatccttgaaaagggttacatattaaaccatttttaccacagccaaaggggaggagaaagatccaaaagtcctgtggatctgctttaacatcaataaaacagttatccacccttcgtagcttttagtgaaggctacaaaagtatgctttttatggattacacatgtgcacgcaactactttaattactacagaaaaaaacgaggctccttattaaaaaaaaatcagaaacaagtccaacagactctgaggaaatgaagcaagagtgaattctgaaaaggtctaataaacagtatggaaatatccttgtgggattgttcttcagctatgcataaacatgtaattatcatcattactgtgatggggaaaaacacggaccctaattctgaaacaccctggtagcgagagacgggcaggaggggctgctgcgcactcagagcggaggctgaggaggcggcgtccccttgcaaaggactggcagtgagcagatggggacactcgagctgccccgcgacctgggccgagctgcctacaacctgggcccaggtgcctgcaagaattagacctccgataacgttaacacccactttctcactgctctaattgtgtgcatcccggcgcccaggggcttgtgagcagcaggtgcgcgttccaggcagctccagcgacccttaaacctgaccgcgcgcacgtccggcccgagggagcagaacaagaggcacccggaccctcctccggccagcacccaccttcacccagttccgtcagtcgccaccacctcccttcccgcgtccgcagccggcccagctggggagcatgcgcagtggccggagccgggttgcccgcgccccagcaggtagctgtactgcaactgtcggcccaaaccaaccaatcaagagacgtgttattgccgccgaggtggaactatggcaacgggcgaccaatcagaaggcgcgttgttgccgcggagccccctgccccggcagggggatgtggcgatgggtgagggtcatggggtgtgagcatccctgagccatcgatccgggagggccgcgggttcccttgctttgccgccgggagcggcgcacgcagccccgcactcgcctacccggccccgggcggcggcgcggcccatgcggctgggggcggaggctgggagcgggtggcgggcgcggcggcccgggcccgggcggtgattggccgcctgctggccgcgactgaggcccgggaggcgggcggggagcgcaggcggagctcgctgccgccgagctgagaagatgctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctctactgcgtctaccagagcatggtgctcttcttcttcgagaattacaccggggtccaggtgagccgcctcccgctcccgggtctcggcgtccacccgagctcccgggggcgcggacctctccgctcccccacagctggcgagggtcacccggccggcccggcggacccagcacggagagcacgtgccgcctccccgccttcctctccgcatgcttcctgccgttctgccgagatcgctctctaggaagctgtggctgcgtcgtcctgaggctacgagtgggacccgccgcccctttccccgcccctcgcctgggtctgatgctgcttagcaaagtgggtgcagatgcacgttttaaataatagggcacgcgtttagcagtttctggcctttggtccaaagaggtggtcatgttggaacagatcggagacgtctacactccgaagtgcgcttttacagtgacctcttgaaacagaagtacaattcggtcttgtgttctttcccctggacaagtgaaagctgggcgaagaaatgaatacatttgttaaccgtagaagcctaactagatacatttcttgccaactttaactgggcttgaatgtgtgggtgatctgttgtctgattactttctttctgttactgtttctctgtagagattggattcgtagattaaacttgagaaacaaaccataaaagtggaaggccctctttaacagtaggtatttgaagtgttataaaaaaaaaaaaaaggtgaatttttcttttatttctcagtttgaaagaacagctttattcttggttattcctaatgtccacctagtcctcttttacttttcttggtagggttagggtggcatggggaaatgggacggtatcattttgtctttttaactttttttttttccacctacagcagctgtttttaccctgtggtcagtcaggtactatatttagtttgcagttgcactgctgatcgacccttgatggccccagttggaagttgtttggggggaaggaactaggagaggccagggcctccatttaaaccagtgtctgtaagtgtctccttggaaagaaaaaaagatactgttccaggtcatggtttcctggtagttgacgtttaaaatgggcctcatttaaaaatttcaataattcaggctaattttttccctttatatggtaactccaccaagtttgtctaaatgtatgatttttatcatgattaagtttttacttccacatcatgtgacaactggcctgggatgggatataagctcagaacacaaagtcattcacctcttaaaaaaataattctatctgtggcgggttatgttatttttgttcaaagaggacacaatatgatgcagaatacaccattgaaggattttttggtttggcaagttcttatttttttaaatggctgtaaaacctagcagtgtttctgaaattgcataccttacctgatgttcagagatccgatttacttcttgatttcccagcaagtgattttgaaaacatttaatctaatcattccccccaccgtctgttcaaatcaaaggaagtggcatccagcactaattttcatgcatttatgaaaggatgcctgaggacccttaagtataattcaaaattttgtttaatgtgtgttccttgatgaagttctttaggagtcgtagaacgaactgattgcccactgatcatcaaatgcaagttatgaacatttaataaaaatttaaaaccaagagtttcttgttcctgcatttttatttttattgtatggaggggacaaataattattttctgtttagtaacagagcagggtattttgaatttattagggtctttttctgcaatctgggtttcctgtgtacacaaagctacctttcaatattttttattgtttctgttaagattaaatcaatagaggaataaatagctatcttcaaacataagacccaaaggaaaaagatttatagtgatgttctgtcaccttattttttacctgtgactttgtaccattaactttgtcactgagatgttttgattaaaatttttagcttgcttttcttgttttgttaggacactctttttttcttgaattgtttttatcagctttcgtttgcaaggctagtgatgattctcttgttctgtataaagtattgttgactcatttctgaagggagttttagtaatttaagaggttataagtttttaaataaaaggtttattaatttatatatattaaagaggcattttaaaataaaattttttttaaatgacatttttacacctttcaactctaggtttaaaaaataagtggttcacagtagttcttgcagaagaatattttcttttacatagaatttttaagctgaagagaagtagtagtaggtccatgagatttatgatctgtgcttggcaggtaaacctgcttccaacaaatttagttggatttttcttggattctgggtaaatacctttttcttccccaatttcactactttattttcatatgtatctctgagatagagaaatatttcagtcagtgctgctaaaattgttccttataactcgtttatccttttaggtccttccagaatctctcattggtactgaaactcaaatgggtactttcttcaccatttatttctttagaataagtaataagaattttataagcttttttatatttcacgtaatttgagactattgaaaatccagttaagtctctctactgtgttgagaggcattgattcaagtacctgtgttactttcctgtgctgccaaaacagatcacctcaaactaagcggcttaaaataatagaacttaagttctcgtgattctggaggccagcactttgaaatcaaggtgtaggctcaattttactccctctggaggccctagggggaatccgttcttgtgggtttcaacttctggtgactggtggcattccttggcttggggccccatcactttaacctctgccttacagtccttgctgccacctcttctgtctcacatctcactctccctttctcttagaaggatgcttgtcattgggtttagagcccacctggatattccgggatgatctcttcatctcaagatccttaattataactgcaaagagcctttttccaaataagaaaacattcacaggttccagggcttaggatgtggacacattttttgaggggctgcccttcattcccccacaacaatgaactccatagttctgcctattcagtattttgtagttatttcgtagtttaacttgccttatttctttaggtatttacgtattaaagcattttggtctctgctttctttaacagagaacctggttttctgtaataagtttacttactttcccataatcttttagtttcttatttacagatttaccttcacatatcccttaagtagaacatttgattaactgttttattttcggaacaaatctgcattctgtataataaccaacttattcatatttcggtattcttttaattcttatctgattctgaaattaccatcttgtgattatatatatatatatatggaaataactgaaatcctgataaattaaaggtgatataacttctaagacaattaattatgtatgatgtggtgaatatactggtgtttggtttgtttgccacttaaaagccctatctataggataggaagtaacttgaatgtggaatgcttagagactcagagtaagaggccgtatatatatccttgagctggagtttaaggaaaacttatgggaaattaaaaggaaagttggagtactgacagaggattgggtaggactcatgaaaaaggaatgaagttaccttaaattctatcatcgtgagttaacgtgaaactagatttatgttagtttatagcctagaattctatcctaggaatctagatatatcctaaatgttgagatagctgcataaacaataactgtaatcgttatgataaataatgacaaatctttttagcatgttctgtgaagctgataaatgttaataggatgtcttcaaatgtcagaattcttttttctttgcttcttttttaaaaaatttcttttcccccattcctatgcaatacactgaaaactgatcattgaaatttgtaggccaaaaaattaatcaacacgtaatagattggggtttgggtttttttgagtcagggtcttcttctgtcacccaggctctggtgcggtggcaccatcattgctcattgcagccttgaatgcctgggttcaagtgatcctccggagtagctgccgtgccattatttctagctaatttttaaaagtttttgtagaaatggggtctttctgtgttgcccaggctggtcttgaattcctggcctcaggtgatccttctgccttggcctcccaaagtgctgggattacaggtgtgagccaccatgcctagcccctaataaatattctaattaccgatttatcttgcttaaatcagttggtaacacttggaatttacttcagaatatattttacattagtggctctgactgctaattcccccttctccaaatgctaatgtaatataacaataaaatgcacagttcttaagtttatataaaataaacaggttttcagttgacctgctttaagtgtaaaatagtgtgaaaaacacaagaaagaagataaagaatttaagattttgacatttctctaatatgcccttaacttctccaaggattcatacttttttttgtaagacagaatctcacactgttgcccaaaccagaggtgcagtggtgcagtctccactcactgcaacctctgcccccgggctcaagcggtcctcccacctcagcctcctgagtagctgggactacaggtacacagcaccatgcccagctaattttttttttggtattttttagtgggggtagagacgagattttgccatattgcccagtctggttttgagctcctgggctcaagtgatccgtccttgatccaccatgcttagctgattcatactcttaactgaaacattgttccaagtttctcagaaacagtcaaggctttttatctagagaacatttataactggatctttctttgtgtagcactgattcatcaaactaatcctaaactcctaatgagttaaatttatattctgaatcttgctgtaaaagcagccattcattagaatgaaacatgtttacttagaattggagaagggagcttataagtcatctagtctactcccttttatgacacttctacattctttctgcacttctgccaaaatgttgcccagcgtcgtctctgatacctatagtcctaacaagaatatgaatcataccttgtatccttaattttactcttctctgcttatttgccattcatgtgaagaccttaaatagatcttaaattgcttccttcactttagctgagagtgacaggactgtgtaggtgtgggtgtgtttctgcatttgcttatttaagcaggataataaaaacttttactataggaaattaaacatttcccaatcaaatacaattccagtctaacacaattaaattctggttagggaactgcttaacttactagacttataggaaaatactaaaaaaatgtaactagaactctatttttacactttataaatataaacctctgtgaacaaaccagttatttcaggttgcatttgtgtatagttttttaatgcctgatttttctattttaaaatcacagatgcaattatacattcaaacactgccacaatactttgagaaagttaaagtttcccctactcctacactgcgtacacctttcctaggtacatcccagtttggtgtgtaactttagatttcttccaagagcttttgagtaagtgtttgaattgtgggaaggttctttagttaaatgaacttcttacagatcagttttttagtacagtagcacgaaatatacctgcatacctatggggatacctctgtgccattacgatggaaggcacgggaaaacagcactccgtatatacctagtttactttccctcttttgtatatttgtctgattttgtggagctgatgcttctcaagtggaatcagaagttaacttttcctttactattttctcattttattatggtttcttaactagaggttgatgttagtggttggaccattcaatagtaagtaatgacttttcagtaagggatctctagaacccagatcccttaattcctgcaatattcccgtgtgtacattgttccaggtgctgtcctgggtaccaaggggtacaatgtttgatagacaatgtacctgccattatggaggtcacattctagtgtgggaagacaaacaataacaagaaaatgaaaatttactgtgccatgccaggttgtttagcctggtgggtgagaggtaggggtttggaaaatcttactgagcaagtgacatttgtgtggagctctgtaaaagggccagcttggaaggtaatgtagtcatccaggtgagaaatgatggttaggggagtggaaagagtggatgttaagattgaaaagaattccaaatctattttagtggtagctgatagggctttgtgattgaatgtggaggaaaaagaagagggtgggttagtaacacactcagtcgcagttagtgagtgctgctgtgtgcaagtattgttctattatgtaaataattccatctttacaaagtaggcaccattcttcctcttttacagacaaggaaaagggaacacccatggttcacatctgtagtagcctagccaggagtttcaggcacttattttctgaagatgctctgcctggcaatgtggttatattggttgaaatgagaccccctactttcaaggtattcatctaggaaagacatgaactgccaattacaatataggataacactgaaattagagacgtgtttattaactttgccatacagaggtaaagtaactctttaaagtaactctttgcttgggttagtggagaaggctataaaaattacttggagtttttactttgaacatgcgtaattaacatggaatgtttagggaaaagaggttttcaattgataacataataaacatgaggagtttgaagcatggcattcaaggttttctaaattctgccccggttaacttttccattcgttggtttcattctagtctagcttttccttctgggccgcccctccccacattagaccgctcctctctggaattccaactcaagcccttgcttttctccatctgtcatgatgttaccccatctcattgtcagggtaacttttatgtaatattaacatatataatactgatataacattagcatattttaatgtatggatcatctcctctgcaacattgtaacctcttggagatggcaataatgggaagaatgacttgattttactttttcttttaacaaaaatggtggagtagtctgggcacggtgtggctcatgcctgtaatcccagcattttgggaggccaaggagggtggatcacttgaggtcaggcattcgagaccagtctggccaacattgtgaaaccccatctctaccaaaaaaatacaaacacttactgggcatggtggtgtgtgcctgtagtcctagctactcaggaggctgaggtgggagaatcacttgaacatgggaggtagaggctccagcttgggcgacagagtgagaccctgtctcaaaagaaaaaaaaggtaaaagggccaggtgcggaggctcacgctggtaatccaagcactttgggaggctgaggcaatggatcacctgaggtcgggagttcgagatcagcctgaccaacatggagaaaccccttctctactaaaaatacaaaattagccgggcgtggtggtgcctgcctgtaatctcagctacatgggaggctgaggcaggagaatcacttgagcccaggagacagaggttgtggtaagccaagatggcaccattgcactccagactgggcaacaagagcgaaattccgtctcaaaacaaacaaacaaacaaaacaaaacagagagaaaaggcagagtactctagggaattctagtctgtgtttctgtggaaatgtatatgaatctcacttttaagggatggagatttttgaatggcataactagttgataagttttgctctaacagggtacccaagtctagtgagtccgattcattctttccttaaatagatgaaggaggaagaaacatgactccaccctcaagagtaaggcagaatgagcaaagtcagagaagttaaaaaagaattctcacgcagccagcagtgcagagaaaccttggtttagttgtgaatcaaaaccagtactttttgtaatttttgagcctatgcaattctccaaggttttatgttgtttcttctgtttctctgtaggcaccagaaatcaaaaccccaaataagaaagtgttacttgaagattttagagtacttatttgtgtataagtgtaagtaatatttggaagacgactttactgcgctcctccagcttggcatgagaattccaggggcggaaagaaaggagggtgatggtacctggaaaggagagtcatgttaagtcccagccacatattaagtgctaaccacctactgttaaaaggtgtaatgttctagactgacaaaatacatagtctctaccgtaaagtaacacataatttagcagtgcagaaagatgtcacttaaaagaaaacttgaatatatgctgagatagttcacaaattaaagaaatgaacaaagaactgaggaaataaaggaggaatacaactgtgtccaaatgaatacttaactgggtgggagctgttgcatatgtaagcaggtggttcacctaaaagttggatgtaacgtagttaacgccagctcttggtgcacttacatattgcattgcttccgggcttaatttgtgttcatataggaataaattttttgttggtttttaattttactccttgtaattccgtagttgatattcaaagtgaaaaaaattacataagcttctaatatatgagaagtcttctcacttgacattttttatttggaatttttgcagagagtagttttgtcacagtcaaaagattttgggatcttgcagtgagaaacctaggtgtaattcctatttctctgccattccgtatgtcatctggattaagtgtcaacttctcagtctcaagattctcgtccttaaatggaatactttttgtcatgctattttgaagacaaaatgagataatacgtgaaactgcctagctcagtgaatggtacatcatagatactcagaaaaaacacaccctctaaaataagaacagtaccaaaagacaggatgtaaaataagggcagtaccaaaagacacatgcatgctgagtgtatgagaaagaactttgtggccttcttgggtggcacaggccatggcagttccacagcatgacgtggttgctgtgggtggtagagcagacatgccgctccccgtcactgcctggctttgatgcttgctttcttcagctgagaggacgcagctgtgatatgaaggtcttgtgtgtacagtcgtgacctcacatttccaatttcctgctggcagaacccacagtctacaacgtacgagcaccagagttgacgtgagacagacagcatacagaggcttgtaacatccttctggaaaacactgtgtaagctttcagtgcgaataaacatgatcagtggcaagttctgttagatgtagtctgcaagcatcctgattttactgggcaagactatgttgatttacaggcggctgatgattccatggatagcccactactagtatttttacaaatttcacaagacattcttactggaagattgccctgttcttatgatactgctgcccttttagcttcatttgctgttcagactaaacttggagagtacagtcagtcagagaacttgctaggccacctctcaggttattctttcattcctgatcatcctcaaaattttgaaaaagaaattgtaaaaattacatcagcaacatataggcttatgtccttgagaagcagcagttaattacctaaacacagcaagtaccttagaactctgtggagttgaattgcactatgcaagggatcaagtaacaataaaattatgattggaatgatgtcaagaggaattctgatttataacaggctatgaatgagtacctttccatggtcgaagattgtaaaaatttgttttaagtgcaaacagttttttattcagctttgaaaatgacttgcataaatctggagaaagattatcaggatttaatatggtgaattatatggcatgtaaacatttgtggaaagcaagtttagaacatcacatattcttctgtttggacagaccacttccaactagaaagaatttttttgcacattattttacattaggttcaaaattcctaatgcatggtgggagaactgaagttcagttagttcagtatggcaaagaaaaggcaaataaagacagactacttgcaggatcctcaagtaagccattgacgtggaaattaatagtttgggaagtagtaggcaggaattcaatatctgatgaaaagattagaaacataaagccttccatcacaattcccacccggaacaggaattcctactcatcaaaattctgcattcatacaagagggaacctgattatgaccatcttctgttggtcatttggtagattatgtggttcacacttcttccaaatatttgcaaatcagacatcaccattatcagcacaagctaatagcatcattcgggaatcatcactattacaggacacccctggagatgggtagcctccagctttaccacccaaacaagctaagaaaaactgttggaaccaaattcattatttacattttcaacaagatctggaagatcatattaatgaaacgttgatgttctatcttctcttaaaaaatctgctcctaatggtggtattctacatgataatcatgttctaatccgagtgaacctgacgaaaatggaaggtttggagtcaatgcaaagggggatatgatcagaagatgtctgtgatcgtgtcctgagaagcaccaggaacacctttgacctcagtgactctcgattgaagagaagaccaagttgtattgatcagtggttgggactttacagaacacacccatgattggattgtcctgctttttaaagccaactgtgagagacattctggggaactcatgcttctagttctacctatgctgcatatgatgtagtggaagaagtgctagaaaatgagacagacttccagtacattctggagaaagccccactagatagtgtccaccaggatgaccatgtgctgtgggagtcagtgatccagctaaccgagggcttatcgctggaacattctggacacaatttgatcaacttatcaaaaaaaaaacttggaatgacaatttctggtgccagattaccttagaacctttgcaaaaatagatagagatagttttccttatgatgttacatgggttatttttaaaggtaatgaaaactacatcagtgtaattccagcatcataagtcagaacagtgcttgtcaaggggcgttaccacacacttgaacagatttttggcagatgacttgggaacaaggctcctccatgtttgtaatgttgaccacacaagttgaatgtggcagagttaaatgaccccaatattggccagaacccacaggaagttcatcctatggatgctaccaagccttctgccactgagaagaaggaagcactgtctttatcttcaggaagatcacactgctgtttaaccaagagaaaaattagagagtcatcaatcacgcagatccagtacagagggtggcctgaccatggagaccctgatgattcagtgactttctggattttgtttttcatatgcaaaataagagggctagcaaggaaaaaccccttgttgtttcttgcagtgctggagttggaagaaccagcgttcttaatactatggaaacagccatgtgtctcattgatctcattgaatgcagtcagccagtttattcactagacatggtaagaacaatgagagagcagtgagccgtgatggtccaaacacctagtcattacagttttgcgtgtgaagtactattttgaaagcttatgaagaaggctttgctgaagaaagcaaaaggaaaaaaagaactttgtcatctgttaggttccatttattgcatgataattgtgtttgtattgattattgggcaagtagctgtttgctattttgatcttatttcagaagggcataataattttactattcaatgaaacgttttaaacggggtagaaaaagactagtttttgtatgctttacagcagaaatcttataatgattaactggtaatatatttcgttggcataaaaatacatttaaaagttcaagtaattataaacattgtaaattgtatatgtaatcatattgaaattgaaattctttatagctgtacttctgtgtaatcaaagactggggagagatagactagctagctctttctcttatccattaatcacttaacagagttttgaataaaaagttccatttcatgggataagaataatgacaggttaacctattttagttggttactatgttctaggtgttgtatgaagtagtttacatagtttcactgatttcactacaatcccaggaggagtagttactattattacactcattttacaggcaaagaaataggtttggaggggttgggtgttttgcccaagttctcatcgtaaaatgacagatgaggattcaaattcaagtcttaattgaagtccattactttagaacctacctcttagtggctcttatgttacagtataagggagagcagactgttcctttacccttgtagggtagctagggcttgtgaattaagagactgattaacaggagaagaggcatacacatttttttgacgttagtatttttacatgcacagggaaggagggttttatttttatttttatttttatctttattttaaagagacaggggtcttgctgtgttgccagggctggactcaaactcctgaagccaagcgattcttctgcttgagattcctgagtagcagggactataggtgtgctcctctgtgcttggctaaagaaggggtttgtatgtgatttttaacaaaggctgataaattgtgaaaaagtgactagtcaaaggagaagaggatttcagctcccaggggtggtaaattgtgggaagatgactaggaaatgtatagtaataaggtttgctatgcaggtttattttgccagtttctggtctcctaataagggacagggaaacacctttacagatggaaattcatatcacctttccacagggaaatttatgtcctgccttaggcagttaggggaagggcagagaattcttcctgtatctgctgtgtctcaggtgccttcagctcaaaataatccttatgccaaagtagcatatttgggtgtggcatattctctgatctctttcaacagcatcatctatacttaacaacagcaaaagttttttttaaaaaatcatgtttcaagatttgcatgtggaagacaaatggacatgattgagataaatgaagaatatatattttttaacaaagaatgctgtatatttatgtctctgtgacattgtgttatggaggctaaggtgttaagcatgtgattactttagatgccgtatgactacctgtttttaagattaaaaaagaatcaataggcagtttatatgtcatgggagcaagttaaaaacaacacagatgtgatgaaggcgaggtgaaactggtccgcatctaattcaggccttctcctgaaagccagtgtgtgcaagataaataagtttttttgacgaaagcagaataactagtttgtcctttgtgatgaagatagttattcagaaatcatttttattggctacctctgaattaataaatgaaaagagaaatttttttttctgtaggggatgtctgatgagttcttaaaaagtggatgaacctgaaattatcatgaacaagcaatcataatgaacttaaaattacttaaagagttatgaaaaacaaaaagaaaagccgtatgttttcttgtgccttattttgaagtgacaaattatttgcagggtacatttgtagacggaactaatgtgatttaaaaaatgagtactagatttacagaatgaagcctttaaaaagtcactggtgcactttaattattttatttatgtttattctgaaactacctttattttgaaaatgaggtatagctttgcctactggtgacaaaagtgtaaataattcagtaaacatctgttaaaaaccagcttggtgctaggctcttggggtagaaaactgatcaggccattgaggagctcatagtccctaaggggctggggacttgtcattaggtgtgcagtgtgttctggatgctcctgaaggagtgtgggcaggtgcgcaccaccatgcctggctaatctttttataattatgtagagacagggtctggctgtgctgcccatgctgggtttgaacttctgggcttaagagatcttccctccctgcccctaccgaccccgcccgcccactccacctcagcctccccaaagcactgggattgcaggcatgggccactatgcctgggctgtgcaaaacttttaaatcagtgcatactcaatggtcttgatgcaattctggcttgttggtaagagaatggggatttactcacaagccacgatgtcacttttaactctgaacagatcaagctattggtattactcatttatgtcatcgataaactttatgaataaaaactcattgtgcaaatgtttaaacatactacatacatagcactgtgcagtttctaaggaaagtaatggaaacctttgtcacatccctggcttccagaactttatgttatctaagtgcatttgtctgcaaagttgttgggttaattgcccctttctttcttctctttttaagatattaataaatagtgtcatgaccaaaagataatccttatggacaagatagatctaaaaagccttagctaatttataatcttgcataatccatgatgacaagatgcagaaacaaaaatgcccagaataaaaacttagcaccattagcagccatttccttttaagtctttacaagtatactcccagtttcttgaaaaatttattctaaaatatgtaagacacacaaaacagcagaaggactaatacaggtacatcgaacacctgtgtgcctaccgcccagtttaaaaataaactggaatgatgtttctctcatacttacagaataaagttttaatctttagcatggaattcaaaagacttctgccattccagttcagagccacccttctggtctccttgctcctcagccgcgacactgcccatgttcccaacaggcctccagggttactgcttccattcgttcttattctcatgaacattttccttcatctcatctgccagaatcctacctaataatactcctgctctgcagtttacagttctttaaaattaaaaaaggttgtgtaccctttagtgtcctgaaaaaagaaaaaacaaatttaaaaccttaaaaaggtaccatattttcatagtatttgcgttatgtctcattacagttcctgtggacatgtctgtctcttttactagattgattgtgggctctttgaaggaagatatatcttatgaacagtgttttatatattgttagcaatcaatgaatgcttgctatatttttctcatgaggatattgattattctattttaatttattaccgttaacctgtactatacataactgctttctgtacctgcgctatttatgatctctgaggctcctgtgagaaatctaatttttgttaatcatggatggaaatattcacaacatcattcgtcagtttcttcacattgtcttcctttgtatattacagatgttttaaaatatcaaagtaatgtttttttgttttatcttttagatattgctatatggagatttgccaaaaaataaagaaaatataatatatttagcaaatcatcaaagcacaggtttgtatttcatttgcatgaaacataggtttttctacagatggcacatgggcattcaaaataccgttcttatatttaaatgaagtgggttttttaaaacagcaattttctgtgcagatattacacctgttcttgtatttttgtgattttactttttggaaagtcagaaacttgaaagctatgaattttcctaaacttaccttctccctctgttggatgtaagtaagctatcttcttacttgcttgctttgtttttcctttgtgtagctctttaaagagtgtattcattctttttgtaagtgatgtttctagaagtagcattggtgggtcgaagtgtgtatacattttacatttttgattgctaagctgcagaaaagctgtattggtatgtaagtactcgtttccttactatgctcgtcatttctagtgtctgctcttcctttccttcttcaaatgggtttggtttaattctagttgctactgttccatcagaggaattgcagagaactggtcttcaaaacagtgcagtatatactttaggtgaagatacttctaaaaacctttgtattttgaggtaattctagagtcccaagaatttgcaaaaagagtacattgtcagcaatatttttcccaatggtgacatcttaatataactgtagcacagtagcagaatcaggaaattgtcattgggtaaggtactttttaattctccaaataattcagccctccaaaaaaatcccacttcttatgttttcaaacctgtagctacttttgatgcgtacttcctaaattgcatttttattactttaaaaaatataatacctagaagctcaaagctggaaacagcctgatcaatatagtactcttaagctaaaaacaacctgatcaatatagtactcttagggaaatcacttatgcctgtggctttttttaaattttcttcctgtcagctgtctcttcatgattttgtggtttttattactgcttataccatagatgaggtatagaaagtaaaagaagttaaaatgcatttttctcaatttagtgaattaatgattacattcagatttataggacaagggttgaagctacaaggggttgataggaatcttgatgtatctgagtattttccccaactttattacatgactggttcagactattttatctaattacatttcactcttggcaaaaatagcaaaacagtcaaccaatggtcaatgctgctgagaactctggcctgtgcagacatattggctgttttacttctaataccattctgcttttcctgtcctgctgctgatggatgtttcttccaggttttaaatatcaaacaaaagggatctgtgggcccagtacagggaatggctcttgatagatttgattttcctgcatttcctttattttgatccagtgttaatttcatgtagagttgtctgtttaacaggattctcttaaaattccttcttcagtttacctgccagcttttctttgtccaggtttcagtatgaactccactcgattaatagagctctctagtagtgacttgtggagtgggttctctgaacatttctggaagtgttgctgatagtgataatattgatcactagtactgttaatttgtgtgcttactacatgttggcttttatatgtattccttcagattaaggacttctagaaaacatccatgaaaaaacagattaaaaaaaacaattctgcatgtatttgggactagaaggtactatgggaaggataatcttcatactcagaccatactgacctgaatttcatttatcagtttagagaaccacttccccttcccttcaccctacctccgagtgcctgtgactttgtatcaccgctctggcaccacatcctcatcccagcaggatttgggaaggctgctttttgaaagccttttaaaattctgtaagttgagaaaatactaggggaatgattttaaatttctttagaattacaggctttagtcagtatatgacagagccttttcctagaaaaatgtgcatataaaaatttgcatgtagttttagggtttcagagacccctaaagcctatccatagacgtggttcattgtctgattgtgtttaggtacccttctaaaacccttttgagatgttaggaatcacaacagagtatctctgaaaatgtaattagcggaaagaatatttcaaagactgttgttctgcttagactttctagtttgtcttctgccaggcttgccggaataaatgagtttcctggcctgatactcaaaagaattgacatttaaattagtctctctcttcccttgttttcgcttgacacatccttgtctctacattctgtctctgtctctgttagcttatttctctctcgagtcagcaggatatagtggctgttatttcttccccttatccttcaactatctacttttgacaacactttgcctttttttttttgagatggagtttcactcttgttgcccaggctgggtgtaatggtgcaatctcagctcactgcaacctttgcctcccgggttcaagccattttcctgcctcagcctcccgagtagctgggattacagacatgcaccaccacgcctggctaattttgtattttcagtagagatggggtttcaccatgttggtcaggctggtcttgaactcctgacctcaggtgatctgcctgcctcggcctcccaaagtgcagggattacaggcgtgagccactgtgccctgcctgctatttgcctttttaatctcatgaaatgttctcttttcttggctgaagtgtcacttttcttgttgaacagcatgcgtggtgagtagaatgttataaaaagggatggactttggagttagagagacccaggttcctgttcggcattgcagaaatgctgttctgcaataggctgtgtgtcagtgggcaaattacttatctctcagagccttattggtaaggtgtgagtgatagctcctttcaggcaccttacagaggctgtctcctaatcctggtagcgtacctggctcatagatggcatttaaaagtggttgtgatgacagtcatagctcaccattagcatagcgctggatccatggcagggaagcgctgcacatgcagtatctcttggactacacagggccctcatgaattaggaactgctgtttcatgaggatagggatgaggaaattagacttgctgcccctcactgccttccactcctctcctccaagttaatgggaactatgactctgctttggcttgattgccatggaagattctcacacagccaaatttattgctatcttagttaaattatgccagaacacaaaatatgaagttattgtcaaagtaatataatctcagctgtaactgagatagtcagaaactgtctgtaatctgatgtcctatctgaaaggtagctgagaataaacaagaaataaagagaattcagtagcaaatattggtgacacaaagcttttatattttgactagttaagctagttcttaaatgtttccactaaaatattcaagtttaagggcatagcccagggcagcttattatgaacatgatgtattttggaaatcttacactttctcttaaaagttcttgggaggggcatgtgaggccataatataaccataaaaccatttgttttaaaataaaacccatttttaaaattcttccaaataaaaaaattattgcaggaaaaaatgctaaacctggtttttaactttgtacgccaactatatttccaagatgtgctgtagcctggtaaccatacagaaccatacagaattagttctcagaatttattgtctgcttacttttgcatttggtacaggtataacagggtcgattatatggtttctaagacatgactagaaagaaatatgtttatcagttattatttcttccatctaaattagaaggggctagggagagggcttcaacaggaatttatatactttagagaaaagtgatcattgatagcccaatagtatagatatctcaacccaataacacaggttgtgtctgtctctgggatcatacactgtaggggagaatctttgcaagcaacattctacttatagggagccataacaaaagtttcatatgtataataattataagtcttaagtcatcaagaaaaagttaacttgtgaatgataatccctgattaaaaagagagatgtataataatggataagagatttttcttggttaatttttagtattaaaatggctaaatcttttttgggatattctgactagtatggtgcattgtctaatagatttcccatagctgagagctaatcatcttgtaatctgtggaaaactgtcctctttggctaaaactttattgtaattcctctaaatcctcagcttttattttctacagacttttttttttttttaacatttccttcctctgactcactccttttgttctcattttcatggcctgagaacatgggtgatgatagaattattcttttcacagattaacagttttcttttcgagtatcgttgagctcatgtgtgtattaactagagaagtctcccttacatttcatttttatgttttctttctcatcaggagatagtttgtagccatttactttcaaatccaagtttctgcggttcttaagacctgtatcatttgtctcctgaatttcacttcatttcctctttaaaccatgtcctctgtttcccatcttctgcacccactttgccacttcctgtttgtttaattggcaagggccactctctgtgttggaaattttttctttttgaaagctcaactaacaacttctaggaagttttttattgctactgttatcaattcataccatcttacccttgtttttgcaaccctttgttaataacatatttatttaactatagttattagcagtctgagatcattttacttggttacataaggagcacatatatctacccagcatcattgtaaggcatgtgagacctttgtttgattgctgtcctaacctagtaccgagtcctaaaaactcattagtagaagatgaagtgtccttgccttttgctgaacatatatatacacactgaatatttagtggcaattcatagttgcatttggccattttttgtttataatttcccctttctcattaaaaaaactttgttttctagactttaggatttagagaagctcattttgttccatacacatgctgctgttggattatttaggtattttgtgactgtattttatctttgaaataaaaagcctttcaagaaatgcaaaaaaaaaaagctcaaaaaacagaaaatgtatattttttaaatatctcagatagatttaaagaaattttaaacatcctaatcataggacttttttttttttttttttttttttttttttggagacggagtctcgctgtcgcccaggctggagtgcagtggcgcaatctcggttcactgcaggctccgccccctggggttcacgccattctcctgcctcagcctcccgagtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccatcatagtacttttgaagcccattcatagtacaacctgtgaagagcctcatgtacgcgctaactgggtcctgtctctgcagttgactggattgttgctgacatcttggccatcaggcagaatgcgctaggacatgtgcgctacgtgctgaaagaagggttaaaatggctgccattgtatgggtgttactttgctcaggtaacttgtttccatgcttttctctctatatatgtagtttataaatttttttttttttttttggagacagtctcactttattgctcaggctgagtgcagtggtgtgaacacagctcactgcagccttgacctctggggctcaagtgaacctcctgcctctgcctcccaagtagttgggaccgtaggtgcccaccatcatgcccggctaaattttctattttttgtagagatgggggtctcgctgtgttgcccaggctggtcttggactcaagcaatctgcctgtctcagcctaccaaaatgctggattataggtgtgaactgccatacccaaccctataaaaatgttatattttaaaatttaacaatatacttcatgtgaatgtatggtttttaaaatgggtttaatagtttattctcagttgaagtaattttgtttggcatttttagtggtgtgtatttatatacgtctgattatccatatgcggttttccttcagcatctgtggggattggttttagaaccaccacagataccaaaatctgaggtgttcaagaccctcatatagaatgggatagtatttgcatataacctgtgcactactttaaatcatctctagattacttataatatctaatacattataaatgccatgtaaatggttgttatactttattttttatttgtattattttaattgttatattatttttaatttttatttgttcacatatttttgatctgtgatttgttgaatctgcagatgtggaactcatggatgtgaagggccagctgcagtaaaatgaaagagcaaaaatgcaaatgtacaaagttcaaacaaataggaaatttaaaggcatagaatttgataggcaattacattaaactgttgataacagtaattagtgatctgtatgatattaaaaaaaaaaagcaaactgtatatataaaacttactttctccagttctggaggctagacatccaagatcaaggtgttgacagggttagtttctcccaaggcctctctcccaggcttgcagacagcatccttcttcctgtgtcctcaggtggtttttttccctgtgcccaagcaccgctggcactgcttcctcttcttagaaggactagttacactggatgactaatccttctacagagactgctaaggtcccactctgaggcccttttttaaccttaattaccacctctaagtccctctctctgaatacagtcacagtgggaactattagggctttagtagactgatttgggggaacacacttctgtccgtaacagtgccacataaatatctttagcaggattgattttttaaaatccctaaagatcgtgagacatgttaaggacgctttttagtgactctgtaataagtgggtggaagaattgggagttaaatccatctgatggatcaggttttttatttttaaaaatgtgtatttaagaaagaaagcattttcattttaactgccaacaaaactaaacttcatgtgttttccaatacagtgtcacatgcagtttttttgaattatgttgagacaaggcaattttcagctaaatgttctttagaagctaatgtttgaagatattaaatatagattaaattctgaaatgtagttttcattctgtactttttgcaagagaagttgcctttttgatgactctggccaattgttattttaaaagtaaatgctctttctcccgatttgattgtggcagcatggaggaatctatgtaaagcgcagtgccaaatttaacgagaaagagatgcgaaacaagttgcagagctacgtggacgcaggaactccagtaagagcctacccgtttttatttttcttaccagctctcagtttctaaatttaagaattaaattaaaatctaagaattgttttgacaatgtattttcccatgtgtaattactaattcagggttatgctgaggtaacagaaaccctctatgtacaggtaggcaggtttttcagccatcagaaagattgctgtaaacaactaggtcctttgctggtcagtggaccttaaagaggaataaaaagagcatttggtgtcgttcagagtctataaatagaactaactgcattttaacctgacatttaagctagtttacaagctcatcttacttcttgtcttctttagtatcagatttggttttagaagcagcaactgttttctgttagtgcaaattttgaatgtcttacatgtacagaaaaaccaaaaaaggatgaatctctacaaatgttaaatcattcagtgtaaataatattttataaaactttattccacaaaagtggggagagttcaatctgctttgtatagaatgctgattgctgccaaaggcttttcccctggttccctccggagacaaagcaccatgatcaccggggcgacttgggctttctctttcagtacatgacatgtgctcagaagcttagctcgtgtgcacaggctttccctttcctttctggctccctccctctgtcttccctcctctcctcctgccctcccctcaccaggggtcctgggcagcagctggagctcatggtgaaggaagaattcttcacggtcagctggcgaagtgcctggtgtgagcattgtttattcacatgcctcttctaggtgtttttacattagaacattgcatctgttttgggcatgtgttgggtgacagaagcagaatggaatgagatgaacagtgaccctttatcctgttatagctaacccttgagaaccaagcttggtgtcttcaaagggtctgtttagtctgaaacagtgtggtgaatttgggcagaattgtggtcattgcatgtaggtctccaaaagacagaataagttggtaatatggtttatcgactttttacaaaaaaaatttaaaaatcatgaatttataccttaaaatgtccatcccacttctctcccagctgtccagtcaccccagcaatggatgactgctgtggagttccttctgtgtcctgctgtgggcattgtatatatgaagcaaatgaagatagctgccttttgggtgatgttggcatcctatgcacagtggccccttgcttttttgcccccatgaatatagctgccagtggcgctagggctgaaaaaatcagctctttacacttgtcatgtgtcttgtttatgtggctgccttcgtgagtttcttcttgtttttggtttgcagcagtttaagtatcatatatctgagtgtcatttaaaaatttttacctggattggtcctctgagcttggatctatgatttggtgtctgttattaattttggaaatttctttgctcttatttccttaaatattattcctaccccagtctttcttctccagttatgtttgtgttggttcatttctcgctgttctttagttcttagatgcattattcgttttttgttggttttttttttaatttttttttttacgccccctcccttttttctttttgtgttacattttggataatttctgttgacccacctttgagttcatggattcttcctttggctgtgttgagtctactggtgagccagtttaaggcactcttcatctctgctactgcgtgtttcattcctcacatttccctttgaccctgtttcatagtttccatctctgtgctagtgtatctatctgatcataaagcttagtcacgttttccagttgaacctttatcattttattatacttgcagttctcttaaattccctgcttgataattccaacatctgggccatatctgagtctgcaaattttgattactttatctcttcagattgtgctttatcttgcctttgtcatacttcctaagattttgcctaacgctgggccttttttgtaagacaggagaaatggaggcaagttgtcttgatacctggaaatggatagacttgtctttctgcttggcctttagtgttgaggagtggagtcagtccactgaggaggtgcactgcatttgggttttgctcatgtgctttttctcacagcttcaggtttctgtagaactcattactttgtttgtaggttggggatgtcctcccgctagagcttttcctcagtgtctatttcacactcagcgttttcacatagcaccttggagtggctctcttctttatgcctttccccactatacttcttggatacttgttactgaactctcgctagtttggtggtagaaggagagggaagggaagtgtcttttcattcttagggagaatctcaggggtggagccttctctgatcctgccttgcttctggctgtaagtctgtgcccagtatgtattcctgcctttactaagagtttttccctgttctcttcacccagcctcatcgagtattcatccgtgccccatgggtagcagggttttgttgcccctgttcatcagtttcaggctgctgttccataggaaaggtagaaagaaggatgtgggctgggccctgagcccttcccacagggctgcttttccctcccacaagcctacatccagtcttccctgaccgcagtgtgttttcctttttctttgtcttgtgagtacacaggaggtctgtgggtcgagcctgtgaaatgtgctgcattctccttgtgtctgtagcccaggggttcgtctgttccactggctcatacttggctttctgcaaaattgttaaaatttttagctaaattctttttactggtatctgttacattggcccccaactaaacaaccacttgcatcttgtttctcctttgagttttccatgtttccttagacttttgggttagttggttgccttgcaaccttgcagctctctgaagggtctaagaaaagtcatgaatctacagcttgtcagtgttgttgttgttgtagggttggcagtagtattccttcagcattctacatacttaatggaagccgcctcccatttttggttaataaatttcaaaacttggaacaatgttagatttacaaaaacgtcagaaagaacagagtgttcctgtttattctttatatagcctttttttttttttttttttttttgagttggagtctcggtctgtcacccaggctggagtgcagtggcacgatcttggctcactgcaacctctgcctcacgggttcaagcaatctcctgcctcagcctcctgagtagctgggattacaggcgtgcaccgccatgcccggctaatttttgtatttttagtagagacagggtttcaccatgttggccaggctggtctcgaactcctgacctcttgatccgcccgcctcggccccccacagtgctgggattataggtgtgagccaccacgcccagccttcttcatctagctttaacatctaatgttgacatcttacataacatggtatatatttgtcaaaactaagaaataaacattggtaccacactattaattgtactacagatttttattcagactttaccaggttttccactaatgtcctttttctgttctaaaatacaatccagaatagatacaaatccattcaacttcagtgttttaaattattgtttttcattatatgaagtgctgtgtggtttttgtcaaatctgttattttggttttaatcttcaagcttgtctttgtttctttaagtgataaaggcataatttaaaaggtgtgttgggttatttcagtgcctaaagtcttgtctgagtcacttgttttctgctgttcttgcttatggtactttctttccttgtttgctttgttatcttcctttgctgctggctgtgtttggttaagttatttgtggaaatcagttgaagcctcaggtgggagtgtctttctccggagaacatttctacctgttttagctgggccccttaaggctcctctagcgtgggccccacccaaacgagattctgagttgaaggtgaactgagccattcaggcagtgcagccagggttgcagatgcacgtgagacctgctcacctctcatttactttcaccctgagagtagagcctttggtgtttcgttcacttgtctgattctctcttcacagttctattagaaggtccatgggttttggtttctgtgcccttcatcttatgagtcttgtaaatcaaagttctgttttatgcttacttctgctttactgtgtttgcttaatttcagtcttaacatcttgccaactcttgggtacttttaaaataatgttatatccagctttttaagttgttttcagtaggaaggttgattcaaataacctagtctggttatgggctacgagaatagcctccctgttttttgtgggcaaaattccagccttttatgttcctagcgcagtgtggataacagactggcaggttcaagaggccgtgctgagcagctttcactgtaaggtcactgtcccaggtcgggtttctaagaatctggatggttgtttcatttcttaatatgtacgccctgtgagagcggatacatcttgctcaggttcttatgattcttttgtttctgaaggtgaattaagtaagtgacatggtagaatatgttaagtcaactttcgtgtggcttactagttctcatgaatctattccatgattgtatcagttcttattcggtattagtatttaagaaatgcagaattttgtttcaaaaaatatatttgtattataagttgtgaagaaatacatctccataattattgctgggacaatacagtattttcttaaggaacttattggttgtggatgcaaatgaagcatatttgtgataaaaataactaatagaagtcattttgttagactatgagctagtaaaacttatggcacaaacatggagacttaacactttttcttccagctttcacttaagttccttttcagataggaggcagcctggtggataagagtattggttttgaaattagattcaggtttaaatcccagatcttctgtttaatctttattttatttcaggtagattttctggataacttgctatagcttatacatcagtacttgccacttcaattttatgttatggagagacggcttctttccttaaacctcacgaaccaacctctgctagcttctaagttttttcctgccacttctttacctctctcagccttcagagaattaaagggagttagggccttgctctggattaggatttgctttaagggagtgttgtggctggtttgatgttttatctagagcactcaaactttctccatatcagcaataaggctgttttgctttctaatcattcatgtgttcagtgaagtagcacttttaattctctttaagaacttttcctttgcatccgcaacttggctgtttagtggaaaggacctagcttttgacctaccttggctttcaacataccttcctcactaagccatttctagctattgatgtaaagtgagagacatgcaactcttcctttcactggaacgcttagcagccattgtagggttattaattggcctaatttcaatattgttgtgtctcagggaatagggaaacccaaggggcggtagagagaaagagagacaggagaacaggccatcattggagcagtcagaacacacacgacatttatcaattaaatttgtcatcttatatgggtgcaattcatggcacccccaaacaattacaatagtaacatcagagatcacagatcacaataacagatataataatatgaaatattgtgagattaccgaaatatgacacagagacgtgaggtgagcacatactgttggaaaaatggcaccaatagacttgctcgatgcagggttgtcataaaccttcaatgggaaaaaaatgcaatttccgtgaagctcagtaaagcgaagcatgataaaatgagatgagcctgtcactcctaagaatgttcctgtacaagttttttgcatctgttacttaccttttcctatttgtgaatagtatcttttttgagtacgtgtgtttttttatttttatacatttatatgtatcttttgaagaacatacttttaagcttaatttattgattttttttctctcataatttccactttttgtatcctatttaagaagtccttgccaaacttaaggttgctaagattttctcctttgttttcttctggaaattttagagttttgcttttacatttagttctaggatttatttataattaatgttttcatatggtgtaagatcgaagttcatatttttttaatataggtaaccatcactatagaaaagattatttccccccaatgtttgaaataagtagactgaatatagatgggtctgttatccctagatcaatggagcatttgttctgttatattgatctatatatatatatccttatgccaataccatactgtcttaataatgcttgctttgcagtaagtttttaaatagtgtagttgtcttctaaatttgttctttcttttcaaagttgttttggctattttaggttttttgcatttctgtgtgaattatagaattagctcgacaatttctacccaaagtttgtgggcttttcattttgattgtattgaagatatagatgaatttgggaagaattgatataacaggattgaatctttggattcatgaacgtagcctgcatttgtttacttaggtcttctttatttatctcagtgtgttttgtagtttaatgtacagatttgcacatcttttgccagatatatccctaagaatttcagtttttgatactattgtagatgacatttaaaaaaatttcaagtttttgtttgttgacctaggcatatatttgactttttaatatactaaccttgctaaacttatttatcatctagtaacttacaaaatatattccttaggatttcctacataaacaatcatgtcattgttatagaaataacagttttactttgtcctttttaatcttgatggcttttatttctttttcttgctaaattttctggctagacctcctagtacagccttgactagaactggtgtgagggaaatcctttccatattcctcatctttagggaaaagcactcattcttttatccattctttagttcctagccccattgcccttcctaaattttttctcatcattttccttcatcacaccttgttctttttctttgcaatcatatcatgatatgtaacgacatgtttttatttatctgtttaatgtatttcttttcctcacttgtccatgaagggaaggaccatatgtgttgttatcctttgtgcagttcctggaacataataagtatataagaaatagtttctgaattagctgtgaatgaattcatgccttcctgctgtctgtcaatgttcttttaaattaaacatctaagacagcaaataataccacatgagttattaacctgagaaataatcgttttatttataaatgactgagttgaaagctgatagcccacagtaattgctttcatggctttgaatataaaccttactgttacaaaacacattttcatgaaaatgaatgtgtggtgtttggaactagctttaatgtttgtcttcctgtttttccttctagttgctataatataataaggaattttgtatgtttttcctaattgtacccacttttctacattttcttaacagatctggtgaatcttcattattaaatataattatacatataaattattgtttaataataatattaattattaaaaataatataaattattaaatataaagatacatataatattatctgttaatttctaagttaggtgtgggttctgaagactattatatgaatgaacaaaaagcttgcatatttgcgtggaagctgaaagtacgaaatttttagataccattataccagtatctaaagaaaaaattcagtaccacataggtttttaagtaggagctgtatgatcataggtcatccagatgaaggaaggcttctgtaccagacgtacagaggtagacagtgttgtctgagtactgtctgagatctggcaagaatgaatccaataaacgtagttttctcccatgagctcctgtcttgtttcctgtattctgtttgtatttgaaaagatttggtgtgcataacttatttttgtcttttggctgtcaatcaaagttattagtgtagtttttgtaactcagttctcaagctaggagtttttgctgtataattttaatgtttctgtttttactttcctaagcagataagcgtaaaaacttagactaattgattacttattaaacgtccagcttgatattcttctttatattattttagtttcagtttatataacaaatgaggtttcttataaataaaatttaaaatgcactaaaggagctgtgtgaaataggaattctgtgtgaagcttttgaatgtgaacatttagaacgtttcacatggtgggaatttactatatgattttcatcaaatgaggtactttttagtgttggtacttaacgatactgatttctaaaatttgtatttctaaaaatgacgtattacaggatctgaaagggcaaaaactcattgaggctttgtatgagtcagcgtttcatggcctatttttaattagtgaattattagcatataattagaaatgtttttagattcttcatggctgacctaccaatgaatgtagcactgcatttaaaatatagttcacgttatgttcatatttaattgttgcattttgtttgcccctcttgaaacgaaggtcacatgtaaataaatatacattttctcctactgtaggaaatactctgttagcattagtaggtttagcttttttaggttaacaataacaaaaacaaagctcacacaaaataaaccaaatttgctctatgtcccacagatgtatcttgtgatttttccagaaggtacaaggtataatccagagcaaacaaaagtcctttcagctagtcaggcatttgctgcccaacgtggtaagtaaaaatttgagtgtttgaacaaataattttcaaagataataacatttttagtttttcttcctggaaaagatacttttgttttacagttgaaggaatgaatgtattcattccttgaattagtgtacatattatctcttaggaaatgaagtttcttctccttaattcactttcatgctattattacatatatctgagaaattaagttgaagtgcttgttacgatacatattcttgtgccatggatttatttaaaatctatctaagtacatgattatgtagatggaagctttttctacagtgtatgggttatatgtaatggagcttctgttttgtaagatgacagacctaagttggagtccaaactcgtacttttattagctgtatggttgcaacttggaagttgtgtaatgttgctgagcttgcttcttcatctcttaaaagaacatatgccttataagtagatctaaatctgtgtgaggattagattagaaaatatgtcaagtttctattggagaagttacacaaagttggtccacagtgcttggaagctgttaatgtcttcaacaatggtaatgttcttaatatccatattttagaaaattgaataattggtacaccaataagctatgcaatttaaccaaattgggaagtatacagaaaacagtggctatgctatgttcttagaggtgtctttgaagcttgactgtgatttagtgtgtgatctccatatgttgatagtcactcactgagcaaataccttgttggtgacattacagcagggcctatgacagtgctgtctaatggaactttctgcaataatggtaaagttcttcatctgttctgtccagtgtgctggctcctaccaatgtggtttttgagcattcaacatgtgactagtgcatgaaactaatttttaattttatttaattttagtttaattaaaaataagggggagtttttacaaggtgcttacaagagcagatatgtcataggtatatgacatcatttgtaacagtacttttaaaaaatgccagtttgtttttaaacacatgtcctattaagtaaggagtgtttcagaataggagggttcagttggtctccccatctgccagctctcttttgactttcattgcttcctctgtctaatagacatgacgttctgtcatttcagttgctcttttgcaatgccattgtctcttttgcccttttcacatttattaaacagaacaaaacaaaaaccactctcgaatctgtagtctacctttgttgtaagcactttttccagtactcactctgccctcaatttgttttggtctgatttgaaattctctccctagacttctgtggggctgttctccattatcctcccaactctctggcgattacttcctagcctcctttccagcctctttctgcttcatttctccctgctacatgtgttatttccagtgtcaggttttggtgtttgattaatttcactttttgtttctcatggtggccttcctctaaatccatggctttagccatcgtttccttgactgctgatgactcgcaaaagcttcctcccctccatgtctctctgcctaactctggacccatttgtacaattgtccattagagagcttcgcttgactggcccaaaaggatgtctcaaactcagcatattgaagatagaatttatccttccatgcatacactcatatttcttgtcttggtaactccatcattcagtttttttgcctaagttttattcacaaaaagaacaaattgatagcagttgcatacctcttataggaaacttagacatggaggaagaagctgttcagatggggtcctgcagaagtgcaggcactgtggtaatatttaaacttttctcagctgttcgaagggttttgttttaactaattttccttagacttgttttaggtatttggctttctaatggttataagggatgtggaattaaatgtatcttaatctgccacctggacccattaaagtaagcccctatggtggttttttttttttaattgccatggttaaaaccatagttgctagcgaaggtgacatacttaagctttttgaactctcttaaaagaaaacagaaatttaatgatgtgtctataatggcaaaccagatacctagaatttccatgttattcatagggtgaataacactggcgattgtagagatttgagagttctttcaaaacaggagaacaaagggaataagctacaaagcaatttttttctttgtagacttaactgaataaaaattatttttatgtctcaaacatcatatgaacaaatttagttggcaaatggcaagctaataatattttataatataggatattaatatacttaatattacaaaagtgcttcataattagaaaagacataaactagaaaaatgggaaaagggcatgaataagaaattcaagagatacaaatgacccacacacttgaacaaatgtttattctttctcataatcaaagaagtagaaattaaatgaatactttgaagccaacttctgagaaagcatagcaaacaagaaagctagtgctcagctttgtgtggtaacggcactctcgctcttaagaaggtgtgtttgctccctgtggctgctctcaggcagggccacaaacttggtggcttaaaacaccacagatttcttctcttacatttgagaagtctgaaatgggtcttactcagctgaaatcaaggtgttggcagggctgcagtcctttgtggaggcttggggggatcttgttctcctgtacggggtcctgtgcttggttcggggtcctgtgcttggtctgggatcctgtgcttggttcgaggtcctgtgctgggtccagtgctctgcttttaccaccttgaagttcatctggaaatggcactggctcgcccacaccatatagctgactctggttctccctcctcctcactcgctctaaacctgtgtttttggctgatttctaatctctctttccttggcccttctgcagcttgcagggccttctgcagctcttgtctgccccagccccggggtctgcccatcccagtgctgggctgttctgttcctgccctgcctttcctcagcccttggcaaccctgtttgttttctcccttccttagcagtggagaacatcgtaagatcaatgctgactgccttctgcagccaagccaggccatttcatttcagccgagccaagtctgtgtggagcagttcttttatttttctccttttgactacctcatggttttcacggatttttgttctcttcacattcaaggattttttgctttcagaaagttatatttctctggaaagagtgcacccaatatcccttttgatttcaaaatcttaatgtggagtctcttgacttggatttctttggaagaaactgctgaagctgccatgtctaagaagaaaactttggagaaaaattttcttcttagacatggcaacgtcaacagtttctaagctcttgattccgtctaccctgtctccatcgttgcctcagtcatctgccttacttctctgcaggggtttctcccagcttgcaaatgtactccaattctgaaataactaagtctatagctgtgcaaagagaagtctgggccccttgctttcttgtgtttgactccatccactctccagaaatgaatcccacttctcacttaaccactgacctccaaagcatcgtatcatttgtgtcagttgtcatatttgttaactttcacataacttttgacattatttatacctttataaccaggaaataattttaactttattgtagaaataaacaatggagtataatttttcttgttgaagataaatatcacctcctcttcctttaaacatctcttccctttgtttttgtattacattggtttcccccctttttttatttcctgggttgtcgtattccctgttattatttttacctttttttttttaatgtggatgtttccggagtctgtatttcttgccttttcatcttctgccctttattattctcagccactgccattacttcagttatccattcccatggtttccacatgcttagcttcggttgattcttgccattttacagaccatatttccaactacttctagaatgttttgttccttcagcctcagtatgcccaatttgaactcatgttctctctcccccttctttcttccttctttctttcgctctctctcccttccttcttttctttccctccctccctttcttccttccctcactcgttctctcttgcttgcttgctttctctcctctctctcttttctttctgcattcttctccctccctctcttccttctctcccccactccccaacttccaggctaaagcagtcctcctgagtagttaggactacagacatacacgtgccaccgcgcccggctccgtgttctctttgtttccctgcctcctgctcttccacttatctttgcatggcaggtgggtgcacgcaggcatgctctgcatgtcttcctcttggccattccccttctagttatggtgtggctttatctacgcgttctggagcagaagcctagtcacaaagctatttttttaaaacattcatgataattcatttccttttatgttttaaaaatactagctttctgtctttatttccttactaacttacttggatgccagtaattagttgttttagtgaacaccacagagtgatattttgaaactttggacttcataaagttggatgagctccagtagcaaagaaggaagtgttaactagtttaactgacaaataaatgcttcccagcttggtgtgcgattgagatttttgttgcaagtttgtgaatcaatttaactgcccctgccctggggactaaagtcagatacgtgcttgtgggaatctttgtctttcccacaccaccctgcattttaaaacctcttgtgtgggacagtcccaccatgtaatagctgttcttccttactcagctactttccctccagagaggccagtagaaaatctagactagttttttatagtctattttcatgtcacttattgagagctactgttttctgttaaattgtcagtaaatattttaatcaaggaaaagggaggtaataggaaggagagaagaacaaatccttaaccctagtaggaacctaatgaatgggatttgttctggataattgcagtagtcccccagctaaagaaccttttaaaaatatgtcagatatacccaagaggattgaaatcgtatgttcatacaaaagcttgttcacctgcagccttcatatgcaattcctatgaatgttcatagcagcattattcataatagccaaagtatggatgcaacccaaatgtccatgaagcaattaataggtaaacaaaatgtgatctgttcacacagtggaatactaactattcagccataaaaaggaatgaagcactgagtcctgcagccacacagatgaacctcagatccatgctgagcgaaagaagccagaaacaggaggccatgtgctgtgtgactgtatttctaggaaatcttgagtcaccatgggcaagatgctatcacctttgttcagtggccagaagcgagggcactaatatttacccttgccggggtctactagattgaagcgtttccgctaggccataaacttccaacacggtgacttgtacatgtagatatttgatcaatatatagcaaatgaatattgatttaaacagaaaaaggcaagtgagagtgctttctaaacttagagccctaaatatatgaggttgtggaattaatagattctgttgtgtgtgtttgagggaatttaaaaataatttagatgttaaacagtatattgtggaggtgttttgtaactaattaatgacggcactgaattgacttctaggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacgggtaagtgtgttcacgcacctgaaatgcctgtacacggtatatacagtgcacatgtttatgtagaattcagttttacaaagtaggttaagtgtacttttttccttcattacatttacccggtatatttttcaagatgttattaagatgtaacagtggagatttcattagtcctgcaaagtgtggtatttcttggctgtcgtgtgagtcctgtggactcaccaattatcattaatccagcctctttctactcaaagttcacacttaaaaggaaagctctgtaaaagggaggaagacgtgaagaaggagcacgcccggcagtactgagtgcacgttattagtcagtgctgcccttttgctgtatttttcgtaaaatatttattaaatttgggtgtcattgtgacaagaagaaatgcagttaagtgtgacctttttttttccccaaacatgttaggttttaagaacctttgagctattgtcagatataaccagaaaaaaatagaattttaagtgagcaggataacttagttaaactaaccaaacatagtgttagctgttagagaaatgtaaacatggaaataggcaaacagggaagtgtgtggagtttctgtttccttttcaaaatatctgtttgagctggggttgagagagaacactaggcttcatggggtttttttgtttttcgttttttgttttgagacaagagtttcgctctgtcgcccaggctggagtgcagtggcgcaatcttggctcactgcaacctccgcctcccacgttcacacgattctcctgcctcagcctcctgagtagctggaactacatgcgtgtgccaccatgcatgactaatatttgtatttttagtagatatgcgatttcaccttgttggccaggctggtctcaaactccttacctcaggtgatccacgcacctcggcctcccaaatgagctttgtgtttttacctcatcagctgtttggggttgagccactatgtatgtcagtgtgcttgtatcagtaggatctactgagggcagatgttcaaaatatgagcctccagcacgttttacatggaaaccctcacctgaagcattcgtctgaagttgatgtgccttggaaattttatagagtaatatttttaactacaacaaaacatttataaaagtagacattattaaagcattcagaagtgagcaaggatagaaattattctgcccaaccttacacgtaggccttctagacgtagtactgtgcaccgttacattatctaacactgtctgtgtgtcatctttggatgttagggatttttccaaagttcagtgagattatagttgtcaaatgattagtctgttaaataatgataagatgagggtcactcaggttttaaaagaaaagctctttgactgaaagagagagcagctgtctactgcagaaagttagggagggaggctggaggagtgaggcccaggggctagctagtataaaaattggttatggtcgaaggaaaaaaaaatgtaacatatttatatctgaaagatgattgttctcataattgtatataacacagagtaattgtaaagtagaaaactaaggtgtttttcattttagatgtaaatgtttagaatatgtaatgcatcagtttaaaaattaaaactgtacgaaatgcacagtgaaacgtcttccttgctttccaccctgctacctggccttcccttctccttcctagcgataaccagttttcttaatttgttgtgcgttgtatgtgcaaatttaagtatatcttcttattctaccatccctcccttcttacagaaaagtggcatattaatatttttctcttttaaactatcgaaggagttacttacctatttttgcatttgaaaacagacagttcatcaagattgtcgttggtttattaaacatagtttaagattaaacaagtgtttataaccaatgaaaaacagatagactccccataataaccttgtttaaatgctgctacttttatcatgtcccctcctgtctaagaaccccttggttcagcagagctcatgggtaaggccagcctctgttgcctgccatcggaggaatgcgttccagccgtgatctctgccttgccttcgcttcctcctgtgctgtgccgtgaagcctcggccgtggtgaagctggctgactgagtcctcctgcaccccatgcatattcagtagttgaaggctttgtgtggccaatcctgctttccacaggaaaccaccctctcttttgttgccctcatccaaggctactgttctcccacagtgacaggcggcacctttcccagcatagcactgtgccttctcctgcccctgctcttgcagtactgctgtggcactgatggcgtgtgttacagtgctggcacttagcacagggctctgcctttctctcttcccagccgcatcataagtgccttgaggaagccaaaaccttctgtgagttgcattgcctgggttccaacctcccactgccctgcttatcctctgctacatgtgagctgactgtggctttggggtggtcactgcctatgtgtattcattacaaattgtctccttttgaaagattgacctttctgacttacccagataccataaagaaaataaaatcttatcacttcagtcaaggataaagtatttctgaattaaaggaaaaatacaccagagtaaaatcaagactgaaagacaaactgggaaattatttacaacctagatcatagaaaaggggtcatttccttcttgcgtaaagtgcacttacaaattgataagaagatgactgataactagaaagaaaaatgggtaaagaacaacaatagacatttcacatttaacctcattcatgataaggtaagtgcaaatgaaaactacaggggataccttttttttttttaatccattagattggcaaacatcccaaggtttgatcataggctcagtgggtgagattcaagtattatcaggcatttttatactttgctgttaggaatgcaatgtagtacaaacctttgtagaagttgctttggaaatgtctctcagatgtacaaatgcattcacattttagatttagcattcccgctttctgagacattattcaacatgtatacgtgtgcacataagatataataataacacgtttttccttctagtgtgttgcttttaacctgtagcttgaaaaaactctgctttcattgtttttttttgttttctgtcactggctcagccctgctttcaattgtttatatgaattgatgggtgttctggtctggttataatctactttagtttaagagtcactttaaattatatgacatctgatataagttgtgttaggtagaaaattctgtaacttggaatactgtaagtactttgtggccacatttcattagtattaaatattatctctatatatagtaggctatttaatattcatattttatgatgcaattaagaaataatttttttctgaagttggtagattgttgatatgccatggcccagtgtttctcaaagcattctgggggatcactgtttgtcagaattagctgcagtgattgttgaacatgcagggcctctgctccactccacgttgctaccaggacgctctgcaggtgagagctgggaagctgtagaagctgcagtgctaacaaatgctacaggaattcttgtagtcaccttcatgaggtcttatgttgaggagaggcagccagtagtgtcccttgtccttcccgttttatggtgtaagtttcattttaagggaggtataaatcaaagcccacctgggcattctctcatggttcactgcttcttgtaatcatggaagatgtcattgcggcagagacgaaacagtgtagtttgattactattgatttttttttaattatttttctgaagtggctgttgtaatgtaataaattgtgtgcttaaggacaacctttggtattctatttgagtattgtgtatgatcctagttaagttttttctaccagtattttcatattacaacatatttactttccatttctattaatatttttatatttaaagtatggaggccgggcacagtggctcacgcgtgtaatcccagcattttgggatgctgaggcgggtggatcacaaggtcaggagttctagaccagcgtgaccaacacggtgaaatcccatctctactaaaaatacaaaaattagccgggcacagtggtaggcacctgtaattccagctactcaggaggctgaggtaggggaatcacttgaatccgggaggcagcagttgcagtgagctaagatcgtgccactggactctagcctggctgacagagcaagaatccgcctaaaaaaaaagggatcagggaagaggggattacagataacccaaagaagaaggaaaaatctccacaagttcacctgtccagcggtaaccccaatttggatattttcctttaacaatttggatattttcctttaaatcctcttttttataatgtctatatgttggagagagtatgtgcctttacgtattttttaaagatgagatttctgtgtgtgtctatatctcctgttcttcatattttcttgtgtgttataaacagctgtacatgtcagtatatatacttccgtaacttttttttaaaggctatatagtgttcattgatgtgatttaacagcagttatctccccggcttcatcttgttggaatgtgggtcctgtgtgttgccttcagagcaaatggggcttggttttgcagcaagtagacctgtgacctgtacgaatagttggaagactttctctattacccaagtgtatcagtatactttagtgcctactagaaatttatgggtagaaaaacaataatatcttagagtattttttcctagattccctaaggtgctatagggtgatttttactcatgtaacatgaactatccttcaactaagatagtttttgcaaatgtggatatataagtactttattaaacctataggaagtatttataccacttatttcctcccttcagtgttagaacctcctaaatggcatttgacattgaactgctttccactttgtcgcatgctcctctcattgtccctacctgggtcctgaaccttagggacttggctgttatagccccaccatggctacgctgggccttggtcgtctctgagacttagtttcttcatcttacaaggagataataacagcccctgcctgcgtagaattgcagagatcaaatgaaataattaacatactcaaaagcatgccgtaaacacattctgagcacatgtacgttttaggaaaaacaaaaggacccatgcacatttcggagtgcttttgtctcagcagcactgcctcttcttccaaagctgacgtcttagtagaggccctgccacgtcctgagcactgtactccacgaagcattctatttctgacattcgaaatgcagtctgttccatcttccttacaatctgtatgccagcacttgaaataccgggtatctgcagtgttgaccaggtgattacttaattatggaaatgttgaggtggagatctagataattcagtgaaggcaggaaaattggtgtcggaatctgtctttttatgtgtcagaaatagaaataagatagggtgagaagtaatttgtggctaaaacactataatagctaacacatagtgcatactgtgtgccaagcactcctgtaggtgcttgaaatcttctattattattatccctactttatagacttgcacccttaggcacagagaggcggacagttgtccaaggttaccccagaggtggagatccaggctacctgactccaccatgtgtgctcttccctagggcacagttgtgctgctaaaaatactttttaagcagttctttgattattcagatgatagtactgtaggaaaattaagacaaaaataatgaaaaattaaaatctttattttagtgttttgcacatgtattattaaagccagtttactcctggaagtgtgtaagaatacagggtatttttgatcacctaaatgctgcatgttactaagagctcgacactgaagtcaagaagagcagttgcagagagtacttagcaaaaacgggaagtgtgtggggttgaaggagcaaagacaagtcttcctcggacggtggagtgtagaattcatcatttctcagaacacgtctttgaacgcattttcaatttgaggccaaaggtctcagcctcccactcggcatacctccctaccttagtcagctcttaaatcttaggaatatttctttgttcttcaaggaacttaaatatgttaacattcttacctgtccacagggagccccctacaaagaagggagtttctagtctccgttctttcttggaataaataatagcctcataccttgtgcaatcgaggctgaaaaagactgtctccttttttcaaataagcaagtcttagaaactacagttgtttacagggctcatggctattccacagtaataattttggttcttttaccaattatataatatgttaaaatatggcaagtatcaggaaagcaaggagtggcaatgattagaaaccaatggccaagttagagaggaggggcaattgctcccccaagtttgttgtggctgtgtagcagtcagtgacgagaagctgtgtgtcaggcgacaagcaaagttgaggattatcaggcgcctgtgagtgcccagctgtgtgccaggtcaggaggtgccatcgtgagccagaccagcttcctctcggcccctgtggagctcgcagtctggtggggaggcagcagtcaccatggtgacaggtgacacactaggatggggctggtggtggtaggcatttgcgggtcccttcagagaggtgagtatggacttagaggaggctccagcttcctattcctgggctgtctatagcactaaaagttgtcacatgaaaaataacatttggtactattgatttaacttaatgacttatgtaattgtagttgacttagaaattataacatgctcttctacttcagcttgaaacccccaaccaccagtttataatcctttttttttaacttttgtttatttttcctaaggaatctgtactttttcttcattttacaactttttttgtcctgttaccttattttcatttttactttatatgaccatgagttctaaaatagtaaaaaaaaagaattatttttgttctttgttagaatttctctgcaaagaatgtccaaaaattcatattcacattgatcgtatcgacaaaaaagatgtcccagaagaacaagaacatatgagaagatggctgcatgaacgtttcgaaatcaaagataagtgagtaacaacagttccagcacttccggaacttcggttcaactagatttcagtatagtcaacaatttgaaaccaatgtaaatggttatattgtctcaagaatacattttataaattcaaatcaaattttatgcatgtctgatcgtgttttaaactttacttgtacaaatcagtctaaaagaacttgttacagtgggcccatctacttgcattgatagtatttcttggacaatactacgtgataacatagcaaattaaattaaaaacaacaacaaacacacaaaaaaactttccagtgtcagatgcccggacctacctgtcaggtcacataaagtggtgttactgtgtgaggtctggctgttgggccagtgtgcgcagaaaagcaagggaggggtagaggactatgcggacgtgcaggtggacatgatgctgttatatttgttggaaatagaagggggcagttgacagcgttatatccaaagtgtcttctgtggttaattatattcagaaattttagccaattgttttattctctaaatatgtactttctgctcaagaaactatcattgttcttcttttccttgttttacagtacagtgtttttaattaaccctcctgggttaactttaccaggtgaaaatgattaaaagtgtaataggttaacaatgaaactttaagcttctatttttcattgactcttaactgtacatgatgtaatgtattcagcgagccattcaggaccactttggcccatggaagaaatttaaaagtaagatctacatgtattgacatgaaaatatgttctcagaaaaaagactaatgtatttaatgtcctacttattttataagtatttagaatacctctggacattttaaaacaatgattattgctagggtgtgtgatttataaagcaatagaagcgctttccctttctgtttgtgttttagattattatatcgggtatgttctgctatcataactttacaaatcttatgtaatatgggaaaatgagttaactatgctgttttccttcttttacctgcctttctaattctgtgggaataaaggcgtttttgagacagcccaggtgcagtgagcagtccatatccatggattccacattcatggattccaccaagcacagaccaaaaatactcagaaaaaaagggggctggctgtggtggctcatgcatgtaatcccagcactttgggaggctaaggcaggcaaattgcttgagcccagaagttcaagacagcctgggcaacatggcaaaaccctgtctctacagaaaatacaaaaattagccaggcgtgcacctgtagtcccagctactcaggaggccgaggtgcgaggatcacctgagcctggaaggttgagactgcagtgagctatcattgtgccaactccagcctggtaacagagtgccttttttcaaaaaaaaaaaaaaaaaaggatttgggaggatatgcatatgttatattcaaatacatgccattttattcatatatcagggacttgagcatcctttgatcttggtctctgccgggtatcctgggaccagccccctgtcgatacagagggaccgctgtctaagaaccgctggtcctatctttgacttctggcggaataggagctccatgtaaaaaggaggagaagctgcagcgggttattagccatttgtgagtcaggtcactgtaaaactttatcaaaagtttaaaagacaaaaagcatcctcataaaatgccttaaaaccacctgttgaaatattacatatacaattcatgtatactaatcatagagcatattaaagatattttagaagactagaaacttctattaaaccaagtttctggatgtttccgtattcatccttattttccagggacctgcataacttttccagcgtgtaatagctacctgattgatattttttgaattgaaatactgaagtgactaaaatctaaactttttccattctggccataggatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacactattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgcagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaatttgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaatggctgtgctgtttaacattttttgaccctaaaattcaccaacagtctcccagtacataaaataggcttaatgactggccctgcattcttcacaatatttttccctaagctttgagcaaagttttaaaaaaatacactaaaataatcaaaactgttaagcagtatattagtttggttatataaattcatctgcaatttataagatgcatggccgatgttaatttgcttggcaattctgtaatcattaagtgatctcagtgaaacatgtcaaatgccttaaattaactaagttggtgaataaaagtgccgatctggctaactcttacaccatacatactgatagtttttcatatgtttcatttccatgtgatttttaaaatttagagtggcaacaattttgcttaatatgggttacataagctttattttttcctttgttcataattatattctttgaataggtctgtgtcaatcaagtgatctaactagactgatcatagatagaaggaaataaggccaagttcaagaccagcctgggcaacatatcgagaacctgtctacaaaaaaattaaaaaaaattagccaggcatggtggcgtacactgagtagtttgtcccagctactcgggagggtgaggtgggaggatcgcttcagcccaggaggttgagattgcagtgagccatggacataccactgcactacagcctaggtaacagcacgagaccccaactcttagaaaatgaaaaggaaatatagaaatataaaatttgcttattatagacacacagtaactcccagatatgtaccacaaaaaatgtgaaaagagagagaaatgtctaccaaagcagtattttgtgtgtataattgcaagcgcatagtaaaataattttaaccttaatttgtttttagtagtgtttagattgaagattgagtgaaatattttcttggcagatattccgtatctggtggaaagctacaatgcaatgtcgttgtagttttgcatggcttgctttataaacaagattttttctccctccttttgggccagttttcattacgagtaactcacactttttgattaaagaacttgaaattacgttatcacttagtataattgacattatatagagactatgtaacatgcaatcattagaatcaaaattagtactttggtcaaaatatttacaacattcacatacttgtcaaatattcatgtaattaactgaatttaaaaccttcaactattatgaagtgctcgtctgtacaatcgctaatttactcagtttagagtagctacaactcttcgatactatcatcaatatttgacatcttttccaatttgtgtatgaaaagtaaatctattcctgtagcaactggggagtcatatatgaggtcaaagacatataccttgttattataatatgtatactataataatagctggttatcctgagcaggggaaaaggttatttttaggaaaaccacttcaaatagaaagctgaagtacttctaatatactgagggaagtataatatgtggaacaaactctcaacaaaatgtttattgatgttgatgaaacagatcagtttttccatccggattattattggttcatgattttatatgtgaatatgtaagatatgttctgcaattttataaatgttcatgtctttttttaaaaaaggtgctattgaaattctgtgtctccagcaggcaagaatacttgactaactctttttgtctctttatggtattttcagaataaagtctgacttgtgtttttgagattattggtgcctcattaattcagcaataaaggaaaatatgcatctcaaaaattggtgataaaaagttatttcttgtatatgtgataaagtttacatgttgtgtatatatgttgtattgccaaatacggctattaaatactacgtcatattttaaaggttcagtttgtagtgatagtaaacaagcagtgcactaagcctcttgcgggcatcatctcatctcactgtcatcacaaaccccatgccacagcgtagcttgaccactaaaagtaatgcatctgcaagcatactgccaggttttggatagtttgtaccaacagttaccttatcaaggtaaatcccagactctaaaagagttggtgctgtgtcactacatgcataactttaaataaatttcctgccgggcgcggtggctcacgcctgtaatcccagcagtttgggaggccgaggcaagtggatcacttgaggtcaggagtttgagaccagcctggccaacgtggtgaaaccctgtctctactaaaaatacaaaaattagccaggcgtgtggtggcaggcacctgtaatcccagctacttgggaggatgaggcaggagaatcatttgaatcctgcaggcggaggttgcagtgagccaagatggcgtcattgcactccagcctgggcgacaagagcgagactccgtattaaaaaaaaaaaaaaaaaaaaaaaattcctctcctgtttgagctttcccttacctgtaaagaggggagaatatgtatttacttcaaagagttcagggaaatgactctcactagtttgagattctaggtataaaaatacattcttatataattttaacaccaatgtgagagattattattcttgctaaaccaattcagttttatttgctgtctaaaatgtgtgaataagtaattgtccattattttctgaagtgttttggaactcaacacatgattgtgaggaggatttgttgctaaacatctttctggttattcaagctcgtgtatactgtgctctgttgagacatgcagagttactttctgtctgggtcacaggtcagttcttgatagttttcggacaattaaccagttttcatttgcccatgaccacctttattctttttcctcaactgcacccatcttttataaggtctttcagtttattgcagagaagatggtggagaaaagccggaattcccacccaccgctgccatccccatgttttatcattggctagagtggaaaatagcagtaactactgtgagagatcatttgtttatataatggaaacaaagatgaggaaagaacctggcttagatcagagaactgatgtatttagattcttttttttttttttttttaagacggagtgttgctctgttgcccagactggagtacagtggctcaatctcggctcactgcaacctccatttccctggttcaagcaattatcctgcctcagcctcccaagtatttgggattacaggcgtgttccaccacacctggctaattttttgtatttttagtagagacggggtttcgccatgttggccaggctggtctcgaaatcctgacctcagatgatccacccgccttggcctcccaaagtgctgggattacaggcgcgagccaccgcgcctggcccaatgtatttggattcttaaagaacactttcaaattaaatatcagttgaagagaactagaactaaagaatttctgtgtcaaactgtttagcaaatgtaagtagaagctgggagatgtgtcctggaatgaatgaatacatcagtaaaataccatacgtatgttatgatgttattgtttccttgccttggttgatttggttttactgtgaaataattttcaatatagaattgtgatcgttggaatttggtcatctagtagaaaatgagaaagaagttaatagctatcttccttaaagatttctgaggttgggattaaggtagtgttcccaaggtgttctaaaacggcagcgagagctgtgcactcacttcacaaatttgaattcctgctctgtgttaggcgctgtgctaggggcttagcttagcacagttatttccagaggttcctgtgtatggtgtgaagaaagcttcacaaagactgtagtgaagccaaagatatagtagggaatgaaagcaaggcatcaccacttcctgtgaggacacgttactgcacaggcacccgagctgtgtcatctctaccatgtgccttgttcaggttttggcagagcccctaagcatatgcccaggaagggatctatgtggaagttggctctttctgatgcattcggtgttagctggttctcgatggtcggtgattcttagctgaatccagaagggtgaaaacagttgctgctccggtgtagttgagctggagcatggcggcacatcagggccacgtcactgatgacaccatcagtaacacactgtgtttctcttaaaacaggggctttctgttgtccagatgatcaaaacacaaggttcttcataactcattctgtgtatcagtgtttcttgtttgggaaggagattggggaggagtggctgggagtagatggagagccgggcttacgggcatggattctagagccaggacacttcggtttgagtccctgccctgccctgccactggtcagcaagggactgtggtcagttttttattttttatttttattttttcagacagagtttcgatctgttgcccttgctggagtgcagtggcgtgatctcgactcactgcaaactccacctcctgggttcaagccattctcttgcctcagcctcccaagtagctgggattataggcgtgcggcaccacgcctggctaatttttgtattttttagtcgagatggggttttgccatattggccagtcttgtctcaaactcctggcctcaagtgatccacctgcctcagcctcccaaagtgttgggattacaggcatgagccaccgtgccgggccttgtagtcagtttcttaatctctgtgcctcaatgtcctgaaatacagaatgaaaataacagtgatggaacctacctcacaggcttgtgagaattaagcgaaatcatctatgtgaagcacttggattagtgcctgtcacattctgagtgcgcaaatgttagcaacttttgttacacacacacacacacacacacacatacacacacacacacgtccataagggcattctgccttatactagagctaataactttgttacattttaggtttttggtatgttgctctaatagggcatgtaacaaatgcaaaatagacattttcaagtaaaatgaagtatacaaaaaaaacccataaacgatgtaccccctcttcttgtgtactaacatctttatcctttttgtttccatatctcctcccctctttctgtttctagaagttgacataaatgaaagataatgagattagaaataaatccaatataaagtatgcctccatgtgtctaagtacctggtaatttctggctctgttctctccaacatggtttttattcctgcacccactctcactggctcgtggatagattttggttcctggtgtattttatgacttgactggcagctccagtctgacataaaactggcaatagaacttaaactgagcttggcctcagagtggtacagtgaacaacgacattgttctgagggtcaggagatctagagttgcggtcgggtcccaagtatgtagcagtgggtctcttctttctggactgcagcgtcccctgggacgtggctgctaaagaccttcccatcctacagtttcattctgcatgctgttccccggtgttgtgccagccacctgggcccaatgcctgggggtatcttcaaccacccctaccacctgtctctctaagcaagtctacttggtggtttcttcatccacctccatctgcttcccctctatcttcacccgctcaacaccctccccacccccaacgtccattaccactgagctcaaggcaatgcagccaacagcttccccagttgctctgttaggacctgtgagccacaaacccaccctccacatcagcacttcctagtagggcagccggagccccatgtggctatagagtccttgaaatcagagaagttagtgtacaatgccagacttggaaaaataagtacaaaaaataaaatagttcattaatcttcatgttgattacatatttgagtgatattttggacatattgtcctcaataaactatattaaaattaatttgacctttttttaatgtggctactagaaggtttaatattcgctatatggcattatatctccacagggcagacctgatgtacaagatgacttaaaggcgaggaactttcaccccaacctttgtgtctcaaaactgccgtgattcctggcactgattaggcaatcagcaacagtttgtttaactgattcagtaggcataatttgagataacattttagggttacctcaatcatagttatatcattaagtatcacctgaagattattttattttatttcattttatttattttatttattttattttattttatatttttgaggcggagtctctctctgtcgcccaggctggagtgcagtggcgcgatctcggctcacctcaagctccgccacccgggttcacgccattctcctgcctcagcctccagaggagctgggactacagaggcccgccaccacgcccggctaattttttcgtatttttagtagagacggggtttccctatgttggccaggatggtctccatctcctgacctcgtgatccgcccgcctcggcctcccaaagtgctgggattacatgcgtgagtcaccgcccccggcccacctgaagattttctaaagcaattgtgtttgaattttatagtccgaagtcaatagattattttaaaaagtaaatggcataatcaataaacatttaataaatgatatggaagttacgatttcaaagaatattccaggaattcttggagttcaagaaaaagcacaatcaaaaaataagatctgaagcaaatatgagaatattgaaatgtgttcattctgaattggccttatactgaatactatgttatactattctctgggttttttggttttgttttggtatatttacatttttttccgaattaaaaaattttgtcaactaggcatatcagttattttgtctaaaaatattctgagcggattccataccgtattatggttactaattaaatatgtcaccactcttctttgatcactaattcaagtatgggtggaatctgtctaaagcttgtaatcttcaaggaattgtaaaaatcctcctgtttcttactggtgtatttcaatgaatgtaatcaattaatggtactgtgattccaaatagtaattactgagaatatctgtttgctcttgcatctgcttataatgaagagctaaatttttgttgcttctgtctactcctttcattcttcccaaaggaaattacttgggatgaactgtgttgaaagacagcgcgtttatagtggcctcacaagtcacctaaagaaagaagccagagcgatcgatggcattttctcatcttcctagcccacatctttagattaaggtgctataaaatccgaaggaagggattgaaacggcctttgcaaaattatgactgagacagtgaaatagatcggacttaactgacttcatcttgcttctaacctctaagctgtccttgttcattcctgagcccaggctgaattaactttggtagaaacttagtttatagtttaaacaaagatggtaacagccctttcccaaagcagacctccttcttgcctggggactagattgcctttgtaggactaacttagccacaagattagaaattatggtttaggagtcacgcagctggacccctacaagagtctgaccctccctaaactgctcctaagatcaatgcttgagatattttgcagaccttgaacttgatgggtcagctggccccacccagatcaacaaactggctcatctgatcttgtgacccccactgaggaactgactcagcgcaagaacacagctcgactccctaggatttcatctctgaccaatcagcactcctgtatcactggctccccgcgactcaccaagttattcttaaaaactctgctccccaaatggtcagggagactgatttgagtaacgataaaactccggtctccggcaaaacaaacaaacaaacaaacaaaaccctaaagtgtgccaacagcaaaagaacaagctgagctactttagcaatgtcgcagttggtaattccaagatgtgcacaggaaaaaaaaaataattctccctgtgttgttaaaagaatgctcttgaaattagctgggcatggtggtgtgtacttatagctactcctgaggctgaggcgggaggatcactggagcctaggagttcgacgttgctgtgagctatgattgctccactgcacttcagcctgtgcaacaggtgagaccccgtctaaaaaaaaaaataatgctcttgtaatctaggaaatagttttggccctttaggttaggaataatagtcacgtgtaagataaatgtctaaatagttcagtgtagtgatacaactgggaacagacttggaggaagcctcagagagggagttgagcacagtgggcttcaccatacagaggaggaaaccacaatgactatagcaagaggaaatatcatgacttcataaatataaatatctaacactggaggtgtagaggtgggaagcggtagagacagaagggtgaccatcatgtgactttattataaggagtattttatttatgtataaaagaaatacagttgggccaggcacggtggctcacgcctgtaatcccagcagtttgggaggccagggcgggcagatcacctgaggtcaggagttcaaaaccagcctgaccaacatcatgaaacccagtttgtactaaaaatacaaaattagctgggcatggtggcgcatgcctgtaatcccagatacttgggaggctgaggcaggagaatcacttgaacccaggaggtggagtttgcagtgagccgaaatcgtgccattgcactccagcctgggcaacaagagtgaaattccatctcaaaaaaaaaaagaaagaaggaaggaaggaagggaggaaggaagggagggagggaggaagagagagagaaagaaagaagaaagagagagagagaaaaaaagaaaggaaggaaggaaggaaggaaagaaagaaagaaagagagagaaagaaagagagaaagaaagaaaaagaaagaaagaaagaaagaaagaaagaaagaaagaaagaaagaaagaaagaaaaagaaagaaagaaagaaggaaagaaagaaagaaagaaagttgacctttgtgcaatgctagggttaggaggcccaatctcccatgcagttgaaaatcctcattaaacttttgactccccaaaaacttaactactaatagcctaccgttttccagaagccaatgacataaatagttgcttaagacatattttgcatgttacatgtattacacactgtattctcacagtaaaggtagaaaaaggaaaacgttattaagaaaatcatagggaagagacaatatatttactattaagtggaaatggatcatcattaacggtcttcctcctcatcacctttgtgctgagttggctgaggaggaaagggaagagggaggggttggttttgctctctccaggagtggcagaggaggaagaaaatctatgtcttagtggaccttcacagttcaaacccgtgttgttcaatggtcagctgtatatatagaataaatcttatttcatatatttgaagtatatctcatatatgtgtttgtgcatgcatgtgtgtgtgtgtgtatatatatatatatatatgactttcagttgataataatttttcagacaatgctgaattgcctctctgcccatctccagtgttaaacccaggatctaggtggtcatcttggaagtatccctcgtgttttattggtggctgacttccgactctaggtactcagtgacacaatgacatcttttttaaaaaattcttctgggcacatagtagatgtatatatttacagggtacatgagatgtttggatacaggcaggtaatgtgaaacaatcatgtcatggagaatgggtatccacctccataagtgtttgtatcctttgagttacaaacaatccaattttaaattttaaataaaaaatttaaatttaaagttattattgagtataatcaccctattatgctatcaaatagtagatcttattcattcattctattttttaatacccattaaccttccccacctgccattcaacccccatctacccttcctagactctggtaaccatccttcttctatctccaggggttcaattgttttaatttaatttttaaatcccacaaataagtgagaacatatgatgtttgtctttctgtgcctggcttattgcacttaacataatgatatccagtttcatccacgttgttgcaagtgactggatctcatttttcatggctgaatagtactccaccatgtatacgtaccacattttctttaacctttcatctgcaatatttaggttgcttccaaatcttagctattgtgaacagtgctgcagcaaacataggagtgcaggtatttcttcgatagactgatttcctttcttttgggtatatacccagcacacaatgacatctttaaccaaactcttgtggcctcagagttaatttggaggcagctgagtttgagataaatggcatatcctttgtgttccataatttccatacatgcccaattacaatctttctgaacactttctagaaatcatattaaagcattacatgcatctcatgccatgtccatctgtctctcctggactgggacagtgataggtcttcatataatcttgtttaataagtgttaggttggtgcaaaagtaattatgggttttgtcattacttccaatggcaacaactccaattacttttgcaccaacctaatattttacagttgacaaaattctcagagcatcagccatacccacattcaaataaaagctgcattaaaaacagattagcaatcatttggtgagtattcactattcaatagataatgtgcaaggttctctgccttgctctacccagatgctactttaattctcacaaaagccctttgaagtagataggggtcccccaatgccctaccatgaatgcttattaccttttaaaaatctcatcattagccaggcacggtggctcacgcctggaatcctagcactttgggatgccgaggtgggcagatcacctgaggtcaggagttcaagaccagcctgactaacatggtgaaaccctgtctctactaaaaatacaaaaattagcccggtgtgggggtgcacacctgtaatcccagctacccgggaggctgaggcagcagaatcagtggaactcgggaggcggagattgcagtgagcagagaccaccacgccactgcactgcagcctgggcgacagagcaagatgccatctcaaaaataataatattgaataataaataataacaatctcatcatccaaaagcagaactgggtcctaggagacacctgactgttgctttggtgccacataagagaaatgaagtgtgtctgtgggggctgggagcagagagccttctcttccggtgctgggagccatggtttccccagttctccccctgtggcctcccatggggtgggggacgggatggggttgagggttgaaaggagtagagatccttaacagcgaggtagagtggatggatgggtgctgggtcctccccacgtcacttaggaaagacacatggtgcttttttcactggtttcaaaaactgaaggcagctgtgccccatgggctgaagaacttaaatctgagaactcgatgtcactggcggcagctcccccaacttgagtgaacctgttttctcacccaagaaacatttgaagatggggaaaacctgctttgcagaggttgttgtggggattaagtcaaacagtgtgacaccctgggcaaagaccagcacacaatcttgtgagaatttacgtagggtatggtagtggttaggagaaatcagcaacagagaaatcagtaatcctttacttgctgcaggtgactgtgcagattaaatgaagtgttgtacaaggacagagcacaactgcccagcacataacgggtgctccatagacgccctctcccatcttcataacacaattttttttttttttgaaacagaatctagctccatcacccaggctggagtgcagtgtcacggtcttggctcactgcaacctctgcatcccaggtttaagcaactctcctgcctcagcctcccaagtagttgggattagaggctcccgccaccacacacagctactttttgtatttttagtagagactgggttttgtcatgttggccaggttggtctcgaactcctgacctcatgcgatccacccacctcagcctcccaaagtgctggaattacaggtgtgagccaccgcacccggcccgtaacacaaatcttaaagtctttttaggggctataaactcgaaccacttcctagggaggtggatgttcttgcttttgctagaaaagccaatggctgatgtgggaggagttaaaaagaaattgagaaaatgacttctgtccaggtttgggggaaaggtctattttacagacctgcactctattctgcttccatggtctcatgggccggtaggggaggactggggtgctaggagcaggcacctttgcctctggcagttatacccctgggaatggagagggagagactgagaaatcagcccagcaccgccctttccggcctcacacatccaagccctcacacatggggcacgaggctctgtgcctggccaagcctcagttgttaggcccagttagtgctgaggatccagaggctcagggaagcccagggagtggcgcaggtcaccccacagggaagcgacagaagcgactctcatttgtctgacagcaaagcccagatgtccaccctttacatatacgtaatatgggacaggttctggctctgtggcctaggctggagtgcaatggtgcgatcacagctcactgcagccttaacttcctgggctcaagcgatcctcacactttagcctcctgagtagttaggatgacaggcgcaccccccatgcctggctgatttttgcattttttgtagagacggtgtttcaccatgttgaccaggctggtcttgaactcctggcctaaagcaggccgaccatcttggcctcccaaagtgctgggatttcaggtgtgagctgctgcgcctggctgttcacctttatattattattgccccacatgcttgaggccacactaagcagaaagccagctctaaagactgaaatgacaagggtagcctagagtaacaggggtaaaagaagctcctggtattttattttgaaaccatagaagatgagaaaaggcctagctaacggacaagatcagacacccgaggtttctcattaagcgtgacctcaaagcctgtctggacagccgcagatgaggagcagcgcctgcgttcatccacgctgggtgaaaggtaagaattcagggttacatgcgtgaaggggaaagcaagcgggaagcccttagcattcaagcccctgagctctggtgttgtccacccctgggggctgcctggtggcaggacggcacttcacgaggggagatggaccccagtgggaaccacactcaatccctctacgcccaggccgctgtcagacactggagtcctccgcacagtcctgcagccggaagcacacgctgccagtatcccctccctcccactcccagcctacagacaagcgcatctctgctgcattcatcgccgcacacgccctaaaaatgtcctcacgtgagtctgtgccagcctgcgcgcaaaccgtgagcccaccgcgctgtgtgcacgctcagcttcccccaggctgcgtccctcccccgtggggtcgcattccctactgggaaccactgccttcaagctggagctcggtcccagctagaaacacccccactccttctaatggggcagtaaaaaagcaaaactagctctgtggaacggtctctttcagatgtgcttccagtcccctgtaaaacgtgtcagctccatttaggtgaggtcatgttctctgggggcaagctcataaactcacggccgatgcagcatcccggggatctctgcgggggcctggacagcctgtccccacctcctggaggccagtcagagtccgggcagcccactccctggtctcacaggacctgagtcatggagcagagagaacctgcagagagactttcccatatggaggctgaggctagagagcatgagagcgtggccctgggctcacctggttagaggcagcatggggtcctctgcaggtccccaaggcctcaaccaggcctgggggcggtgggagcagctcactgatgatgaggaaccaacttcagtgcctgatgctgtagcagctgagtcacagataagcaggcactggcagctggcacatgcccagaccaacccgacccagcccagcccgggcagcggcagtgagagctgccaacccccacagctgcccctgtctctcacctgcaagccctgcctgcccctgccactagcgtggagcctgtcttctggggaggccggggcagtcctggtgcttgtcatctcttgcagcagctgcctgggctgggctgagttgggctgggctggcctgtcttcctgccatggctggatatttatattaaacttgaggaagggagaaaggggatttacaaggcacactcaattctttctaactctaaggtcctggccttgtctatgtccttgtggaggggcgatcttggccaaaatcactgtccttcgaaggtcagcatgtgcttggtgtcttcctgaataaagggaaggacatgctgatgcctcttccccaggctgaagatctttggatggttaagaaactcctgaccacactcttgaaagccgacatgctggctgccatcagcagcaccccttgggcctgacctccaagccacaattaatcctgcaagctatgacccagagtattgatgtcctcacattcccagattagcgcccccacccatatccctagcaccgactctgccccatgccacctgagccatgattccagccctcagcacacaggtgcacacgctgcctggacaatggccagagaactgccacaggtcacactgtgtctcacggcttctcacttccgtagagaaaccggaagacaggtctcaaaccagacctgaggcagcagcaatagccacagcaatgagtggtcatagctcaaatgcctactgcaccccagcctgccacctgccttatttaaccctcgcaattgtatagagttggcgtcactattcccactgcacagaaaaagaaacaaaatcccagaacagatagaagatgcccaaggtcacagacctaaccattagaagtgctgccatgtgagcataggtgtaattgtctacggagctctagaaaacagatgaactagcaggaagggtcactgcaggccgggacaacacccagggaaaggcctcactatggctgggaagagcgcggtgtgtgcgtctagcaggagtccaggtgtggggcaggagaggccgcttggggaaagggagcgaccacacactgggtcctgcctcatgtgcacctggccatgtgtcggcacttggtgtcgttatcctgcccgctccttacgagaaccctgtgaaacagaaactcctcctgattttacagctgaggccaaggaagctcacacatcacagattaaataatcgattcaaagttactgaaagaataggagagtccaaatctatttgcttaatccccagaccagggctttctgcacgtgcctcagagcctttggtgcagctccaaagggaggcatcgagaaacaccaccggctggaaatgtggctctgctcccgatctttgtctgcgttggcgagacaccggccgctctgggccggaatctctcatctacgaaaaagtgggtagatggagaccaccctcacgttcccttccagctatagaaacagtaacttccagtccttaactcgattctgtgtgggtgtgtggctgaaactgctcacagagcaagctggacaagcggacctggattgaaacccgcccctccctggagaaacaggggtggcctccctcccccatggcagggacctgctgggcaggactgaagcctggctcctgacaaagattctattcttctcgatgctttctcattgttctttgtgtttacaaagtgtcttccttcaagggaacagtgacttggacaagcagtgccgaactctgaaggcgcagggctgtgatggctgcagcctcttgcagtgtttctcggtgtctttccttgggttccaaagcccttaccaggcaggcttctggacagtgagtgggagttggctctgttgttatttgccacaggtgacatcagggtaaaggatggatttggggtgagccgtgagtaggctattatccactgcacttgaggtgtgaacctcctggtccccctcagcaggtcctggcttgttcatggaatggaggagtctgggaaggcgctgagaggcatccgctagggaacctgttccacctgggtgctcagaccctggcaggagcccttgctgaagtccagagagcccctggctgtcccctctcatgacactcaaaatctgccggagcctgcagcccagccctgcccagcaccctcttatggcactcaaaatctgcccgagcctgcagcccagccttgcctggcagagcccaatccacagatcttcctgccctcaacctgccagttaacaagttagccctgttttccagggcctgaagctgtttagcagaagtaaaaaggcctttaggctgaccaagtaaacatgtgcaaaacacatccctgtgccaggtggttctggggtcatggagattgttacgggctggattcggtcctcctaaaattcttctgttgaagtcctaacccctaatactcagaaggagatatgactttaaagaggtaattaaggtaaaacgaggtcattacatggccctaatccaatctgactgggtccttacacatggaggagatttaggacgaggatacacctgggggaaaatcctgtaaggacacagggagaacacacgtctaggggccaaggagagaggcttcaggacaaaccagccctgccaataccttctactctccagaactgtgggaaaatcaatttctattgtttgagtcatgcactctgtgatatttgttatcgcagcccaagcaaactaataaagagattgatacaaaatcacccctaagctctgagaatcactgtgtagcaggagatgccaacacataagacgtgatgtgttccgtcgggaaagtcacacacctctcctctgaccactccactccccactctggatgcgggtggggcctttggcttttggtgaggcccctctggtgtctctgcccacagagctccctccacacctgtattcaggccccagctcaggaagcttcccaggagagtcaagtacacacaaagcctgtgccagacagaagtaaattaagacaacctggatgctttaaatctcccctccctcctacagttactgtgatctatacgcctctaacgtctgacattctcaaagcaactcggtgcgtgtccatctgtctagagagctcttaaaaggcataagagcagaacgatcaccagcgattccgcaggcacgttctcacacggacgttagtaacagctgaattaaatgctttttgaatgagtgatgtattggatgcatttgttattattttactctatgaactataaagaaagattgatgacacctaaactcttgggcaggatccccttttccttgctctgtaatgcacttcccctggcaaactcctactcacttctcaaaacccaacccgagggtttgtctttctgaaggctacgctgtctccacaagctgagctgatcagcccatccttagaacaatcacttgttaaacccaatgacaagggtgtgatgggctatgtgtgtcccacccctaattcacacattgaagccctcacccctaatgtgatgggatttggaggcgggtcctttgggaggtgattaggtttagatgaggttgtgaaggtggtgtacgaagccattcttcactgttctaaagaaatacctgagattgggtaatttataaagaaacgaggttggcttggctcattgtcctgcaggctgagcaaacatagcgcttgcctgtgctcagtttctggggaggtctcaaggagcttttactcatggtggaaggtgaagtgagaacaggcacgtcacatggtgaaagcagaagcaagagagaaggaggaggtgccacacacttttcacaaccggatctcgcaagtacctgctcactatgcaaggtcagcaccaaatcatgagggatctgtccctatggcccccacacctcccaccaggccccacctccaacactgggcatcacaattcaacatgagacttagagggggcaacatacaaactgtatcaggtggagccgcatgacgggactagtgccctcaggaagaggaagagattccagaactttctctctgtgtcacttgaggacacggccggaaggcagccctgcctggaccttgaagctggacttccagcctccagaactgtgagacataaacgtctgccgttgaaggggctcagcttgtggtgtgggattgtggtagccctagtgaggcactggcctgttagatggaaacttctggagctaaggggctttcacctttgcacccagcacctggtcagagcttggacatcctctcctaaagatttccctaagcttgggttaaattaatgagctgcccagatgccacagaccatgtctgagagcctgaagcagctgaggaggttgtgttatttaagttggggcttgattgtttcagttcattttactctagaggcaggaaaaacaataacgggtaaggcctctcaccccgatgttttagggagtgaggcaaagcaaccacccctgacttgacaagaagaccattctcaaaggtgatcaaaatagactcagggaagcaggcctgtggttccttgacgctcctcccaggccttcctgtttgtcccagccaccagcatcctgcaggtaccgagagggtggatgtggactcactgctcgcaggccgccagcctgctagcccagtgtcccaagtcaaaagtcacagcgacatgccggaaagacagtttccacaggacgagtggaaaagggggcgtctcttctgcccatcgaagggtgcatccacctgtggtattaaaggatttacaactggcctcagaaacgctgccggagctgctccttggggtctgtccgatgggaagaggcccctcctgtggctccccaggtggtaaacagctccagcttcctaagggggtgtggagcagcccaaaggccacactgattaaaaaaaaaaaaaaaaaaaacagccccatttccgatccagagctcttgggtagaaagtgactccatgtgccagtctgggcaccagagtgagacctcacctctcctaaaagtaaaataaaaatgagctgggtgtgggggctcacccctgtagtctcagctacgaggctgaggcgggagaatcgcttgagccctggaggtagagactgcagtgagctgagatggcaccactgcgctccaccctcagggacagagagagaacctgtttccctcttaccaaaaaaagaaaaaaagtgactcaatatggagagagggcatgagggcatcagggagctggtgggcagcccttggcactctagtgggtccagtgcatgagctgctgcttcttgttctaaggcttctcattgggggtgccaggattcatgcacactttttgcgttttgttgggggctgggggaacacttgtgatgattctcacggaaacaggccagcttctgtgacccactaattatttgggcacccagctttttcctagactgccttccaaatttagtacacttatatttggcccttttttcctagttccttttgaaatgttccgggtttgacttcccttctagtttctctcctttaaactgcctcccggctaaagtgggacacaggccccttccaatgggtgaagctcttgcagaccacagttgggatctggcaccatctagtggcgagcaaggagctgccagcttagcttttgaatagccaggtaccaatccaagttgttaagcagtgagctcgaatacaaagctcaggcatacgtgggggctaagggatgtgcacacgggacatagcgtgcggactgcacacactgaagactcggaagggtgggagggtgtgggggaagcggatgatgagaaattcctgaatacgtgcaaagtacattttttaggtgatggatacactaaaagcccagacttcaccactatcgaagatatccctgtaacaaaatagcattgtgcccctgaaatttatacaaataaaaaattaatacaaagatcagaaaacaaaagcagcaacaactacagacaccgcacgcatgtgcgtcctgctcacgggaacgggtccgtggttttgtcctgtacaggttctcgggaggacagtgtcactgcccagcagccaggccccatcaggctggaggtcttcagttctatctctggccctgctttagaagacgagctgtgagcagggtgtcctggtttcactcaggggtgattggtgccatcctccaccttcccggtttctgctcctgcctactgcctgctgtgagaacagaactcaattttcccatcggcatggagagcaactccccagcgcatgagagccgctctcggtccgaggtgcctcagctgcgggcgtctccctgccagcagggcagaggatagggctagactgtccccatctctcaggtccatcctctgaggctgagtcagtgcccctgccgagagcccagaagcttcattactgtatctggcaggtggttcggagacaggtggtggctgcacgtagggaggagcccgttggggaggaaaaatggccccgactggtaaatgtgggtgtttggagtattgtttgttatcatcgatctcactctctgccagggcacacactttgtgtcagtgagtcattgtgtcaatataaaagattacccatggttgggtaatttataaagaaaagaggcttcgttggctcacagatctgcaggctctacaggaagtgtggcgccagcatccgcctggcttctggtgaggcctcaggaagcctccaatcatggcggaaggcaagcggagctggcgcttcacatggtgagagagggagtaagtgcgggaggggtcccttttaaacagccagatgtcgcctgaactcagagtgacaactcactcactatcacaaagacggcatcaagccacccatgagtgatctgccccgacgaccgaaacacctctccccaagcctcacctccaacattggggatcacatttcaacatgaggcttggaggggacacacatctgtaccatgtcacacttccccaatctcacagcccaggaatttgggtcagtccttcccatcgatctatgactgtcttttgcatgactgggggctttctgaggagaaagggatgtccccccaacaaatggcttagatggagccgacacatggtgggggaatcggtttttgctcctcgcaaaaacaggtatttctgctttctctttgggcacccaaggaaagatatttgctgcaaacacaaaccaaaaagacggtgtccaagagctgcagagaaggggcatcacagcaccccaagcctttgagtcctgtggtgtttggggatttcagaagccacagacatggagaaaatgtcccacatgactctctttccagtcattcctttgctttcacaggatgagaaataatgctcctgaatgcacatggcaaggtctgaagaaggtcttgggaagaaatgtgctgtggaatgttattaaaacgtggtttgagcccacgtctctatggatatgcatagtcccacatatgaacatgatgcttagatcattattcttgggcttactattaatagtaaagtgtgtccatttccaggttgatcgaagctggcagaggatagaagagctctgtggccgagtgagctgtttctggagccagatgagtctttggcagagcctgaggtcccctgctactactgggtgagtctctctgagccttggttttcttatttgcaaaatgtgagacggtaacagtccttttcctgtggcttgttggaaaaatcaagtgaaagagtgtatcatgtctggcacatcgtgtgctaaataaagtttgcaattattatctgaagacaatagaactcactcaaagaagtcccaggaaatcaatgtagatttttttttaactttaagacctggatacatgtgcagaatgtgcaggtttgttacataggtatacatgtgccatggcggtttgctgcacccatcaacccatcatctaggttttaagccctgcatgcattaggtatttgtcccagtgctctctctctcgttgtcctccaaccctcaagaggccccagtgtgtgatgaatcaaaaccacagtgagatatcatctcatgtcagtcagaatagcgattattaaagtcaggaaacaatagatgctggcgaggctgtggagaaataggaacacttttacactgttggtgggagtgtaaattggttcaaccattgtggaagtcaatgtggtgattcctcaaggatctagaaccagaaataccatttgaccagcaatgtcattattgggtatatgcccaatgtaaatttttaacagggaggttttttcgtcgaaaactatcaactttaggctaaaagcaagaattgttttatttttctttttttggctcagtttttcattagaaaagaaacctccccaaatgtaaggaagcaaatgaatgaaaggaaaattacaactgtggggagtcattacattggaaggcctctcttgggacagcgtgaaatagaattgctccattgctgcagccacgaaaccattagagaatgcccctcccgggaccggacaaactgatgcaggctaattttccatgggtgatgtctgcatagctgcggggatgggtcctattggcctctgaggcctgtgtttaagtgactgctgtctttccacttggaaaatcccatttgaatatgggaatcacggccatggaatccttcacatctcgtgatggtcaggcgcacttcctatttcattgccctgaagtcccagcggcaaaaggcattgacctgttgaaaacatgaaggtcagtctgatataaccagagcttttctgaaccccagccactggaaaaccttgctggtacgatacccatccattaccattactggtactacggctccaggaatgaacagaatttagcctttgcatgggcaacatggctcaaagagccctggattcagggtcagaaaacctggttttaaatcctgttttacagactgtgtgatctgcagaaagttcttctttctcacctccatgcatttttatataaaatggggtaataaaaatatctagggggttacaagtaaggaaaaaaggtatatgaagttttgttgtacaatgcttatgtatatatggatgcataatgtatatatacatacatatatacacattaagcattgtacaactgatataaaatatattatgtctgtctccagaggacaacgtaggtcactagcaagatgggagaacgtgattcggccagtccagctagcattcattttctcaaacagattttaaaaactgctattgccttctgaggctttaacttcttcattctaacagagtctattattgttaggatgaaataattcttcaattattgaacaatgacaaaccattgcctcccactaatctacctttgtggagtttcatccatgcaacgaacaattatttaccaaactcttttgttttttttttttttttttttttttgagacggagtctggctctgtcacccaggctggagtgcagtggctcgatctcagctcactgcaagctctgcctcctgagttcacgccgttctcctgcctcagcctcccaagtagctgggactacaggtgcccgccaccacacccggctaattttttgtagttttagtagcggtggggtttcactgtgttagccaggatggtctcgatctcctgacctcgtgatccgcccgcccaggcctcctaaactgctgggattacaggcgtgaccacaactcccggccttaccaaactctttcttatgtgttccatgccatgctagtttattataaatcagacacagcccctgctcttgaggggcttacttgtttaagtcactgagcacacaggcaaatctcttatgatgaattgccgtgagcgccaggagcaaaacagaacacagaatggagaagacgcactgaactcccgcctcagccctttctcctggtgggcttgtccccctccccactcagccactcatgctagtggttaaagcctgatcttattactgtaataaatgcaatcgttccaaatcccaatgtccaatatcccactgtcaagcttctttctctccagctcactcctgctaccaccctgctttcaacaatccttcaacatttggggacctgcagtgggttggcctcagctccttttcactcttcctcaccctttgacttcctcccttctgactcggcttaaatcccatagcagccactcaggttgctgcttcgaattcctctccagtgccctgtagcgcagcagtcaggtccccacgtaaatgcaccctccactcagcacctgcttaaccccacaaggctggggcacattgcacagccatggtgaccagttccccataaggtctcgatcattaaaccccggaggcccctgagccagcccagaaaccatgttagatgctcctggtccagtcactgccccctctcccaggacgtgctcctcaaactggtctagcacctcctccaccatcatcccactcagctgacaccctcgaattttgcttcattgaaaaaagaaaactgtaattactagtcagggttctccagaaaaacagatttattatgggaattggttcatatggaggcccacgatttgcgagctgaaaacacaggaaagctggtggtatcatttagtccaagtctgaaggtcagagaaacaggagctccagtgttcaaggaatggagcaggttgatgtcccagctcaagaagagagaggactcccccttcctttgatttttgttctatccctgccctcagtggattggatgctcgtccacattggtgagagtggatgttctttcctgagtctctaaatctgaatgcccatctccactgcaaacgcccacacagacacacccagaaagaaagttgtaccagctatctggactcccatagcccagtcaagttgacccagaaaatgaaccatcccatgggagcaatccaagaggaacttccacaccaccatccactcctttgttcctcttcctgcatgtgtctcactgtgttggagacagagtcttgctctgttgcccaggctggagtgcagtggcacgatctcagctcactgcaacctctgcctcccgggttcaagaaattctcgtgcctcagcctcccgagtagctaggattacaggcacctgctaccatgcctggctgatttttgtatttttagtagagacagggtttcaccatgttggccaggctggtctcaaactcctgacctcaagtgatccaaccgcctcggcttcccaaagtgctgggattacaggcgtgagccaccgttccccgcctaccttcctatgtttagagggacagggggatagaggttccccagattggtctcaaactcctgggctcatgtgatcctcccaccttggcttctccacgtgctgggattacacgtaagagccagtgcacctgttctatccaacttctttcctgcatctgtggatgacctttttgtgctggccacaccaagccctccctgtgtgtgctatcccctctcatctgcataggggcactgtggagcactttgctcttccgcaccaatgcagtacagaaaccctgcctgagcccagaggaaccaggagaatggacatccatagaattactaagcagctcctcatagttttaaaatttatctccttaattgaatttttgtgttaaaatgaagccaatgaataaacttggcaaatcttttgaagacttttagcaaatcagtatgataatttaagtgttattttcaatgttttatacaccgtatttaaatatatcatctttgaattatgtcaaatttgtttacatatttgaataaatgtgtctatatgatagtactaatcaggtgggctaggtatgttatggtggcaaacaaaaaactcccccaaaaaacacaaaatctcaggaattaggaaaaaaaaagggttagcgggtgtggtggtgcatgtctctagtttccaacttctctggaggctgaggtgggaggatcacctgagcctgggaggtcaaggctgcagtgagtcatgactgtgccactgcactccagcctgggcaacagagcaagactctgtctcagaaaatgaacaaaaaaggctttttgatctttgtttttgttggtttgctacagctaccaggccagaggggctggcaaggtatccctaaggattattacaacctttagggacccacatttaaggaagcccattgcaacatgtactcccaaggtggctgtcccaggaaaaggaaaggtagcaaagactctcaaaactgcccccagaggcaatgtgcagccttggctttcacatgccattggtcaaagcaagtcccatggccaggcctaacttcaaaggggacagaaagtacaataattccatgtaatatttgtgaaaggccctaatggcatcataatgagaatggatcccattactagcacttttataaaacgtgtatcaacattttatgttttagggtgcagatgctcaaatctttgttttacatcctgattctccaatttgccaaatactatcaccttactctaccgtctttgttaggaacattgctaacaccatctgcataattggcaccctttcctggtatgggagaagcacagttgacagccagtgttttggtggcaagaggtgatttgtgtgtgcatttgggttcggcaagtgcttcgtcctaggtggggaggattcctgagcacagtcaaaagatcagcaaagcgtggccggggaaatgcgggggactttggagaggagagtgagtgcagggtctgtagtgggtaaaggaacccttgaaaaggtgtctgggagatgaggcaccccagaagcagccttaggagatgcttgggtggggtgggggagtagataggagcaccaggctggacagagcccattccacgcctgcttctgccaactgccagtctgggatgctgggtgaatccctcagttttctttttttcttttttattttttttgagatggagtctcgcactgtctcccaggctggagtgcagtggtgtgatcttggctcactgcaagctccgcctcccaggttcacgccattctcctgcctcagcctcccgagtagctgggactacaggcgcccgccactacgccgggctaattttttgtatttttagtagagacgaggtttcactgtgttagccagatggtcttgatctcctgacctcgtgatccacccacctcagcctcccaaagtgctgggattacaggcatgagccaccgtccccggctgaatccctcagttttctaaagtgcagttttgttatctgtaaaatggaaataataagagcaatgcaaggattagattgagctgatgcgcgtgatacccttagcacagcacctggctcaatcaatgacagccacgattggatcagattctgcttgcttacagtcagccgtataattaaccctcctccctccacttgccaccctccaccaaaaacccagagctaatattaagaagctttgatagttctaatctgctcttcccttcctccaaggggataaataagctctccactggctttaagccaacagccacccacaccttgaccgcatgaagtttctccttgtctgcctccccaagcacgaaacaggcaccatttgatgtgttttcactgttccaattttccattttccaggccaagacgaattgacagaacttccaaaacactttgcaaagacagcgagtgcacaaagctgcagctcacagccttgtcccgtggccgggagacaggatgcatgctgagctgctgggaggagggacaggaggaaaagtgcctgcagctgcaggagcacccacttgagatgcctcctgtgttcaatcaagttcagagtaattgcttcctcactcctcctggcaaaactgttcaacttggcacagtgacagctccttgtagagtttttccagctgatgtcattcttcctaaggtctgctagggtcccagctaacacgactgtgttgcactggcatccagacctccaccaggagcaattcaaaggcctatttttgtgaatatgtggcaaagatcccaggctccatggaggccttttgcactggggacatggtggaaaattaagccccagaggtaactacctacctgaacggcatgagaccagctgattagatgacagaatgggcagatccgtggaagggattgagtgagcactaacatcgagcattcttataaactaagtgagactgcaagagtcaggggccactgtgcacaattgtgtgagctgtgttttgcagcaggtgtctggggagctcaaatccacccacaaagggaagcctttctgacttgtacaaagggccataagtggtggctcgaacctgaggctctaccatgcagtgagtgtggagatgtggagatgggtacacaggaatggacaatctagagaggggaagagactaacatccagcagcacgttaactgtgaaagcaaactaaatatggcctgagaaggactccatacttctatatttgagtcctcgcggatggactgtaacctagcttaataggcggacaaaattgcaaacataacctggtagtatgcacctccaacaatagctaagtcttggccaaccccagtggccatactcaaccaaccatacactgctgagtgttcaaattaggcatacgccaagcagtaaccaatccagctgttttatacttcacttctaatttctgtacatcattcccccccccccacctttttttgtctataaatcttctccacctggctgtgctggagtctctgtgaacctgctgtgattctgggggctgcccaattctcaaatcgatcattgctcaattaaactttaaatttaattcagctgaagtttctcttgcatcaactgctatagtatttcagtttagtttctttctcttttcttgaaactaatatgtacttagagtctagtatggcaaatgccacggtgggcattttacttatataatctgaaaactgcttatgagctccctgcaagacagatgctagcatccggcccactgtatggagggggagacggagccacggatccctgaccagaggtaggtgctcaagcagcaggcctgctcgacttgaaatcacgggttttccttcacattgactgctctgtccttcttgaaggactgctcaatgatgcattttattttccacctgcattcatagatattatgtaaattttcaaaatagtatctttctgtgaaatggcaaaagcatgatgaaaaagtaccttgaaagtggctaagtcttacaaatatggcattttaaataacatcattagacactattgcacaaagtgctatagttatctctcattacgatgcagtgaacaggtcctaaagttgctttttcccttttctgcacaaggaccaacttggagatatttgggaaagaaaagaaagaaaaagatttctctgactagcttctcccgacacaggctagccacgtgttatgccattagtacctgtgctacatccagacagaagtcactcttgtgaaaagaggattcggttttttaaaaaatgtgctactgattcggtgagcagaagaatcttgacgctaattgtcaagtagattctactgtatccagtgtctggcacaaaacccaacaggggtgctttaactcaagaattcctttagaaggaggctaaagaatttgatgaggggccaggtgcagtggctcacacctgtaatctcagcactttgggaggacgaggcggagggtggtggcggcgggtgggggacggggatcacctgatatcgggagttcgagaccagcttggtcaacatggtgaaacgctttctctactaaaaatacaaaaattaggcaggtgtggtgccatgaacctgtaatcccagctactcaggaggctgaggcaggagaactgcatgaacctgggaggtggagattgcagtgagccaagatcacaccactgcactccagcctgggtagcagagtgagactccatctcaaaaaaaaaaaaaaaagaatttgaagaggattagtgaatctgtcctctaaaaagaaaagtagatattgtttaaaggaaattatgaaaatatttacatgtggcaaactaataattggatagtaaatcatttaaaaatctcttgcctctactgtttctcctactattcaaggagcaaggagtctttctgtagtctctgatttcgcagttattgcagaaatggccaggtgcggtggctcacacgtgtaattccacctgcttgggaggctgaggtgggagaatcacttgacccaagagttcaagaccagcttaagcaagatagttagatcccaagtttcataaaaaaagaaaataaaaattattgccaaaatgctacaagatattgcttgagcttggctttgaatatcaacagcaaagcctagaaaatgaaccacagagaactggcaccacgccttggattgcagagaagaagcgatgatatcgatggcctcactgatacagtgatgggctggagtgcgctggctgagggaggggtcattgggtgatgatatcaacgccgtcatcggtacagtgatgggctggagtgcgctggctgagggaggggtcagcgggtgatgatatcaacgccgtcatcggtacagtgatgggctggagtgcgctggctgagggagggggtcagtgggcggagggcagcatcttgagggctggggagaagattagccagagtaggagagtcagagagacaggagaggatgggggagcttggacagtggaggccagctgtgccaagagtgtggtgagcctgggcaggggcatttgatggcatcgtaagaggaactatctggtcagtggtcctgcgatgaaaaagctgtctaggggctgagagagctctgaacatgacaaaggagatcagtgtcccgatcctgagccctgcctaactcctgcaattttgggcaggtcgtgtcccctccagctccgtcaaccttaaaagcggtgggggggggggttggattggatgcctctggggtttcttctagatcatacctattctgtgtcaactggaggtcactggctgtttggggagagccctgaggatgaaggccaaggcaaggggtggagctggaattggtgaagatgcaggaaagggagagaaaggtggctttggcttgaggagggtcccaagagccatttcttcctggtggaccctcagagatgtttggagtcttgggggaagcatctagaaagtgaggtggggtaaaccacggaggaagggagggaggacgcagggagagtcaaaggtgctcgggcagggagatgggtgtttgtgggagcaggagacagtagatggggaagtgaatgagaaatgtggggcgttaacggagctccactcggatgggttccatcttcccagctaagcaggagtttcagggaaagcacagaggacactgtgtggggcaaatgccatgggggaacatgaggaattaagggccaatgcatcaagcatttccagaaaagcataaagagccccactcagaatgaagagggtgcatttacactgaaattcatgtcctgccttgctgatttttctcctggatcctagaaaatggttattattgaagcatgaggttaaacttgccatcatgtctctgatttatgagtcacaatgtggcctgttgtgatctggatggggtagggagaggctctgttcccatcagcaatgggttgtgtctccttgctgtggggtgggcccgtccagcacacggcctattttacctgttttggggacctgcaattcgcttcaaataccaagaatccatcctcgttttactggatagaattgtccaggttcctggtgcgttgaacaaagaatcgaacaaaatgcacagagcaataaaagaacagattaatgaaagcatagatttattgaagacatttcagggtgggagcgcactcgagcaagtgcctcaagagcctccttaattaggggtttctgttgagctaaagaaactcagcaacaccagtccgtgccctttagaggcctccaattggctacaccccatgaaggattggcctgcgaccaatcagaggctgaagtggcttgttattatgtgagtgaggatgtagcctataaactgcacctgctgctctcctgcttctatgaactggctgcacctgctgagccccgttcccttaattccctattcttctgtcacacactccaggagtgctccttactttgggctcattatgactaaagaggaggagctgaggccttgttaccacttcattgcagagacaaaggcataaacagtatttactaggcatgtattgagtacatgtgatcttccaagcactgctctaagtcctggggtgcaacagttagaatgtgtcgcctccaaaattcagatgttgccaatgggatggtgttgagaggcgaggcattcagaggtgattaggccgtgagggatgctccctcgtgagtgggattaaggcccttttagaagaggcttggtccagcatgaggacaggccctcctgtcctcaccacctgaggacacagtcttcctcccctctggagggtgcagcctcatttgagaccgaacctgttagggccttgatcgcggacttcccagccttagcaatatatttctgttctttataaattacccagtctgtggtatcctgttagcacaacataaaacaaactcagacttgggaatacagtggggggcagggtgggtgaggaccctggtctccaggagctcacattttagcagatttaacacccgctgctatacgtgctcaaatgctagttccttttggagcaggaacacagctgaaaagatgggttgattttcagcgtggagggctccgtcatctacctggactctggccagcttttctgctcctcactccgagatgaagctgttttccattttgattaggctcagagattccaggcccgatgcctttgatctgtgtgctcctacattctgcttgatcttctgaggtgggagggcagagtctgaaggctccatccccatttggaatatcccggtcatctgaggccatggctgctggtcctgagtcattatttttccctgagggaaggagacagttgttcagctgctcaacccctttgctctggctttgccgtacccttttcagatgtttcaggaaaataaaaagatgcaccctgggaggcgttccgcagagtaaccgccaaagacggtaactgttaatagcaggagacaggggccgagcgcggtggctcatgcctgtaatcccagcactttgggaggccaaggcaggcagatcacctgaggtcagaagttcgagaccagcctggccaacagcatggtgaaaccccatctctacttaaaaaaaaaaaaaaaaaaattagccggatgcggtggcacatgcctatagtcccagctactcaggaggctgaggctggggaatcacttgaatctgggaggcggaggttgcagtgagctgagatcacgccactgcactccagcctgggtgacagggcaaaactccgtctgaaaaaaaaaaggagacagtgtgtttttgtccaccccggctgctgtcacaaagtgccacagactgggcggcccataaaccacagaaatttctccattctggaggctggaagtccaagatccaggcactggcagattccgtgtctgtgatgacctgtctccttaatgacagatgggatcttctccctgtgtcctcttctcactgttagccccctttataagggcactaatgccactgaggagggctccaccctcatgactacaccacctccccaggccccacttcctgagagtaaacactgggagttaggatttcagcagataaatctgggagcacaaatattcagtccttcacatcgggaaaggtggggcagggccacctggtttggaggtcaccttcccagcttataacaggggctttggggactggctggcagtcagcccacccaggggtgcctgtttggaatctcaggtgatgagtatatttccttcatcttgcaggaccacagccatccagccagctgggatttggaggctgggggaggcttgagctaagtcagggtcctctggactcatgttttcctctgacagcactgaggggcccccgctcctgggcggcccacgccttcctgcctctagcatcaaggcagctgccctctggagctcaccccagggaccggggttcccaaggctggaagatacttttcgtagtgtggtggctggaaatgtcccaacttggggctggaggaggcccgccagtcctgtctgtcctttccagcagccccgcagaggctgaaccccctggcaatgtggcactgccacatgccccagcacccgggatgtcaggcgccaccaaggcaggctgctgtggtgcggcactggtgagtcagagcatttgctatggtgctgtctgggcatattttaggagcctgctttgtattcagtgggtattttccttggcctgtcaccaaaacacttgccttgaggtggaggaaaaccaacgtaacaattctcaggaacaagagggcagccgttggggagaatctagaggcaaaatcccagggcaaagaccacaggctgagtgagagccccctgtccattcccctggccttgcatctgtgtcctgcccagagccagacactcacccgcatccctcaagtcctctgcagagcctcctccaccaggaagccttccttgtcctccatctcctaatcaacactgtccccacaggatgggatgtgtgcttcacgccagtgagtaggatgtgttatttgattggattttgtgtttgttaagatggtgcagcccacttttaaagcaatttgctccagaagtgctgggatgaatatttcctaagctcagggcatcattttgctcttttagggttttaaaacaattcttttttatttttttgagactgagtcttgctgtgtcaccaaggctggagtgcagtggtgtgatcttggctcaccgtatcctctgcctcccaggttcaagtgatcctcctgcctcagcctcctgggtagctgggattacaggcaggcaccaccatgcccagctaatttctgtatttttagtagagacagggtttcaccatgttggccaggctggtctcaaactcctgacctcaggtggtccacctacctcagcctcccaatgtgctgggattacaagcgtgagatactgcgcctggcctaatacttttttttaaaagcatttttagggtcatagcaaaatggagaggaaggtacagagagttcccacagactccctgcaccccctggaacctcccccaccagagtggtgcatttgttacaactgatgaacatccgttgacctgtcatcatgacccaagtccagtttaccttagggctcagtcttgacgttgtgcactctgtgggtttggacaaatgtataacgacatggacccaacattacagtatcatgcagagtagtttcacagccctaaaagtcctgtgttcatccgtccctccccactaagccctgacaaccactggtcttttttctgtctccatagctttgccttttccagagtgtcatagagttggaaccatacaggagacagccttttcggactggcttatttcacttagtaacctgcagtgagtttcctccatgtcttctcatggcttgacagttcatttcttttcgtactgaataatatcccattgtctgggtcgggcgcggtggctcacacctgtaatcctagcactttgggacactgaggcaggaggatcacttgaggtcaggagttcgagaccagcctggccaacatggtgaacccccatctctaataaaaatataaaaattggccgggcgtggtggcagacacctgtaatcccagctacttgggaggctgaggcagaagaattgcttaaacctgggaggtgcaggttgcagggagccgagaccatgacattgcattccagcctgggcaacaagagtgaaactccatctcaaaaacaaacaaaaacacaaatcccattgtctggatgtaccacagtgtatttatccattcactgactgaagggcacctgagttgtttccaagttttggcaactatgagtaaagctgcctcagacatctgtgtgcaggtttctgtgtggacctaaattttcaactcctttgggtaaatatcaagtagcaccagcttgatcatatggtgagagtaagtttagtttagtgtctgtgtgtgtttaacagataccacgcgggtgtgcagtggctcttcacaggtacaatcatggcacactacagcctcaaactcctgggctcaagtgatcctcctgcctgagcctcctgtgtggcttagactacaggcatgcaccactccaccctagttttgcaagaaactgccaaactctctccctaagcatctgcaccattttatgtgcctagcagcaatgagtgagagtcctgttgctccacagcctccccagcatctggtgtggacagcgttcagggttctggccactctactcggtgtgcagtggtatctcatggcttagtttgcatttccctgatcacctaggacattgacatctttccatcagcttgtttgccacccagggcacttgttccccagacaatgacagtgtcctatgaggcagtcactggtatctgagcaccagccttgttctcaggatccctgaagttagagcatgggcttcttgaggacagaagcttttctttcctgtctgctcccaccgcctgggttgatggccttccctgaagactctggacacagcctggtgagtatgagccaagtccactgtgtgatcatggaggctgcggttaactctctgagcctcaagcttctcatctgtgaaatggggagaacaagagcacctgcttcatggagcagttttgagtggtaaatgctcattagcagcatagagcctggcacatgagaaataacttagaaaaggttagttaacggtgacaatgattattcaatttgcttttggagggatgaccaaattctattagtccagagaagagctgactttgggcaggacagcccataccagtctttggtaccaagaaacgtgaagcctggcaactagggtgccttcttgccttgttgtactacgattttttttccaaagtagatggctaggagcttttggatgatgggtagaaaaggttaaaaccaaccaactggcccatggtggcagccaagcagccttaaaccccaaagccagaattcagctggaaaaatacacagttccaatgtaagaattaaatttagagatgaagacaaattacctaattttgggactttacccaggaatccagctcaaatagcggcaatggggtcagctggttaatagaaggctggttcctgtgtggctctctcactttctccatgctagccaaggccagcctggcctggcgtctttcctcacaccattaacacagacaactaatgagatgttggaacaagcccagagaaaaaacttgtttagagcacttcctctccacttcaccggtacaaacatctattctgggtttgggctattttccaagttgggttatatgatgataaacaacaggttattttggcgagtaaaattttagctgggtacttcgcaaaacaatttttaaataaatttgaagaaactattaagtggaaaagttaaaggcataaagaattgtcggtggttctaaaagtgtttttccctaagcttcttgtttatttcttgatgttgtggaaagaccttcttggccacgtttttcatgagttatctgtgtttcccatagatttggggtctagactctcaattatttatcttatttgaaggataaaagtggaaagttcaagaaatcgatagttagctggcttgaatttgctgagaattcagaacaatgttcacaactaaaatttgcaaagtaaatcaacagaatacaaagaagtaatttaacccagaatgacaaaatgaaaggatggttcccatgtaacctcataaatttcctgcttgatgcatctcaagtctctgatttctaataaaattctcatgagaacatagtattgctccataaaaactcctgaactctccccatgagaacgggctggtttatgagggtgcatgagttcaagtctgtggtttacttattaaaaatttctcagtaaatatatcatggtccactggagagcacccctcaattgtggggaggccatgtatcatttctgccgtccctaagtatgaagaaaaacaagaagaagcacgccaggaactctctgaaccagaaaaaaacgggaaccttttatttttctaaagaaaattctaagactttctgtttacctttgacccaaagagacctcatgggagtttcacatttgctttgcgaaaatctgagcattcttgccaaaaggggtgacaggcagtcctgtgaggggctgcgaaaatctgagcattcttgccaaaaggggtgacaggcagtcctgtgaggggctgcgaaaatctgagcattcttgccaaaaggggtgacaggcagtcctgtgaggggcgaaggaagcttgttttggttcctgccgctgttgtgggtcaagcccctcccggggagcacacggcagagcaaggctgctcagtgggtgctggaagcgcttttgaggaaagatgtaacttacacgtagtcacaaaggcagtaaactcgtggctcgctcacctttccccacatgcctgccaaccggaaaaataatgttcactcacgttgtgcttttaatctgggccagttactgctagaagctttgtgggtgtcccctcactcgatcctgcacacaagcttatggcacaggccattgttatcaccttcatcttagagagagggaaacttcacccaggaaagttaagtaagttgctgaagtcacacacctggtcagggacagagcaggttgattgcaccttcatgctgctatacatcacaagactagatcggagagagatgccccgccaaggagggtggccgggaaacctgggagcccttctcatttcaacctactcagccagggtcctcttcagacaaacccacaggattggagcaaacacgtgcagagcacccgtcacgggctacacctgtgctggtgtgttcacgggtgggcctcgcggatactcgcagcagcccgtgggaaggggatactgggctattgtgcaactttcttccactgggctcaagagctggacctcgtatttctagcactaggtacaggccttgatgcatgtagtttcactggataagaacaggctttggtctgtggctgagacagcataattaacaattttaaaaatagattttaattttttaaagaagctataggtttagacaaaatagagaggaaggtacagagatctcccatctctcccgagcctcccctgttatcgccagagtggtgcatttgtcttttgtgttttgttgtttttttgagatggactcttgctctgaggcccaggctggagtgcagtgggtgatctcagctcactgcaacctccacctctcgggttcaagcgattctcctgcctcagtctccagagtagctgggattacaggcgcctgctatcacgaccggctaattttttttaattttttaattttttattttttatttttagtagcgacggggttttgccatgttagccaagctggtctcggactcctgtcctcaggtgatctgcccaactcggcctcccaaagtgttgggattacaggcgtgagccaccgggcccggcccagagtggtgcatttgttacagtccgtgaacctgcacagacccatcaccatcacccggagtctatcgtttccattacagctcactctggggttgcacgttctatgggtctgacacatgtaccatgccatccatccctggctacattgccagacaggggactttcactgtcctaagaatcctctgtgctccaactattcaccctccctcatcccgaacccctggcagccactgctctttttcctgtctccatagctctgccttttctagaatgtcataagttggaatatgcagccttttcagattggcttctttcacttagtaacatgcgtttaaatttcctccttgtcttttcatggcttgaaggctcatttctttttagcactgagtaacgtcccagtgtctgagaggggcacctcacagaaatgaaaagcactttctagatctatagaatttagagctgaacatgggcagccctggtgacccgttccagaactcactgtccctgaagagacacagaaggtgaccttattttccttaatgaccacagcacctggaggctgacgtgtccgtccccacagtaaccacccgcccgtggatgaacaagcagagagccctggacgcttcgtcaatgctcacttcacctttaagggcacctgctgttgcaaatgaaaagctgtcgtattccttcttactgaaagttggtaactgcatctgaacacctaattatcttcataaaccccgacacacagcgctctgaccagggcaggccggcaacttgctgggaaaatgcaaaatgtcctgcactgctgagcttttcacaagccccttggtggggtccttaccggcgtttgtgcgtttgaaagcaactgattgaaaatcaggcctccaagcttgtgcttgaaaggacgagagcaccagcctgggtccgcgagggagggcgccagtgccacctggtggccgcgccggggagcccaggttccagcctgggggcggctctaagttcagggtcagtcccatcattccacagggctgagaattagtgagcttgcagccccagccgctcctgcagccaagcctgaacgtgaaatacgctgaactccgtcacacgcctatttcgctagctcaccgcagaacggctttattatgagagtcaacaggatgtcggtgtgatgatgatgtccacaaagaacggctttttgcaatgtagaattacggctcaatgttaccatgaattaagtgagagaaggtggccgtggaacatttatttcaagacgaagtcaaaactaagccagactaagcttttcgctgacagtcactgaaaataaatgactacaaatcctgaacgtttttgataaccttacgaaattcaccttaggcttttgtccacctaactccattattcagatttgtcacatgactccctactgctggagcaaaaaatatatgtgtattgacctcaaaactcttaagacatttgagaatggaacgttgggtctgatgatctaactggaactttatcattcattctgcaagggctgttacttaaaacaaacaaacaggccactcacggtggctcacgcctgtaatcccagcactttggaaggctgaggcaggcagatccacttgaggtcaggagttcaaggccagcctggccaacgtggtgaaaccctgtatctactaaaaatacaaaaattaactgggcgtggtggcacatgcctgtagtcccagctactcgggaggctgaggcatgagaatcacgaacccgggaggcagaggttgcagtgagccgagattatgtcactgcactccaccctgggtgacagagcaagactccatctacaaaacaaacaaaaagaacaaatgacaacaacaacaacaaaactaacaactaagattgatccctttttcttcactgttcctagaagttctaggggtaagaggggaagacagggatctcacattccatggatgacgttgttgcccttgggaagcctccaaggtcaccagatgaaggcaagatctccttagatgattttatggctttggcataattactgtaaaactatcaacaaaagcaagcttgaccctcctcagggtgcagtgtgcatttgcctttgggatgaaccaggtgaggcagtatcggggagggaggacggggtacaggtgccgcccttcttccctggtcccagtcaacaacagacccctgactgcagacgatgactccatcctctcgggagggacctgggggactcagcttgagaaaccagaaaagccaaaaggaggctcctaccacatgggtgagacagctcacatccactgcctttgtagatatgcatgggaattccatgacctagccagacgaatgatcatatccctgttttacagaaaaggaaactgagtctcagaaagattaggtcatttatctttggtcacaggattagctggaaaaagaacctggaagagaacccaggtctcacatcccacgtcgctttccacagttctttgctttgccctcaaaggcacagtgagccaaaaaagtacatgtcttcagtacttggccaaacttcaggtataagaaaaaaaagaaacaacaacaacaaagacgaagaaagaacaaatctcccttcttttctctaaatgctctatcttttaaagtaacttaaagacaaagcatccctttgaatctaagactttagggtctgaaagatatccttaattggtcttggttgtttgtctttttgtttgtttgtgttcccttatttcagtttaaagggcacactaagaacaaaattccatatggtttattctgttcccaatctcatcttccccctctttcccttccccaaccccagccttgccaatttgtagacaaatcagaaaaatccccaacgggctgaaaacctgtccatggttcactccagctggaaagaattgcgttccaccaagattcagatcccatttataatggaaaccctgacaggcaaagttgtaattacggttgtgccataatgaatgtatctgtgtggtcaaagtagtggatttttccatggtatttttccatggaagatttcctccctgagagatgttaacttaaaatctggatggtagctttgactttagagtaggatcactcctggcattgctatagcttgaagttaactattatatagactttggtagtcatgattagcaagcgggatgttagtcaaattgatattttgcaggactgatggcagttggggggttggggtttggtggtgtaggagctaacttaggtaagcttgtattgcctttcagatttttttaaccaggaaatactgtctttcttttctgacatgatgtctaatacgaaagtagaaaggctgaatatggctaactggtattagggtgaccaaccatcccaactggcctgggaccatccagttttggcactaaaatctcataagccaggaaatccctccatcctggggaaggcaggacagttggccatcccacatcctatggaaaatagaatcaaagttaggaggacagccgagtattatgttggtgtgaaagtaattgtggtttttgctgttataacagtccgtgttaaagagagcaagcggacttgagttttcaagtaaaattctttcttggtgcttcgaaaatcctacttagtgtcagcggcattagcttgagagctgactcaggaaagggctcagaaggaatgtgaaaatccctgcttggtatggcagaatgtcatatggaaaaccagacaagtcattgttctgcccaacaatttcatgggttaacccatcctctggccatttggaggcatgaagagaatgagacatttcacgggtatcaggccctccccagaggctactgctgagggtttttcttctgcaagccctacctaataggcccttggctgttcttccaaaacctcttctctatgctgaaaaggaaagggcgcaggaaagaaggaatgtgggggctgatttgtggagctccagcttcctgtccaggccccacatcctgcctcactcaaggggccttgccttctggatcttctccttttatgaagctctcagattgctctggttgcctttccaagtactgtgaaaatggccgacttttaggaattgggggactgggtgaggttaaaagaaaggaaggaatacagaatcaaaacgaaggcaagaatagggcaatggccaaaaacaccagctgatgaacttgacaactctgtagagtggcaggagaacatctctatcaatttaaaaatgtaagtcaaatagatttctacaaacagacccttcaggacatacatattgaatctatttgtggatttataaatcctgaccttcagggtatgtatagaatccacttctggatctgggccttcggtgactgtgttgtgagccatttctgcggctgtaatttctattgctatgagttccaggggcataagatggaggaaaagggcagacatggagctactgaccttgtgtgacagaacattctcccatctcacccaccgccatggaaggagtgtgcttcctgccccatgggagctgggcttgtcgaggccatgcatgaggcaggatggcagagtttccactcgcccctcggggaacttccaacctctgcctccagtctggccactgccccgaagcctgggatgtgcgcagaggtgactggagccacagccccattagatgacatgcagaccccagtggaaaatgcgtgctcgctgttttacgcccatgagcttttatgctgttcaatctgctgtttatgctgttaatagatccatctttaaaaagtgaacataattcaattaggaggtgtagctggttcttcttcagtcgcgctgctcctataggataactgcaaaagggtctcaaaattatattttttttctaggctttcttctgttgtcatagggagacagaagatgtaaaatttccgttccttcttttctgcttcttaatagaagtgtctaaaggagttatgttgcgtgcgcctgcaaagggcacagaaagacaatcaccagcagtccagaatccaagtcctagatacataaaatagttttattttcatatgcatgaagagagaggaaactgtgagaagtggacacacaaattttaaaaggccacagtttgggggccatttggtgcaggggccaagtgcttggcggcgagtaagacaagtccccgaggcatctcagcacggtagcagtgccagttgtcttcagttctcccctccagactgactctttgccctgccccgggccatgggagctggtttttatagactgcctggagactccacgtctttggttaggtctggccgatgctggtggccctagcagaagggcagggcaggtatcttctcctgccaggtccctgggggttggctgcagtccttaccaacagcaccgcccagacccgggggaccaagggcggcgagcactctctctgggggtcgacagcagccccacgcccgccctcagggatgcaggcggagcgctctgccattcctcctgggtttcctaactctaccccacactttgtaaacagctcctctgagcaggaaagagagaagcggccatgttctgagatgtcagagttctccgctacagaggacaggggagggagtgaaaatgtttccacaaagaccggcctacaaaatgggtgttcagaagctttgcttctggaggtaaaatcctgagtcattcagaaaagcctggaaatcgaattccacggtaagagtgcttgccatgagccatttatcaagcagggtctcaaggggacagagagttgaacaaaatttcctgccctaaggagcttataatcggtatggaaacattcattgaaatcgagcctaattttccacaggtcctggatagcagaggttccctgcttttggtggagacagcggtgcagtgcagtctgtggtgtagggcataagaggggtacctgcacgggacaagaggggggtgacgtggacttaaaaaatgaagagaggcgacctggtagctgccgcagcagacggaggatcagtgctctgaggggaaatgccattgtgaagctgtgggtgacggccacctcctgaggaagaggcatcagaggaggagacagagacaggagaagactgcagcccaggagaacggcccacaagttccctggtgtttgcttgaggatggatctccgcggcaccaagtcagggcagccacggcgcacgagtggagggaggagtccctgaggcgaggagcgatctttcagggcgcacagttttatggcgggggaggctggaaaggacctagtgggggtgggggatgcggggtgagtggatgggacaagagtgagtgcggggggatggagggtgagagggtgaggatggggggtaagtgggtgggaatgggggtgagtgggtgtgaagggtggggatggagggtggttggttgggaaagaagggcgagtctggtggaaatggagggtgaatctggtggaaatacggggagaatctgcgtcctgctcactgtggacttggagagttctcccacgagtatggctttgcctcccatactccctgtgtcagggaaaggaggaggtcgtacctctgtcgggacagacgtggtgactcaagcgggagcttctcacgcactggacgtggcacagcctgggcagcgccggcccctgtccttcctgcggacctgtgaggagcatccggctatctgcactggctcagcctcgcccccgggcaggtgggtcacggttgtgtgaccttgggcttctgtgatagacatggctgtttccgctgtctccggacatcagtgtacgctgtggacaaatgcagccggtctacgtgaggtccgctctgcactaaggacgggatgggctgaaatgcaaactcgggtccagacatagctggaagatgagtgacccgccgctgggactcaggaaaagctactgttttggttgtgatccaatagataatatttaggctaccaaacatctataaaactaccactaatatgatgaagaaaagagcagtcccggaactctgggacctggtccgatgcttaaggccggccctggtgttctcctgttggccacaaagcttctcacaggacacctctgtgagaagcctctgacgtggccactggagaccgtgacacagcaagaccaaaggtcaccatgcaaccacaaaacaccaggctccccctttcccactaagtgagtgatgactgcttctttacccatggcagctttatgcttgctcgactccctccctacagatgcaactgactgcaataccgggtcacagcattgcccccaaacctgagtagacccggcttccctagactcacccagattcacccagcaaagcccaaatcctgtaactcctttccaatctcctttcactgagcggccccgcagtcccccacggtgtgcgtgcttctttgccgagaagagtcataaacccaactggttcagttacagggggttcctggtggtctttgtctgaagggcattagcacagctgtctccagatgtcatggtcgtgctctatgggcccagccataaagatccagatgggggctagtgaggtccaaagcaccatccagtcccttctccccaagacagcagtcagtattcagtcctgggagctggtgacaaggagaaggcccttcttccatccccactgaggtcctctgtgtccttccacaggcagaggcatgagttctcctggggtgaagcgtcatggatactcaaggctggttattgtggataattgcaaaacctgacccatagaggctccacgagagcagggagccgacatgctcgtcttcaggtctcccgatgcactggttttcattctctggttcttcctttcttctcaatagtgaaagtgggctgggcacagtggctcatgactgcaatcccagcacattgggaggctgaggtgggtggatcacctgaggtcaggagttcgagaccagcctggccaaaatgatgaaacgccatctctaccaaaaaacaaacaaacaaacaaaaacaaaaaacaaaaaaaaaatggaaaatgtcctggaacagacttgaagtctccagctgctgtggctccttgctgcccatgcgcagccactgaagctccaggtcaggacctggaaagtcactttcagctgcatcttctagtcctcgaggttccttcttagtcatttcacgaaggggctcttctggctttatgcacttgtctgcagggacagccttgtccacctttgggtaactctgtcttaaagaacctgtctggagccctaaggagtttcttcatggctcataagaaactgcaggaagaaaatagaatctctcgctacagaacagtgtcaggtccctgaagatgacaatcatgtccttgttaagctgaccttctgtgggttcctgcagccgtctcagaggggactccataaagctctcacctgcttctcccactgacgccgtgagcacctgtcacatttcttctgtgtagctctgtgatcctaatgactagcatttgataggtgctcagcaggcatttttgaattaagtgtccatttattagtcttctctaataaatatagtgtatattttctgatccttttcatcaccgggcaatatgctttctggaggcatgaagtgaggaagccatctgagaagccgatgttggtccacagggcctcgaacagcaagtacatgccttgatttctgcatactcagtgcctgtcatactcaactaatattccttaaatgaatgaatgaatgaagagtatttctagctttccaggctattcaagggctagaaagtttgaaaagaatgagcaaattccccatatcccacccttacttttaccccataacacaaatgccgttgatccaggatatgcactcaagctgaaattcatgcccacagccccgctcgttagtgaattcatgctgttgaatgctctaacgcctacttttgctggacactctgctggaccttggagttagcccagaaggaggactgcaacccttaattagccttcagggaggcagggcttcaagtttaggaagaggtcaccagagggcaaagggcagtggaatacaacctggggacagagggtaggtctgggagagctggagctggggagggcccaggaaggcaccaagaggagatgtttgagtggagtcttggaggacaaatggggagggctggtgaggactcagggaagtgctcatgctctcacctggctgggcgagagactgcatggaggaaggactgagatgctgggatagcacagtgaatggaactatgaatgattttgttctattaacaagctttttttttagatagagtcttgctctgtcgcccaggctggagtgccatggtacgatctcagctcactgcaacctctgcctcccagttcaactgattctcgtgcctcagcctctcgagcagctgggactacaggtgtgtgccaccacaccaggataatttatgtatttttagtagtgatggggtctcactacattgcccaggctggtctcgaacttctggcctcaagtgatcttcccgcctcagcctctcaaagtgctgggattaccggtgtgagcccctgcatccgacccaaagtctcgttatcttcacctgttgtatggaaagtttgtagccacttgtctgcatccccgattggcttatgtggctggccaggaggatgctgatggtctgagagcttattgcagaaagtgtctgcaggtgcccttagtatgtgtcaggctgagctaagttattctactattcctttttagagctctaatattgtaccctaatccaaaagtgtttggagagaataaaaactacccattctggctgggcacggtggctcacgcctgtaatcccagcactttgggaggccgagatgggcagatcgcttgagctcaggagttggagaccagcctgagccacctggcaagaacctgtctctacaaaaaatacaaaaaagtagccaggcatggtgcccacctgccagtagtcccagctactcgagaggctgaggtgagaggattgcttaagccctggaggttgaggctgcagtgagccatgatcatgccactgcactccagcctgggtgacagagaggccctgtctcaacaaataaacaaatgaaatgaaacaaaacaaaacaaaaatacccatccctaaatagcatccagctctctgtgtgcctttctctttgatagtttatgactagacttccttaatcagctacaaaggaaggcttaaagaaattatggaaatacctagccacaaagaacactttagagtggaggagtcagagagaaggagagtgcgagaggaatggacgtttcctcccttctttttggatgggcttaaatcatggatagtgtctcacattgaatggaagtgggaacaaagcttggacataaaggagatggggtggaaagcagcagtgggagctggaagggaactcttggctggccagcctgcacaaaggggagcagcacatttcacagaaaaatacatttatgcagctggccaggaggatgctgatggtctgagagtgaattgcagaaaatgtgtgcatgtgcccttagcatgggtgaggctgagctaagtgagtctacccttcctttttaaaagctctaatattgtcccctaaccaaaagatatgggaatcttagaatgacatttgcactttcagttatgttagttattacaagcacacaggccttacctactcccagaaagcatgcaaattatcttaccaagagatttcataacataatacagttagaatatattaaaatgagattcataaccgctaaatgtgaggcaaagctaattgtaacaagaacctcaaataaaataggaatctgggttttacctttgtgtttcctagaagccacagcaaaaagataaaataagggaacctacagctcataaaaggtagcagacaattttgactggaatctctttctcctcctctaaagtatgttagagtctctcctatgcatgggtggggtctgtgatgtttgcattggacctgcaaaatcatccagccctgtttcttcatttttcagggatgcagatggagattcagaggtgacagtgatgtgcccaaggacacaggtgtcagaagtgggatttcctttctcacggtaccaaatggccagcttggtttgtcagcctgttgtcttatcccaccatgactgtggtcagatgaaaaaactcggctcttgcttcatctgttccctgcagctgcagtccgtttggatagactcagacttaggggtggacgtgaggcagggctcatgggcagtcctcagctgtggcaatgacacccacacaccaacagctgcatggtgacttagctcccttttgggctccagcggctcctctagctctgagatactgagggttcttccagggaagcctgcactggggcagaagcctctacatgggcctgtgcctaggatggggctaatgtcggccatggtgtcggggaagggcgccaagcccactgggtggggcgatgcaggctgggcagggctgctctttcccagcctccttccagagtgggccgtttgcagagtagctgggctgccttcttgttgtgaggatgtggccacttctgcagtggcgctgaagtacaacgtggaactctgctgtccttcccctcctctctgctgcccacctgtccccttcccctgtgtcccagaaacagcgtcagctccttcctttggggtgccctccccctgcgtggctgctgggttctgggtaggtgcttcatcctgctgatcgctggcaaaagatacgtaacttgaggtttccaatgggtcggcctctgctttagggacaccttcaaacgcagagctgttctctaaggttgaggggtcacgggatgaggatgggagctcttgctgggcagacaaggcctttctctgcaggtagtcctgttgactcaacccccatgcaggtggacaataggcaggactgttatctccaaaggcggcattgatcttagacacatttcctgtttttagggcaagtttcacccacagccagtggtgatgactgaggaaagagtcctccacagcaacctgggtccccagcccagcctctggggggacctgctcaggggtagggggcttccctaaaatggttggttcataacttgccccttggcatgagcctgagctctcggttctcttcccagctagatctgtggcccggggagaatctcttctctctgttttatcacctcctgcaatgccacaggacttccttaggcagccctgccagatgtctgtggattttggatgcagcaggctgtaataaattaccagtgagacactgcctgaaaaagaacaaaaagaccacaaggttatgttctttgaagtctgcatcctccctctggtgtgcagtttcaggttctggcccttttgtgtagaggaagataatttgggatccaaaataggactcttgttggagcctcagaactggatatttcgggggaatttaagtaggttccagcttctgtaagctgtaaatgtttctaaagttaaacatgaataacaaggcttaaatccgattgattctatgcttttgtcttgagggcagctccagttcagtcatctacgtgtgtgtgtgtgagtgtgcattcatgcatgtgtgtgtgcgtgtgtacacacaggtacaaaatgtttggcagaaataagcattctactttcaagtaactggaccatacactgcaaattcgactgtcaatacagtggttgatgggttacaaagctgggggaagggagggcattaagaaataacctcaaaaacaagtaagacctaaacagaggttaatcagattcatcaaaaaccccatatcaaggaatttccatgaacaacaacaacacttcctttgtgcataaacatcttaatcacattgttgtcagtttaatttattttgatcagaagtgttgactgctgcaataatttctttaacagagcattccagtaagcctcccacgttatttccagtttcctgttgtactggataaagtgcctggtttcagggtgctcattataaacagcacaaaacctgaagtaatgcctgagaaggccaggagattgcagcatgacagagctagaaagactgcctgaaggacatccccagccccaaatcctctcttgtgtcttgggggactgggagacccagatcaagcagctggttagtggccaggctccaaccttggaaagggaggtggactttctccatgttcagtgccacctctgcagtaggtcctgctcagccagtttctgcactgttttgaattctcacaattgcctggtgagggacatattgtcacccttcttttacaagcagccacccaaggccaggaaagatgaacaaaggcccctgatcacagaagtcctgggcacacttattcagtgaacacaatctttccagaggccatgtggtttgagggttcttggtggcatccccaggctggcacgcagttggtactcagtgaatattggtcccaggatggaaggaaaaggggaggagcctggatgcaagcttgtgctccttggactacaatttgggttcaatcttcctgcctaggattcccaagggtcggctgggagtcaggggtttggcagctccatcagaggccggaggaggagcggcagacaaggctctgagccggtggccacctgggtgctgagtgctgcccgtggctatgggctccctactcactgcccgtggctatggactccctactcactgccctccagctgtgccgtgggccagcatactggctgtgaaaatgtcttctcactggagtggaactggaaggaaaccaggcatccactctcaggagtgtgacaggttttcggagtggtgtaggacatcttttctgagtcagtgttaaaatccagaaagtagatgaggggacattttccctcccaccacactgcccccaggactcagctatacctcccgtgaactggaaaatccagatgagttgttagacctcccggccggcaaggccccttcattccaagtatcacatggcccctccctgaaggaaggattgcttgaaatatgccaggaacacccagaccacgatgcaatgtggtgagagtggtgcttctcacccgggcagcgcgatgtcctcagtttcccataggccatttatccacacacacagcttagaaatcaatgctctgcgattcaaatgattattttaaaaaggatgaaccagatgcccgtccatgggtcgacgatgaaacaagctgtggtccgtccaaaccatgggatgcgactcagccatcaaaagcaaggagcaacccgggaggctctccggagagctctgccaagtgaacaagaccgatccccagggtgcacacactgtgtggtactttcacaacgcattctccaagtgatagaataatagaaacagagaacagaataatggttgccaggagggaaggaggtggcaggggcgagaggaagggggccacatgaagggtcctcgtggtgatggaagggttctccctgcacctcgacgtactactttgagatcctggctgtgatgttgtgccaccgttttgcgagatattaccactgggggaaaacctggtaatgggtacggggagctctgtattatttcttaaaactacaattatctaaaaagtttgatttgaaaaagaaggggttgtctcagctacctgaagctggaagaagtgaggacccgtgacgtctcatgaagaagaacagagctgaaacccagggtggcctgtggctctcaaatgcttgttacgaagccacagtgtgtgacatttctctgacccgtgaacagcccctgcatctcactaagtgtttgtgtccaggtcattcctttcccaggtccaggccactcacacaggccacatccaacccccggctgctgtgagcaagaaaagaacccgaggccacttccaggcacctcttcagggtgtgggtgacagagagcaggctctggagggagggcaggagttgttgcagaggactggggaatctctgtcctggcccatgttgcagaagcacgaggccccacgtgagaggtgcaggtgctggctttgacggtcccaccgcaggcctgagagtgacagtggtggaagcctgctgtgctgggagaggaggctggtgttcgcacctttcaagtggggggcggaatccctgcggaactcatgccaatctgggaagcgaggtcatcaccgtgggtgtgacacagaccttggggccatgcattcataaaacacggctgatgacagtgccaggcctgtgctcaggcctgcactggagctgggcttgaatctcagctctatctgttacaaaccattggatctttcggggactcaacctcctctgtgcctcaccttcctctcctcctctgctagggcacccacttcccggggtgcttgtctatgggctgcagggggtgccatgtcaggaagatgtgaggagctcccctaggtgggaggggagagagaagtcacgtcctcaaccctgcaggaagctccggggaggacgggggctttggggtagagagggatagccccagctttgcttgaggttccgagcacagtcaagcaaggcagatgaggctgagctcagtatctcatgctctgatgggcatggctctgccccccacatcgcagtgagcctggttccttggtctccagttaaccacatctgaactcagtttcctaccctttgagcccattgtaaaaaaaaaaaatacgttggggaggggatgcagagaagaaggtgacattgggacttaccaatcagaaatccagacaggaccccagctatggtctgcaggctggtccacagatgccccctggagaaagtcggtggccaacagcaacaggatgatgttctccaacagcatgacctgcgggacccaggacagaggcaccacacctcgtcaggtgcacactgcctagggacccccgtcccgtgagtctgcagcggctccccctcccctccatcctgagtgcccactggagactccaggctgctgaggagtacccaggagcagggctatgtcccactgagaccttctctggcaaagagagagccaccctgttctcagggtggctcattaaagtgtctgcagaatcataaaggcccaggaaatgtaagggcatccctcaaatggctgtggggctgcctttagagagtcattatgggctgagaggggacttttattttctactttgcatatttctccatcctcacactaactgcaggcactcattagtgttaaaatgaaagatagctgcagagctcatgatgccactgaattccagggagctagggtcacaaactttctaacaactttaggattttgtttccttaaaataattgctttgcggccaccaggtggcagccggagacgggagctcgcaggctgacaaaggagcctggccccgtggctgcagctggtcaaaatggcagatggtccagaaggctctttgtacgcccatctgggtcagcttattaactttgctttccaatttttaaatataaaaagatacgtcttcattaaaataagtaaacaaatgacataattcaaagacgatatatttaaatactgtgtgttttatatttaatatatattttaatttatttttatttaattaaataattatttaatttaattaaaaataatttaattttatttaattaaaatataattaatatatattttaatatatttaatatatatttatattaaatactgtgtattttatttatttaaaaataacacttaaattatatactgatttgctaaaactcttcaaaagatttgccaggttattcattggcttcgtttttcactctcaaaaattcaaataaggagagaaataaaaaaaattatgaggagctgcttcgtaatcctatgaacatccattctcccagtccctctgtgtgcaatgggcagggtttctgccctaaatgccttggccagcagccagtacagaaggcatctttctctccccactcctcagctgtgtggttctggtggttcagattcttaagtttgtcccaactccgtcacctgcctcctgtctttcccgccatttccgtggttctggccccatgcctcctgtctaggcaacccctatcttcattctctctctgaaatctctcctccacaccaatgtcagggtgacccacttcacccagagattgcatcttgccattcctccccgatgcaccttgaaacagccccaccttaacttcaggatccagtccctacttctcaacagagcagatggtcctgtttgccacttagcgcaagttttcctttctggggtcatcttccagcatgctcttcccaaacgacattccactgacaaacagtctttcctcaaccaaactccagtcagccttctctgagccttcttttccatgagtcttcaaccctggccaacgagaactccagactcagcacatatgattccccttacctccccacaccgagagacttgaacaaacactgaccgagtttccagcagctcaaggcctcacccctacgatgctgacctcagtctcctttaagttcctgcctgagaaagcgcagtgctgccaggagaaggtactgtttgttccagccaaaacttggtgctgggtggataggaccctggacttcctttccgagcagttcctttagaaagcttgcagttgcaaatcatttcgctgcgctctgagatatacatcctctattacccagaactgtctcctcaagtacccaagagccatctattcaaatacaaactccaagcctggtgggtgcattgccctaacaggactgactcctgcctcctgtcataaagaaatgagaaatttgtttctgctcccagcaagtgacaagcgccaatgaacaaacacagatggcacactcacatttacgatcccactttcctgctttttgtaaatttccacttccctgtctctggccaagcccccggatgttcctcctccttcctccctttttctcccttttaagccctgtcacctctgcacaacttgaaggtgggttcagttcatgcagggctcttccctatggcgatacactcagtgcaatctgttttcattgcttttaactagcgcagggctttttttccctcggacgctgtgcgcactcactttcctgtggatttccagacactccagggtctttccattacttccgcagctttgcctgaaacgttctagcgccgtccacaccttttcttcaggtgaaccttgctcaccacatagcacatcgtgcaggtcccctctgtaaacccttccctgactttcccaagctctgcctcttgtgtcctgtagggttttgatagcgtcacttctctgatcacagtggctgcatggatttgcttatgtctttgtggcactgagacatgaccctctcacactgtggtgtctaactccattttcagcacaggaggaagctcaatgtgtgctgatgtgaataaacccataacgggtgaaagaagtgagacggggtcttatattacattcagaagtgatcaacaggcaggcttccgcctctgagcaggaggtgaggacagttgagtagatcctgagctaggccagtcatagtgtcacctgtggctgtctccagacgtggattcccaggttgcagtcacacctactgagacagaatctctgagggggagcctgggaatcgccactttataaaagctcccctgagtgccactgacaaccagcagggctgaggcccagctgcactggaggcccccagcccccagcccctgccagaccgttccagcagaaacctctgaaccactgccaggcggtggcctgttggttaaaggccctacgaaaaagtataaaaattaaccaggtatggtggtatgcacccgtgatcccagtgactcgggaggctgaggtgggaggatcacttgagcctagaaagtcgaggctgcagtgagctgtgatcacactgctgcattccagcctgggcaacagggcaagctctgtctcagaaaaacaaaagcaaatacaaaacaccttatgttccttcttgaagggatgtgggggtggtacactctccagtggcccaggaataggctcaacatagctgagcgatgcttgggttggccctgggctacgctgcccaagtctggggcttccagacaggaattgcagcttcttctggggcccatccagggcctggggtctggcagcctctttcctgtgtgagctgctgtctcgagggctggggctgcgtgggtcccggcaccctccgcagaaggtaatgctttcggatggcagcacgggtctgtgccagcagggtgcacatctcagggagtggcgccccagtctgtccactgcactgtggcctcaggcttccaagatcacagtctgggcatttctaacctgcccagaggcactggtttcaggtgctggccactcagccacattggatcaatggagtttagctgggggtgttgaggaacagtgggagaggctgcctcacactctgaatggcccgtgccacggagccagggctgcccagcactgcctggcacagggaggggcccagactcaggtctgggcagtgtgcatggtgaagtgcgaggtgagcatgtccacctgtcatctccgccttttcttcagtttcatggttgcagccccacctcagaatgtgactggcaggcactcttgaaatgtcaggagtttaataggttatcctcggagttatgtgttatttcacctctttatggtgatattggctatctttaccctccacttccttcctcttccctaccttccttcctcttccctaccttcctttccttccttccttccctccctccttccttccttccttcctcctttccttctttctctgctctcttgcccccgatgtctgtttcatttattgtaaattatttatttatctttcagagcatctacatctatctacctgtgccaggcaccaggctcttggctttctatccatcaccttatcaatcctagcaacaaccatttcagagatgcaaaaactgggtgtgggggcagggggagccccggtgactctcatacagttcagaaccgaaggatcctggtatcaagccttagctggtcgggcagcaaggcctaaagcccatgttccccatcacatgctgtagggatccaagcccccgggctaggactgcccggcctggatgggtctgtgcacagcgagagagataaggacactcgtgccactgtggtagatctcactccaaatgtaatggtgtctgatttctgcttttcctatttaatcgctcttgactcagtgatctagtgactgtatgagatggttgggaagaatgaaggatttgctttctttccttctctaacagccctcaaactcctgggagatgacacggcaactgacatgtgagtgtgacaaatgcaagcaaacaaggtggcaggtgtcaaactcctccttattgagctcctgcttatctgggcattggcaggcggggtgtccacctatgaataagccacttcagcaaattggatgagaaaatcaatattccacttctttgttcacttggggatcatgttggttgggaggctgctcatgcatgacctgggccctgccacaagtgaacctatctacaacacgcacgctgttatgctcggtgttcagatgtggacgctgaggttggtgaggctcagtaatgtgtccaacattgcaagtcctgtgagctctgcctggctctatagcctgtggggtcactgtgctatatgggtcctaaaatcagcaggtgtctaggacgcttccctttcctggacaggagctgcatcctgcctttaccttcacccaggtctctaccctggaatgcctgactcctcccacagaagtctctccttttcatatgaataatggccacaatttatgggttattttgtgccagctacttatgtatattattttatttggtctttacaggaaccctgaagagtatgtagatcttatttaatcttcacaggaacactgagaggggggtgacttattcctagcgtgtgcatgaaaaagtaggttcagacagtttaaattcttggctgaagccagctggtggtagcagtcagcagagctgggctccagtgcaagttttttctgactctaaaacccatgccccaccaatgtgattgtattttctctcctttgcccattataatccagctcaacctccactgtcctgccaaaagtgtctgtggtcatcctgacgagaggtgatgctggcagctactcctatgagtcccagacatttttttctctcctggcatctagctacgttctgtctgattttggttatttgggtgtctacttacttaccaaatattataagttcttcaaatatgaagaaatctctacgggactcaaagcaatctgaagaagtattaggccacttttgtgtttctgatactctctagggccatgcctggatcttattcataaacccctaataaaaatggagttgattaacagagacattgagtatatgatattatacagttgaactgtaatgatattcagcaggtgggctgatgtagagaagacatcaccaaatatgcctcagttgttgccacattgaatgcagggccacagctggaggttgggttactattttcaaagcctgtcatctctgttcaagactatcatttctttaagaatttttcttaaactaagctattccttttcaatagataggtgtgcattggtgcacacacacacacaccccccacacacacccacacacaccccacttgctgtatacactgtaaaagttaggataaagaaaagtgccacttgccatgtagaacgtgaccatcctatttctagaagggctgtcccagaagctgaggtagcagaggatgtacacggcccccacgagcaggttgaacagcctccagtggcaggtgctgtcgatgatgtcactctgctgggcgacaagccagaatgtcatcaccagccagtgggcacctgcagagaagccgggtgcagacgtcagggtccatgcaaggagatggggggacaggcaaggacacagagaccaggggctggaaggctctccgaccacatttgactcagcatccaagaagagatatcaaaacccagaagagatttgagggggacagaaaaccaacacagtttatctttgcatgtattatcccattttatccttataaagggtatctgacctaatttgaatatgacacaagaaagagtagcttcaataacacttgccaaatattgtatacctatgacctttttattccagaaagtgtttaaaggggcagttataaaactgactgccaattattttaaaattgttacaagagcaaaaaacctccacatgcaaaggaaagaactctatgtggtgcagctttaatttttatgcccatattttaagacgaataaatcattttggatttcaagctgattttttttaaaaaaagaataacaaaatagctaatctctctttagaagcacagttctttttttcaaaaaaattatctttttggccaataactgtattcaatgtttgctctaggcccaaggggcaaatatttcttaatgtctccaattctcttaaaacaagagtaaactgttccttcttgcagagtatattcactgatgaccagagatgacagctctcctcggcagggacacacaggccctattcagggaatctccagagccagatagactctctgtcattgccattcatattgcgtgtgcctagactgagggaggagggagggcttggatttagtggagctgtcctatttgcaacagaggagatgtccaagattcagcattcaaaggaaatggtgcacttttggaagctatgtgcagtatgacatatagactgtatatttttatatcaggtgaggcaagtgggaccttgtacctccctcctgtttcagtgacagtttttctacataaaagattttggcctgtaacacagaacagtctcctgagaagttctctgctccagatttagctgggagtgttgagggctgggatgtctaagctatggcagagtatctcccaagacagccagcacgcgttccttcctgccctggatgtgtactcatcgggagctgcagtctagtcctccatgctcttgaatctgggctggttgtgcttgctttgactggcagaatacagcagaagcaatgctgagccagttctgagcctgtttttatagaagactagcagtttccagttccttgccattgcaattctcagctgctaattcctgtcaaggctctttatgaatctgaacatctgctaccccattgccatctctgaggccacccaagcaagatccattcagcagagagcccagtcagccttcaggcctgggattgaggatcatatgtggttattcttgagaccttcatttctgggttgattggttatgcagcaacagatgaccagatcattagctcagctcacctgcaaccacaaaaacccaaaagtggtaggctttgtagaacagaaccagactcagcacgcgggttcccaacatgcccatcctccagagctgctggcagaagagggcggcccatggcatggccaggtggcctggcttcatgaagcccatgaagcgagtgtaggacaccagtgcccaggagagtgaggaccaggaaaacagggtgctcacccctgaaagggaagcagaaagatgtggtatgctctgaagattccgaagtaacagtaccttgtgaagattcactcatggcatttctttaatgggatgtgtaacctcttgttaaagcctggctgcacagagagtattactaacccaccactttgaccagtaggtaacataacaactctatgtccaaatacacctgtctatattcaggaagaaatggggatatgcaggaaatatttccactgctcaatgtactaaatgctcttcccagcaaatgggctggactcttcctttctacgccctttaagaaaaacgtcccagctcctgatcctctaagtcctctgtatataacaaagctgattctacaaggctctgaacatggttccaccccaaatgtactttgctgttttatccatatgaaggaggtttaataaaagaacgaaaacatcaaatggtgtcaggctctttgataaagatggatggaaggacagtgcaggcatatatgtgaagcatttaatttgtgcatatgcaattgtggacactcagcaaagaggaagggagagatgaagatggaaggggagaggtggggagggagagaagggggtgaaggggaggggagaaaaggggatagcaggagggagagggagagggaaacaagaagcaactgagagaaacagggagagacataatgagaatgtgaatggcctgaaatgagtgggagctggagacaaatgttgctggggcctgagttgttctcagtttccacatggctttgaaggtataagcctctggctttgttaagaattattattattattattattttgagacagggtctcactctgtcacctggactggaatgcagtgatgcaatcatgactcactgcagcctcaaactcctggcctcaagtgatgctaccacctcagcctcttgaatagctggcactgcaactgcatgccaccatgcctggctaatttttgtattttttggtagagatgggtttttgcctggctggtcttgagctcctgggctcaagcaatccacccacctcagcttcccaaagtgctgggactacaggtgtgagacttgtgcccggccaagaattattctaatgattaaagacacaagaaaaacatgtgcagtgagtttatggagaggcagtctttccaaggcattttgaggataattttgattatgggcaatttctatcttatgggctgactttagaacatgacccttaagaaagaagggagccaactctctgtaaactcaatgcaccagcaaaagccagttttaagcatcatctgtgccagtgagctcaaggtgccctaatgctcctaagcagaggaaatctcgaagggagggttttgctaaacaggctcacattcctgtcccccttcggcagtcagacagtctgtgctctgtggtgacagttactcacctggcacaatatctgtgaagtctgaggctagaaaaacatatgtctgaagcagcaggtggggcccagtctgcagcagggcctccaagagtcgaagggccgacaggtcggcctcctgcagctgcagccagcctcggtggggagcctccagttccttctgcagactggtcagtgcagcgtcccagtgcctagggaacagcagagggcacgtgacacggagccaggctgtggcgagattcaataggacgagctttcatttagagacatactacatgctaagcaatatcctatgcccttactagtcacctagagttactagttaggctgttgccagcctctgactgcaagcagaagacgtcacttctatgtaagttccccgagtcctgtggtgctcagccaggccacactctccccacgtctggtaccccagtacctgacctgggggctctttgagctggagcggctgcatggcaagggaacccagactgccagctctgtgaagctcggcaatcaccccgacctgagtcccaccccggatcctcttgggatgggaattcatttatcgacagatgtctgttgcaaggtactgtgtgttatcatctctttgaaggacaaaaagtagaaaaaacccttgtcttcatcctcacagaatgtagaactctgtgctgcgaaaactggggcacatgaagagcagacagggaagaaggatctggaggctttgctggggagtggccagaggtccaggtggctggagcaccatgcggagcttggaggctgatgtggtcccggtgaagtagatcagggccctgaacttcaggctatggggtttggattttgctctggaaaaatgaatttggcagaggtaatatgtactgtctggggtatgagatgaatgtgtatggatttgtgtgtctatgtatgtgtatgtgcatgtgcgtgtatatgggtgaacacacatgtggtgtacatgtgcttgtgtgtgtgtgtatgtatctgcatgtgcatgtatgcatgtgtgtgtgcaagtgtgcaaaacatatgcatatgtatataggcattatgtgcttgcatatatatagtgtgtatgtttatatatgtgtgtgcatgaaggtatatgtgtgtatattcatgtatgtgtgcagtgtgtatctgtagtgtgtgcagtgtgagtgtgtgtgtgtgcacgcatgtagtgtgggtgtatgaacaggggataggaacatcaggaggaaacagagctaatagaatacttccagcagtaattggtgaagggagtcctaggaatggaaagtagggagcaggtgcaggaaatagtggagttggagatcaggatttgatgactgaacaggggagatgagggaagttgcagtggctttgaggtttcaggcctaaatgacttggaaatggtggtgctaccgacggaaataagccaggtgaggagtgctggattggccacgatatgaatttcttcagcagtgaggaatgtgaggatgggtggagcccccataaggagagatctggatgaccagttgtggttgagggactggaagtggccagaagagactgtgtgaagacagcatagaccaaggacagcaccctggggactgttcccactaaggggcctggatacgaaagggacaccagcaagggtgggtggaagccgagaaccaggcagcggagagagctgctgatctctgcactgtggattacaggatggggtggcccagggccacggggacacatctgctcacccagcctgggtggtcctccgaggctctcggaaaaggaatcaagcaacaagaaagaagtcagaacatgtccttgcttcagtctgtttcccatgagcctatgccaggcacctttactggaaacttcatctcataagtagaaagtggcacagaccaccttccttacaacctgaagatccacatagaacccatgaccacgaagccactccccaccacaccagcgggctctcaggcttcgagtctcacctggaggtcagatttcgccaccacccaccaattcctctctgggtctacctagcagcagcaataaggagatgaccacagccgcctgcacacgagcctgctgcccagcaaacccactggattctgcttccctgtcttgttcaatttaagaactagaggtcacttcaatttagcaactcctgaagccaagctggatgcatctcgaaggtcacctgcaaaactccctgtagagacccctaaggctctgactggcaggtgacaagctggaccctgatgggtggcaaacatttctatgtccagagcagaagattcggggactcctctttgaaatggctttattcatggtgctgagatcccaggacagatgtctaagaaaaacaactttcctttttcatgatttggaatcctggagtgaacccatttcttactgtgtcttgattcctgacataaacttaatgttaagaaaaacatatgacactaaaaaatgtaaccatgagggcaggcagtagttttcttttcactctcaaatcatttgttcctgacatggggtagtttcctcttcttgctcttccagaaagctttgtttgttcaacatgcatttttcttgggctttgagaggcccacctgctacagaccacaggcgaagtaagagaaatgaatcccagctttttgggaggccaaggcaggaggattgcttgagcttgggagtttgagaccagccctggcaacataatgagactccatgtctacaaaacaaaacaaaacaaagagctgggatagtggtgggtgcctgtagtcccagctactcaggaggctgagatgggaggatcacttgagcccagaagttcaaggctgcaagtgagccataattatgccactgcactccagcctgggtgacagaggcagaagactctcgtgaaaaaaaagaaaaggggggaagtgaaatgaaagatgtcttttagaaacctaagattcagtgtggaaagaaaacatacaaatgcgaaaagcttcaagaggaagaaatataagtatcaacatgagtggcttgggtagtggtggaatcagagtcacaggcagagagaataaggtggtcagggaatgcttcctggaagaggaggacaggcaaactctggacaggtagatggtaggaagagcctaaaggagtgtctggggtcagtggcacagggtacaaggcactgaaatgaaggtccatgtctgggaatagcgaatatctggtgcttggtaaggcgggggccaggagaggctgagttgtggggctactcttgtaagaaacagaggaccagtgggaaggtgactagcccggttttctgaaacgagctgtctcgaacccattgcagagggagaaattcaggctgagacccctggacagccactagggaagccggggaggaagctgaggcgggatggagagcgtggggatttggtcactaggtcctatgagatggtgtccgacatctgtcctcacagtcgctgcatcattccaggtccttatcagcacttgcctggatttctggctgcctgcatggaccccgtccctcccaactctgttgcattttattgtccctggtgccatctgtctacaggctcatttgcccatattattcctttgctcaaacccttccaacaggtctccaatgcctgaggataaaatccaaactccttaatccagtagaaaagtttcttcatggtccagcccatttatctcctgccacattcctgccatctaggaaattcttaccctttagtctcaagaacctcatcctaatttcccatatacaccacttctggcacgcatctatgtctttgcaccagcggctgcagcttgctgtgtcggaaacgcctgttccctccctacattgatggaaatcgcaacagccttcaagcctcactcgagggatcctgaggcaggactgggccctccagggctagggctatattttatatacttttaaatattaaatctccacccatttatgctgaacctgtcttacatacctttagagtttaccttaactttccttttgacaaccttgaactttcactaaagaaaaattgctaaaccaaggtgcatgctaaggatgagataggccttcttctgtcatctcatgctgcatttacaagtggatttgtgggcttaaaaagaaagatgaaaaagatgttggtaacatacagtattaaagtgtaagtaaaaaacctaagtagaagaaagtaatggtctttgtttaaataagtggtcaccaatgtcaggttctcttgaacagagtcagacttaaaatgaacatagtatgtattattgggaacgttaaaaagaatacacttatggcttaaatccttgcctttttatatttatttatttatttgagattgagtctcattctgttgcctaggttggagtgcagtggcgtgatctcagctcactgtaacctctacttcccaggttcaagcgattctcatgcttcagtctcctgagtaggtggcattacaggtgtgcgtgaccacgcctggctaatttgtctatttttagtggagatggggtttcgacagtgttggccaggctggtttagaactcctggcctcaagagatcagcctgcctccacctcctaaagcactgagattacaggtgtgagccgtcacgccaggccaaattcttgctttttttttttttttttttttttttttttgagacggagtctcgctctgtcacccaagctggagtccagtgatgcaatctcggctcactgcaagttccgcctaacgggttcatgccattctcctgcctcagcctcccaagtagctgggactacaggcgcccgccaccacgcccggctaattttttgtatttttagtagagacggggtttcaccgtgttagccaggatggtctggatctcctgacctcgtgatccgcctgcctcggcctctcaaagtgctgggattacaggcgtgagccaccgcgccaggcctcaatccttgcatttttataagcaactttgtgttttactggattctcagttagcagattcttttgtattttgtgatgaggacactcaaagtgacctattcttaggcaattcaaaattgtgccaaacgcaattgttttggctccccctacaggtccttttctagaattgcaatttggaaagctggattgcctcactaaaaatactgcttcactcagtgttgtctttgaaccctatgtgctagtttcaggatgaggaatggatccactgctgtctattttaactttcaaagctttcctctatggaagtaaatttctgttttttggttcatgtttaacctgagaaacactgcaaatcttgcggcctttatgcttgcactggctgttataaaccttagggccaaattgtgacccgcttccgatagctgtgcattctggctctatcttgttttctaacatttcatctcgatacctggcctttctcatttcttttcttttcttttttgttcttttaaggatgtgtatttttaaagtcatcttaacttctttttcaaaacaagaataaatatatatgactaatggtttttcctaatttataattttcatgtatctcttcacttatctatatgatttcactagtatataccagattattcaagttcgtttttttatatacaccagaaaatcatggcatcacttaagaaaattaagagtgcatgggaaagacagtgtggggtccactgtgaaataccagcagcatgaatttggacacaccgtggtcccctggcagccctcatctctgaggaaggcagtggattccatgaggcctgagggtccacacagcctcagaaggcagatttgtctaaccgttcattacccaggaagcttctctaagtgaccacctgggcttacctctctctttgggctgccaaacatgggctcatggtagctgactcactcaacaggcctctgtcctcgagggctcatgccttacgactgtgatggtcaaagccaagtaagacccagagcccttaaggattgattactgggctgggccgatcagggaaggagacgacaatggcagctagggcacaggagaggctctgaccctatgaggccctccgaaagatccttctctgccttctccgccatggaaggaagggccctgtcttttcaggggaacggcactgcttgaacaccaaggccgagcttttggcaaaatgcctgtggctgcaaatatgctttcggtgctgttagaggtttagggtccaactctgagggtccagtgaaactgagagtgggtgcttgaagtctttctcagaagcaccctctacctcctagctgagattctactctgggcgggacggcaccattccctgctcacagtgatgctctatgtggggctcatcactcatttcagtgcctccggagaaagtcttgggaatagcttgcaggcataaacccctaggacacacagcagcattggccacgaccccttgaacacctttccaaccctcagtgcctatgatttaatgaacacttgagctgcagggcttcaccgctctgatccctgaatttttctcccttaaaaaaaatcctgtggccaggtgcagtggctcacgcctgtaatcccagcactttgggaggccaaggtgggcggatcacgaggtcaggagaccgagacgatgctggctaacccagtgaaaccctgtttcgactaaaaatacaaaaaattagccgggcatggtggcacgtgcctgtagtcccgcctactcaacaggctgaagcaggagaatcgcttgaacccaggaggcggaggttgcagtgagccaagatcacaccactgcactccagcctgggtgacagagtgagactccatctcaaaaaaaaaaaaaaaaaaaaacaaacctaacaacccaatggaattatgaggcagcagctgccagctgaaatgtgcccttgatataaactcactgacacatctcttctcatagctccttgaatccaggttctcaaagtagaaaaaaatcagccctcacctgtcgtgatggtctatggatcacggataagcccaccaggccccagaactatccctggctacttctttagagaaaaaactagccctggcatccaaatgactttttcctgagacgaagtcttgaagcaaatgtcaacaggctggcttcattgtctagtctgtggttcactaaactatgccaccttcctgttctaaggtgacaggtgtgcagatggaactgccttaagtaagttgctttatatggaactaacggctcaaccaacaaatcaaaacagcaagacagggcttcatctgaagacaagaaaaagcctttcgtaaggtcacagcttcacagagaaagagcccctgaggttggagatgctcaaaaaagtgcaggctggacccgggcatgccaatatcagagcaggggtttgctgtggccgctttgaacctcttcccaatgctgaacttttatgagcttgaggacagaatccacatggagagaagattcctctcactgcacttgtgcaattgtgctccagaggtgaaagaggcagctgttcttaccgcttccaaacaccaagctgtaggaggtgcagcatcatcaaggagcaatgccctggatgcccgtctgctcggaaccacaggtagctcagggcctggaccaagaacccgggcaggaggacagcaagggccagccacccccacagaagccgtcctgtggtgaagtagtaagccacggtgtaaaggcctgggtgagaaggggaaaggcaagcaggttgttggaaggctggagtgagactgggtacctgcattttaaacaactgaacattttctggatgttatgatgttctgacctcttaaaatctttctggctggggagtgactgtccctcccaaggctagcaattatttcagctagcaaagggcccagccaggagcttgcctttgacatgcgaactaaatctagccagagccagacctcccctacctggcccatacccccgcagaaggcaatcttcttttgccttaatcatcccagggcccagtgccaggaaactagggaccacccttataccccaaagccacagaaattattcaaagggctaatctgaagctggtgctctgccctagcaaagcgtctggcctcaacttcccctggttcctgtctcctgcctcctgaccaccctggtgacattcccctgtggcccggcatggtgtgccatgtctcctgtcctaggacctgtgagtacagcaaactttgctttccagagtctctcctgtgtctcatcttgtggccacacctaattatctcattaaaaacaaaaccaaagcactttgggaggccgaggtgggcagattgctcgacgtcaggagttcaagaccagtctgggcctctctactaaaaatacaaaaatgagcaagtttgctggctgcgtgcctgtaataccagctactcgggatggatgaggcaccagaatggcttcaactcaggaggcggagtttgcagtgagtcgagattgggccactgcattccagcctgggccacagagcaagactcttgtctcaaaacaaaacaaaacagtaaccaaccaacacagtgtccccatcaccagcaagagtctcctaggagcaggctgggagccagcagagcctctggcaacagggacaggcattcactaaatgacattgtcagggctttccagagctgttgggcaatatacgacatgtgtgaagcgcctagcatcttgtgcatcctcgagaacgatgaaacctcctctctggtttgtttgcttgtttgtttttgatggtggttacgcagtggagagagaatgtgcactccgcagtcagtaactccgcactacgaaaccgttagtccctgtggggtcacagctctctctgtggggtcccttttctcctactttcacatggggaactccctggcctggaactctgggcctccccaatactcctagcacggcctcctcagggttgtctgaggctgatcttggaggcggtgcgctggtagaggcaccgcacacaggcatcgtttcacacaactgttacttaggttttccaatagtaaagttctaagtggatgaatgaacacaagccgcggattttagggaaactgggaaaactgccctgaggtacagctgcagacgctgcagctctagaccgcggggtccgggctcaggcagcccttagcgcccaggctgggtccggctgtcaccaccccgagcgtcctgcggcagcctcccttgcacgaaaagccttcggtgctgcagggctggggaatgctgacacccagtccgtgcccagctggagggcaagggaggacacctggggtgggtgccgacccccgcaggtcctgtctcagcccttccagtccggggcgcggagccagggcgcttgcgcgtcctccgtgtgcgtcctgctcggcgcgcctcggaagcagcgggacctgcggggacgcccgcgaactcagggaaaagtcccaaggcggcgttcccagggtaccccctcttccaccccagggactctgcccgggaaaaagcttccgcagggagcccggcggaagtgggcggagacgctcctcccggcactgaaggagttacgcgttcaaaccagaagggcgcgaaaaatggggccatcttgctccgccgcggctggcgggctctgggttccccctgcgacggaggtggcctcgaagggccgcgtcccgccccgtcctaaaccccgaagcggagtcgccgtcctacagggccgcgtggatgcggagccctgtccccctccccccgccaccccttctgcgagcggcctccaagtcgcagggtccccctggacggccgggggtcgggggagagcccgggcgcccccagacttgcgctcagcacatcttggcatcgcagcactttgcaaagcttgtgatggaaggaagggcggatacatctcccctgcttctgcgaggggatcttgcatgcgtggggcggggggatcgtgcatgggcgggaggaagtcaagcaccagtcgggaggggggggaaccgagcatgggtggaggaaaatcatgcatccttggggggatggtgcatgcgtgggcatctactaaggacgggaggacgtgctctgcaggtgggatggccaccaccgtgcgtcaccggcgcgcagtgctgggcgcaggctggggcagtgcccgcccgggcataggcagcctgtgcggctcccggcgccggggtggggttaggggctgcaggggtgagcacagcctcgggctgccgcactcacgcgcgctctgctcggccgcctgcagcagggccgagagccccaggagcctcgcgtgcatcttccgtgccgaccccgcagcctgcgcccgccccttcccctgcacgcggccccgcgtcggggaggtttccggcccggggcccgactgcgggtggcatttctggctaagccgttaggcgcgaattgtatgtctggtttattcgtagtggccagcaggggagggagggaggatgcttggggtttctggcttccagggtgggtggggacgaggtggtggagtccagctcaggtccgggctcctgataagggcagaagcgggttctgcgctgcccccaaccctgtaaccgccaggaaagcgcttggtgagcgtcgggactgcgcaggttcctcgggaggtggctaaactggccaccgcctctggggccgcctaaagcaagtccgttaaccactagtcagggaggaatactgtgtttgagtaaatatatgtagagttgggttagaatcattgattgggtctttttgaaatcttacagttctgtgtccagaaaacacagggcacgttacccggtatcgtggtctacacctcgcccacaaatccatcccaggctgtatcctcatggaagctttttccagatgtgcttgagggttaagatcgcaatgtgcaagaagaaaaagtgcacattggaaaaccttctcttcggagatatctatatctatatttatatatatttacagatatggagatatatacacacacgtatctgaaaacattctgacgttttaaaaacggtaagacagacttttattcagaaccatttccttagatgtaagggactgcactgaggttttgcagcaggggagagagattggggtccgaaaataataaggaaaagtggggatttatagccaaggagcagtgtgggggacggtggatggaaagtcattgagaaggggacatcaagtgggggttctggcttccctgacctaacaggattcctgctgagggtgggccaagttgatccacatcggggatgggggtggggtggagcaggtgttggaatttggtcagatatggagggtattcagacacctgaggtggggaattgggattaaactgacttagcaggattcttgctaaaactagactctgcaggaacagaggaaggaatgcccaggttgggcccagtcgtgcagagagctcggaggaggctgtccagagtctgatcagggagacattctttgtcattcatgtatatacccatatattgtaataggctgttcttgtatgactataaagaaatacctgagactgggtaatttatcagaaaagaagtttgattggctcacagttcttcaggatttacaggaagcacggtgctggcatctgctcagtttctaggaaggccttgggagcttatgctcataacggaaggtgaaaggggagcaggcacatcccatggcgaaagcatgttcaaattaacataagaagaaagagaacttggccaggcacgatgtctcatgcctgtaatcccagcattttgagaggccaaggcaggcggatcacctgaggtcaggagtttgagaccagcctggccaacatggcgaaacgctgtctctactaaaaatacaaagattagctgggtgtggtggtggacacctgtaatcccagctacttgggaggctgagacaggagaaccgcttgaacctgggaggtggaggttgcagttagccgagatcgtaccattgtactccagcctgggtgacagagggagacttcatctcaaaaaaaaaaaaaaaaaaaaaaaagagagagagagagagagaatttgaatagtccagtgagtgttagagaaattaaactggtagtcaaagactattcaggtctaggtacttttacagattaattctgccaaagtttcaatgaacagttaactgctacctaatataatttgctccaggaaacaaagaccgaactttacccagcttattttaaaagactgctgtagttttgattgtaaacaaagatatacatagaaagaaaattattttaatgacaagcacagatgcaaaaatcctaggtaaaatgataaattcaaaatatattaaaatagtattatatgataaggtgggttttactatgaattttcacaacccagaaatcctttgatgtcactccattatcattttgaacaagaaaaatcctttttttttctttctttcttgaggcagtctagctctgacatgaggctggagtgaataggcgcaatcttggctcacggcaacctcaacctcctgggttcaagccctgttctcatgtctcagcctcccaagtagctggaattgcaggcgtgtgctaccagactcagctaatttttgtatttttagtacagatggggtttcttcatgttagccaggctggtctcgaactcctgagctgaagtgatctgcctgcctcggcctccccaagtgctaggattgaaataatcaaatgatttttcttggttgggcacagtggctcacagataagaagacaagcatgctcagtatcacaactactgtttaatattgtgttggagggtatacctaatgtataaggaaactgaaggaaataagatcatgtaactagcagaaaggaagggtgagacactcatcatctacagatgcttctctacctagaacaatcaaccttgtcaagctgatgaaatagttcaaaacgtggccgggtgcggtggctcacgcctgtaatcccagcactttgggaggccgaggcgggtggatcatgaggtcaggagatcgagaccaccctggctaacatggtgaaaccccatctctactaaaaaaaaaaaaaaaaaaaatagctgggcgtggtggcaggcacctgtagtcccagctacttgagacgctgaggaaggagaaaggtgtgaacccagcaggcagagcttgcagtgagccgagatcacgccactgcactccagcctgggcaacagagcgagactccgtctcaaaaaaaaaaaaaaaaaaggccaaaaggccttctaatataacttacaaaaaccaatagcgtttctctgtacacgtactatacaaaactggaaaaattaagatagttgtaatagttagaatgtctataaagtgcttaggaattgatttaaaacatacataagatttgtctggagcacaccataaaactctaataaagaatataagaaatgatctgagtagatatattcttgtttttgattcaaacagcttaataaaattgtcaattcttccttaattaatctatacattcagtggaaacttattaaaaattccaaaatgatctttacgaaacttgatagacttactctaaaatgtgaatgaagagaggaggtccacaaattagccgactttgtgaagaaggataaagaggcatttgtacccttctagatattaatatatatcaagaaaaagtcatgtttatagaacgttatggtattggcacagaacagacaaaaaatctatagaatgcagtggagagctcagaagctgacctacaaatacatagaacttaaaatatatgaccaatagcggcaccacaaatcaatggagaaatacaaattgtttagtgaatgtgtgataaaatgagctcattagatccaaacaataaaagtagatctccacctagcgcatgcccacaggtggacgccatgtagagtaaagacctacatatgaaagataagactttaacagaaagaagtacaaaaaatagcagaatatttttatgacttagtaatggagaaggatgtcttaaacaacacctcaaaacacaaaccacaagggaaaaatggattgcatttttttgtgtgtaacaactgaagccttctgtttagtgaaggaccttgtggacgttaacggacagaagttagatacagtgggagaagtgttttgcaatgtctcaaactgacaagtcattaatatatgaaatatacaagtaactcctatatttcaacaaaaacgaggaggcagcaacctcagtaaaaaaggggaaaaggcaatttatggaagagaaaaacccgaaaaggcctaatttactgaagaaaatgtttccaaactgaagataatttaagtgatgctgaaacctatcaatattttaaaaagtgcaaagtgaatgacatcactttatttatttattagacaagatcttgccctgccatccagactggagtgcaatggcgcgatctcagctcactgcaacctccacctcccgggttcaagcgattctcctgcctcagtcttatgagtagctgggattacaggcacgtgccactgtgcctgggtaatttttttatttttagtagagacggggtttccctgtgttggccaggctggtcttgaattcctgagctcaagtgatctgtctgcctccgtctcccaaagtgctgggattacaggcgtgatccaccactcccggcctgacatcacattacttctttagattggcaaaaattacaaactgggtgatgcctagcctcagtagccacataaggtcccaggctccagggacctctggcactgctgctgtgattagagcagttcaggttaagtgtggtacagtctgattaaaaatcagaagcagcgtcttcataattaaggcaattcttattttaatgttgggcatacattttctaatctttatctgtctatcttttctgttacattaatgaaataagaatgagccttgaagttaatattctgcattttacactcaatgtatcaggaatacattcaaatattcgtatagtacttattattgtcagcaaatcctacgcagctgaagattttatttgtttacctatttttgtagtgttgataccactgcaacaaccatttggggaacacagttcctccactgtcctctgctggaatgtttacttttagataaatttccaggagtacgttatgagaaatgagagtaaacggaatgttttggctctataaatttgtagcaatagttgaaggagttgatgtggaagatactggtgtcttctgtggtcgctaaccctgggatgatccacgagccagtcgggccacccaccttcttaagcatccctcttctagtgcgtaggagaaagccatggttgccaaggcttttcttgccccctcctccaagccatgtaaactaatcgtccctcaagcccatccggaccctgtaatgccatggcttgtttgcacctgcatagatagcagatcatgagagtgtgcacagcgtataatgccttctcagtgcatgttgggtgtatgaatgaataagtgaataaacaagtaagtgaatgaatgaaagcaagcagccaggaagcgctgcagctcagtctagtcttttcccagggcaaacacccagtaggtggcgctgttgcaccggcggttgcaaaccctcagagcacgtttaaacagagctctctgactctgggacagaggatgtggaaaacctgtgtcttcaaatcacgtcattaggtttgaagatgacttaatgtgaaaataaatgtattttaacgtcattaaaataatccttagtactttaaaatctcagctagcttctgaatgctttgggaatactttctccatagttaactgcacacaagcccgtggggtgggcagggcaggtatttgctctctgagatccaaagagggcagtttctcggctggtagaggcagagctggatgcagagccaggcacagagccaaggcgcgtctgaccccagtccagcgggatctcctgcaagccgcagtgtttccagaggcgcacttcagtgtgtggagtgaagggagagtctccggacatgagaagagctgctctgagcagtgtggcggccgtttttgtttcctttctctttctcctcctggggctaggcagacaccgggcacaaagaaggaaacaggccttctgtgagtgcagcagcaatcaataaagaagcagcccagagcggccatccctcttctgtctgctgtgacgctccggcccaggtgtccctggggctgccctccccagggcctgtgtgttgcatatatggggtggggtgagggcagctggaattgaggtggggaccctgcaattgtgaggggctgcgtggcagaggtgggcggctctcgcaggcctcttcctggacacttgcaccccctcatcctgctctctttttcttcctgcacttacatcatctcatttgtttattttctcattgtccgtctccctctacaggagcaccagaggagggggacttcatctgacttgttcagcactgtctcccaggccctggcacagagggagcactcgatacacaccgatgggctgaaggtgtgaatggatctggggactagagtgatggttatttggcagacagcatgccccgcctgggcagtagccgtgaagactcttcttttcctctcctcgcctgcactctttaggattgaacagcattggttcaatgcatattctgggagcacagagaaaaaagggatcaagttccaccattatgcaaaagggactcctgtaagccaggtgaagaaggggcaaggcccttcttggtcagcagggataaggcagttgtgtatgggagagcatgcgaggagggcgagggctgggggagatggagcaggaacatttggttggggctctgaggcactcttctgcttggggagtgtgtgggcaaaggcaggggctgtgcaggaaggatttagctaaagccataaagctggaagagggtttggggaacggctttgaagttacatttgttttgcaagttctttgtttttattaatgtttgcatgttatttgggtagctgtagggagtaggttttcggggagttaaagtgcactctctcacccctccttcagtcctactactgcccctagatacacaatcacctcaagtgactttcacgtcaccaggaatgggcaaagtctagattttggaacagaaaatattttaggtccccgtccctctctgtaaccaataaccaatgccatataaatggaaaagtataaagaagtccagaaattcttattttcccctcaacgactagtcatgcatgacattttaaaactaatacttcactggcatcagagctcctgggctgtgcttgatcaaacaattgggatctggctctgaagcacatccttgatccgtacggatttttgtcagagaatcttccgcttgaaaggcagtgttcggggtcttccaaggcacactgaactacgttaagcccctcatacacacccaaagtacgtaaggcagaaggaacctggataccctttgtggttgatggtgaggcgggccaccactgtggccctgaatcccccactgaatcacaccctttgtgatctgactctgcagctctttccatctgcagtggtgtctgtttccccagctcaggaatctagttggctttttgacttgttttgaccaataacagcagcagaaggggccagttatgaagctaggcctcaggacaccttgcgcgtggctctacaattcacattgccttggcggcagccagcctccagtggacctggaagctaactgcagatgcaggggtaagcccggtgggaagggctgagttgtgtgcacccgaattcctatgtggaagtcctaactcccagggcctcagaatgtaaccgtatttggaaatagggtctgtgcatagcttattaagttaaaatgaggcctttaaggtggccccgattcagtaggactgctgtccttataagaaaaggaaatttggatactgacacacacatgcaccaagggacgaacacacaaagatacaggaagaaggcggccatctaggaaccaaatcaaccctgcggataaccggatgtcagacttccagcctctgggactgagagaagtaacctgaggttactcttcacgcacacacagtattccttccttctctgcgtctagatacatgtctctcccaaataagcatcgtaatcgccattcctaaatccagcacctggtcatttatttattttcaagaggtaatacggtagaatctttagagctaaagtgagcgttctatttcgctctccaggtttcctgtgctcaggtgatcttcagcccgtcacaggccctggctgcatttctttcttccactgtaggaggaaccaacggggatctgctgtattgtgcaagaaaatatacattggccgccattctggaagcactcaggggttttcgaaggcattggccatggcctgtggggagggaagtatatttcagctcctcagctgacaatggtattccctatgaagcccgcactgcggtctgtgtcaatctgtgccacgctgtcggtggttcttggcttgcaggacagcctcaactctaaaaatgccagattccatagtatctgccccaaatgctgactcttagctccctcttgcaccccagcttccagtccctgctaaagagatagaatggggtggagattccgtaacaggaatctctgcaaccttctatgagtgtgaagacaagccagagcacagcccctacttgccctgcgcatagaagggcaggaggcactgggcagaaagagtggacaggactcctcgggggactgggaccccataggccactgagatacatccacggcctcaggaggccggcatggtgggccggcttggcgggagaggaggcagagaatacagaaaacagaagccggaaagcaacagcaacagaaacaccgccactacctccaatgtctgtgatgctttaagaggctcttcctgaacctagcctcaggtgtcatcaatgaaaccctctgtgccacgtggggtttttattcctgttttacagagacagggttgaatttgaggacaactcagttactcgcaggaaggcccactgcgagtgagtgtcagagctgggaaccacacactgtactttggctcccaggccgagccctcttctgtatcctgcactttctcgcaggctgagccctcttctgtatcctgcactttctcgcaggctgagccctcttctgtatactgcactttcttccaggccgagaaatgaatcaggtgggaaatgagccctggggacaggtgcctcctatgaggcagttatctgcaaggcctatttctagcgctaaccatatctgctgtcctaaaagcctggctcattcctttcactgtctccctggtaagtcggttcttgttccagggaagcaaccctcagtctaaagagatcctggaggatgtctcagtaagttaaaaaaatatatataagcattttccttgagtctgtattattttgatcctctccctgatgctcagatttattacttatttctagaccctgagccgttgtcaaaacacagcttaatccccattccctgggcccgagaccctgcagcccccacgctgcccggcttccggtcttacctggggcaacctgaccaacaagaacgcggaaggccaggagccaaaaacagagactcctgatgggtaacagaaggaaaaggtatgtgccctgctgagaccacgaggctcgctggaagagcctctgtttatactgcttctggctgcttacacaacagatctggaagtgttgcctgttatgagacttaattatagagaatgattctttgtttttaaatttttttatttcttttttattttattttattattatactttaagttctagggtacatgtgcacaatgtgcagtttagttacttatgtacacatgtgccatgttggtgcgctgcacccattaactcgtcatttacattaggtatatctcctaatgctgtccctctcccctccccccaccccacaacagtccctgaatgtgatgttccccttcctgtgtccatgtattctcattgttcagttcccacctatgagtgagaacatgcggtgtttggtttttttgtccttgccatagtttgctgagaatgatggtttccagtttcatccatgtccctacaaaagacatgaactcttaattttttatggctgcatagtattccatggtgtatatgtgccacattttcttaatccagtctatcattgttgaacatttgggttggttccaagtctttgctattgtgaatagtgccgccataaacatacgtgtgcatgtgtctttatagcagcatgatttatagtcctttgggtatatacccagtaatgggatggctgggtcaaatggtatttctagttctagatccctgaggaatcgccacactgacttccacagtggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcgtcttttgagaagtctctgttcatatcctttgcccactttttgatggggttgtttgtttttttcttgtaaatttgtttgagttcattgtagattctggatattagccctttgtcagatgcgtaggttgtgaaaattttctcccattctgtaggttgcctgttcactctgatggtagtttcttttgctgtgcagaagctctttagtttaattaaatccgatttgtctattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctccatatggctagccagatttcccagcaccatttattaaatagggaatcgtttccccattgcttgtttttgtcaggtttgtcaaagatcagatggttgtagatatgcggcattatttctgagggctctgttctgttccattgatctatatctctgttttggtaccagtaccatgctgttttggttactgtagccttgtagtatagtttgaagtcaggtagtgtgatgcctccggctttgttcttttggcttaggattgacttggtgatgcgggctcttttttggttccatatgaactttaaagtagttttttccaattgtgtgaagaaagtcactggtagcttgatggggatggcattgaatgtataaattaccttgggcagtatggccattttcacgatattgattcttcctacccatgagcatggaatgttcttccatttgtttgtatcttcttttatttcattgagtagtggtttgtagttctccttgaagaggtccttcacaccccttttaagttggattcctagatattttattctctttgaagcaattgtgaatgggagttcactcatgatttggctctctgtttgtctgttattggtgtataagaatgcttctgatttttgtacattgattttgtatcctgagactttgctgaagttgcttatcagcttaaggagattttgggctgagacaatggggttttctagatatacaatcatgtcatctccaaacagggacaatttgacttcctcttttccaaactgaatgcctttatttctttctcctgcctaattgccctggccagagcttccaaccctatgttgaataggagtggtgagatagggcatccctgtcttgtgccagtcttcaaagggaatgcttccaatttttgtccattcagtatgatattggctgtgggtttgtcatagatagcgcttattattttgagatacgtcccatcaatacctaatttattgagagtttttagcatgaaaggtggttgaattttgtcaaaggccttttctgcatctattgagataatcatgtggtttttgtctttggttctgtttatatgctggattacatttattgatttgcatatgttgaaccagccttgcatcccagggatgaagcccacttgatcatggtggataagattttgatgtgctgctggattaggtttgccagtattgtactgaggatttttgcatcaatgttcatcaaggatattggtctaaaattctcttttttggttgtgtctctgccaggctttggtatcaggatgatgttggcctcataaaatgagttagggaggattccctctttttctattgattggaatagtttcagaaggaatggtaccagctcctccttgtacctctggcagaattcggctgtgaatccatctggtcctgcactttttttggctggtaagctattgattattgccacaatttcagagcctgttattggtctactcagagattcaacttcttcctggtttagtcttgggagggtgtatgtgtcgaggaatttatccatttcttctagattttctggtttatttgcgtagagttgtttgtaatattctctgatggtagtttgtatttctgtgggatcagtggtgatatcccctttatcattttttattgcatctatttgattcttctctcttttcttctttactagttttgctagcagtctatcaatttggttgatcttttcaaaaaaccagctcctggattcattaatattttaaagggtttttgtgtctctatttccttcagttctgctctgattttagttatttcttgcctcctgctagcttttgaatgtgtttgctcttgcttttctagttcttttaattgtgatgttagggtgtcaattttggatctttcctgctttctcttgtgagcatttagtgctataaatttccctctacacactactttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttctagcttgattgctctgtggtctgcgagacagtttgttataatttctgttcttttacatttgctgaggagtgctttacttccaactatgtggtcaattttggaataggtgtggtgtggtgctgaaaagaatgtatattctgttgagttggggtggagagttctgtagatgtctattaggtctgcttggtgcagagctgagttcaattcctgggtatccttgttaactttctgtctcgctgatctgtctaatgttgacagtggggtgttaaaatctcccatcattattgtgtgggagtctaagtctctttgtaggtcactcaggacttgctttatgaatctgggtgctcctgtattgggtgcatatatatttaggatagttagttcttcttgttgaattgatccctttaccattatgtaatggccttctttgtctcttttgatctttgttggtttaaagtttgttttatcagagactaggattgcaacccctgcctttttttgttttccatttgcttggtagatcttcctccatccctttattttgagcctatgtgtgtctctgcacatgagatgggtttcctgaatacagcacactgatgggtcttgagtctttatgcaatttgccagtctgtgtcttttaattggagcacttggcccatttacatttaaagttaataatgttatgtgtgaatttggtcctctcattgtgatgttagctggttattttgctcatcagttgatgcagtttcttcctagccttgacggtctttacagtttggcatgttattgcagtggctggtaccggttgttcctttccatgtttagtgcttccttcaggagctcttttagggcaggcctgatggtgacaaaatctctcagcatttgcttgtctgtaaagtattttgtttctccttcacttatgaagcttagtttggctggatatgaaattctgggttgaaaattcttttctttaagaatgttgaatattggccgccagtctcttctggcttgtagagtttctgccgagagatccgctgttagtctgatgggcttccctttgtgggtaacctgacctttctctctggctgcccttaacattttttccttcatttcaactttggtaaatctgacaattatgtgtcttggagttgctcttctggaggagtatctttgtggcattctctgtatttcctgaatctgaatgttggcctgccttgctagattggggaagttctcctggataatatcctgcagagtgttttcccacttggttccattctccccgtcactttcaggtacaccagtcagatgtagatttggtcttttcacatagtcccatatttcttggagactttgttcatttctttttattcttttttctctaaacttcccttctcgcttcatttcattcatttagtcttgcatcactgataccctttcttccagttgatcgcattggcttctgaggcttctgcattcttcacatagttctcgagccttggctttcatctccatcagctcctttaaggacttctctgcattggttattctagttatccattcgtctaattttttttcacagtttttaacttctttgccgttggtttgaatttcctcctgtagctcggagtagtttgatcgtctggagccttcttctctcaactcgtcaaagtcgttctccatccagctttgttcctttgctggtgaggagctgcattcctcatatataaatgcagaaatcacctgtcttctgcgtcgctcacgctgggagctgtggaccagagctgttcctattcggccatcttggctccacccgagaatgaatcttatctgcacagggagtgctttccgattgagcagctccattcctacccttctgctggccagccacacgtttagatgggaaagacctcatatttagctccaagggtggacgcttggcctacatacctgaccacagaggtcaatgggcctcagggaacacagacagccagggccagaagagggatggaaatgtctgtcaacttctcatttaaagaatttgaaggtgatctctgttgtggccctgcacagaaccaacctgcttggtgctgacttctgcagtgagaagtcagctcactgcagaagttagtaccaagtatccacctgttccacaaagccagattctaggacagctggtgacagacaactcagcgaggggagaccaggggcccagggcaggtcactgcaaggggaattcccacacaccagaacccacttcccaccatacatatgcagatgcacacacccatagctgcacatgtatgtgtgcactcatacatgcacacacacacacacatgcatacccagtcacactggaagatgcacacatgaacatacatgcctgcctgcacacacctacatgcacatacaccccatacacacacctgcacatgcacacctgcgcatatacacacatgcacacctgcacacacctacatgcacatgcaccccatacactcaacctgcacatgtgcctctgcacatatacagacatgcacacctgcacacatatgcacatgcaccccatacactcatacctgcacatatacacatatgcacacttgcacatagacacaaatgcatacctgaacacacctatatgcacacacacaccacatacactcatacctgcacatgtgcccctgcacatatacacacatgcacacctgcacacacctacatgcacacacaccccacacactcactcctgcacatgcgcacctgcacatatacacacatgcacacctgcacttcctgcacctgcatgcacacacaccccatacactcctgcacatgcacacctgcacatatacacacatgcacacctgcacacacctacctgcacatgcaccccatacactcacacctgcacttgtgcccctgcacgtatacacacacgtgcacctgcacacacctacatgcacgcacacaccccatacaatcacaccggcacatgcgcacccgcacatatacacacatgcacacccacacacacacctatatccacacacatcctgtacactcattcctgcacatacacacacatgcacacctgcacacacctacatgcacactcgtaccctcaaatgcagatgcacacttgcacaaatacatgcacacttgcacacactcatacatacacttgcacatgcacacgtcgatacatgcacacctgcataaacctacatgcatacgtgcacacttatacactgatatacatgcagatacacatgcacacctgcacacactcaagcatgcatgcacgcacaccccatacactcacacacatccacatgcatatacatgcacacctgcaaacacccacgcccacatatgcacacacacacacacacacacacggtctgagtgtctgttttcccatttactagtaggagggtgtctgcagagggcatctctgtctcctgcaggaatccgttttcaccttagctggatcagggttatcccgtgactccctctcttaacctgggaagctttctgaatccaacctttggggccaagtggaaacttctttgggcttcctcgtctctgtaccagctggagacccaggcaagaggggttcttctcgggcctggggttaagaggtcttctgtctggccagatctatgtcccttctcattaatcattctctgggctcctatgacctaagaattacttgcccccagccttcgtctagggcctttggaagtttcttccttgggttggaaccccaaggtgagacgtgctcccagggtgtgtcataggccaagtggtggctgctgtgagactgtgacacagcttagagatgcaagccaagaggtcctgtgtgggagtgcatgagaccctggaggctgaggatggtcttggctgtagggagagaaaggggaggggctgcaagccaaggccctgccctctttgtgctgtctgattctggtgcgggagttgtgggagtgcaaggatcctacatttttcctggaggtccaggttgtcttggaagtatatttgtttagggtgggaggatagaacacgttttagtcaacagtgtgatagtttgatttatagctgttaaatattagtctcttggcacataagtctctgtttgttcttccccactattctcaaatatttgtggtgggactgagcggcctgcagggaaaatcactcatccatcccagggcaggactgcagcttctgcctgcattgacagtagggctcagtgcttctcaaattatgggtgtttcctgagtctctaaaccttggagtctttgtgcacttctacaacctcctcgcttggcttctccctcttatcagctgctaagtctttccacacagcctgtcaaagggagaaagacatgtttctaactgcccgcattctgttctgctgcatttctcatggtttatctgatctctgaactgggccccatcccagggagccagagaagctggcttctgcactggaggagaaccactgccttcaaaacagccccaacccttcatgtcttgttccaggaaactttccccaaggggagaccacaagttaaatcatctccacctggttctttcactatcttgtttcaagaacaaacaagtcaagttgcaacgcccactgaaaagagtggagcaggatgcagtttgtaatgcctacctgcctggggagccatggtccaagcacctccatagactttctacaaccttcagacaaagctttcaggacttgaccgcagggagtccatcaactccctgcttagcctcaaatgtcttccttgcactccttggtctagaaacagcagtgagtttggaatgctccatctggcctgtgaacccccaaaatctgagacaggtctcagttaatttagaaagtttattttgtcaaagttggggttgtgtgcctgtgaaaccgcctcaggagatcctgaggacatgtgcccaaggtcttcagaacacagtttggttttacacaatctagggagacaggagacatcaatcaacatgtgcaagatgaacatcggtccggtctggaaaggcagaacaacttgaagcaaaggcgagaagacaaagcagggaggggcttccaaatgataggaagggcttccaagaatgcaaatggttgcattcttttgaatttctgatgagcctctccaaaggaggcaatcagatatgtattcatctcagtgagcagaggggtgactgaatagaatgggaggcaggttgtccctaagcagttcccagccggacctttccctttagcttagtgatttgttgggggaccccaagatatattttccttttgtaggccctagatacttctgctgaattttccattctgcagatacggcacctgggttcaatgaggcttctgtcatctcctagatttgagtttttggtgtgtcaagaggatatgaaattttaggatgctgtgatagaatcagagttttgctggctttaaaatatagcaccagaaatacagtgaggccaacggatcaggacacggtgccattgaaaagggagtttgttagacccacagatcgcaggaggggcacacagagcaggggggccacatggggaagcctggggttaggaagtagatggagacaaaaggaactgtgggcgagagcctttcttgtgatttccatgggaagaaatgagaagacagggcaagcaggtttgggatttgctagtatgaataatttcagcagttctggggcacagagggtgtccctagtcgtctggtacctggcccagggtagataagggctggtggatagagaccagagcatgagagcctcccgaagagggcaactgggggtgtggacttttgattggttggtttgcatttgaaaggggtgctcctgggagagttgcctactatctctaagaattggctgactctgagggggcaagtccccagatatcaaggcatgagaattcagacaacaagagatacggcgaatccactgctccaacatgccttccctcagccgtggcttggcagtggctctcagcaggtaaactgtactccctgacccgccgacacagggcctgacagtgtgccttgtgtccaccagcaggaagcagtggctgcgtgcctgttccagaaagggcagcatgtgtctcagcccacagccttcagccctcagctcccatggggagagcgtgtcataggcagcccctgttcactgagcatttgtccccgacagggccacacacagagcagccctgagcccagtccagagccggctgcagaggccacagagccaactgtgaatggcgacatgaatgtttgtgacttccagaatctgagatttggggacgtttgttcttgcagcaaaaggcgatcagtacagacacctgggattttggatgtgcgggaatctctaagagctgcaggggcttcatatctatactgcaggcttcaccttttcccgccaccttgaaaactgctcttggtcctatgggacttccagactgcaggaggagatcttcgaggccgtctttgtctttgacctcacacaactcaccgaagcaagtttaccttgcctgtttttacctcctaaatgtttctcgaatctttgtcctcctctctgttcttagtatcttaggtctggcttccattgtttctcccaggatcaatacaagaggctcccacatgggctccccacctccagaattgcctttggacctcacatctgtactccacccagctattaaagggatccctctaggattagtgtcctcgggctgctgtaacaaagtatgagaaactgggtggctcaaaaccacaaaattgtactgcctcacattgttctggaggtcacaagtctgaaatctggtgttggccgggccatgctccatctcacaatgctgagagaggatcccatcttgcctcttccagcttctgttaatggctggcaatccctgccttccctggcttgtagaggcatcatgtccagtcacacggccctgtatgtcttcacgtcgtcctctctctgtatgcccctctctctgggtccaatttctcctttatataaggacaccggtcctattggattagggcctcccaaatgactccattacaggttgattatctatgcaaagaccctattgccaaataaagtcacactctgagtggctggagttaggacttgaatgtctcttttcctggggacacaattcatgccatagcataatgtatctgaatttcatgtctgactgtgtcacctcttcaaggacccaaagttttctgaggctcctcatctcccaggctgtgcccccaccaaaggtcaggagctgtctgctggagctttgacagcaacaggcaaacatggtctaccttcctggagcattgtttttcctctcaggattcaaaaatgattaccttgcaatgcaatggaatggaatagaatggaagggacacatgcctttgcctgataagatgcggctttgaaggtattttgaacatccagcaggtagcccctttggcaccagtggggcttttgttctcatttgcccacgcaggtgaagcatgttgcagagcatttgaacagctctcacctacaggaaaaggcccaacattgttaaattgtgcaaggtcatgctgcacagattatttaatcttagctcaactcagccatcagctctcttgctaacactttccaatgaggcaccatcaaactgttcttgctcatgcctcagctcctggactgtttgctgatccctacttttcccttgtccaacaggcctgactcccagtcagttaaagaacgccttctctgatcctctaggtctttcccactttgtgacagttacattccccgtgcttgcgaaagacattgataacgtctttatctttgtatgttctgtatcatattacaatttgtaattacctttggaatgtgacagctcacattagcaggtgaattctttaaggaaagcaatttttaaaaatattttaaatccttcacgtccttgacattcggtggagttcacttcctgggatatactagacacttaacacatgtttgtggaaagctggtgatgttttacttcctgacactacaatttaaaaaatctctatctcacttttcaaaaccttgaaaataatgcaaaaaactttgaggcaaaaatacattgttttgtactaatattcagaagacttatgcaactattacgacataattgatttgttggaattttttcattttcaattacaatagcatccattttttataatagaaaaattatgaatacatatacaaggaaaataaaaatcacagagaaaaataagcccagatggatttaggatttgtttgtgaaggcagaaatttaagttaatttgagtaaagtagtgtgcgatcatgattacctcaagtaggaaagaatttatttatttatttatttttttggtgagatggaatttctctcttgttgcccaggctggagtgcaatggtgcaatcttgggtcaccgcaacctctgcctcccagaatcaagcgattctcctgcctcagcctcccaagtagctgggattacaggcatgagccaccacgcccggctaattttatatttttagtggagatggggttttactgtattggtcagacgggccttgaattcctgacctcaggtgatccacctgcctcggcctcccagagtgttgggattacagaagtgagccactgcgcctgtctgaggaaagaatttttctgaagtcatgaaaactacgaactgatgggaaaaagtctgatatgttctactccgttaaaatcaagaacttcctttttatgctaaagacactataatggaagtgaaagccagttcaaaactggaggaagatattcttacaaatatattttacaaaatgtaagtacgtctgaatgcagaaatgacagaaagccagttcactgcaaccctccccactggaagcatatcttctgcccaatggtgaatttgctaaaagtggactaatcaaatgaccggtgtgctggacgtaagaattttcaaagtcctcagcttctctgtgtcttcaccatatcagttttgtttctgtgatttgtcacaaatatctgtttcatatttcacatccaggtgcatcaaaaatgctcagtgttggccaggcgcagtggctcacgcctataatcccagcactttgggaggccgaggtgggcagatcacttgagttgaggggttcgagaccagcctggccaacatagtgaaatcccatctctactaaaaacacaaaaattagctgagtgcagtggtgcacacctgtaatcccagctccttgggaggctgaaacaggagaattgcttgaacctggaaggcggaggttgcagtgagctgagatcatgccactgcactccagcctgggtgacagagtgagtctccatttccaaaatataaataaatataaatgcccagttttatagatagaggtgtgtgaggttgtcctgagatgaagtttgcgatctgcattttggcaggttcatgcctgcctgggtcccgtgctattcccacctctgatcttgctgtggtgcctgcctctacccctcccattccaccttcatcccagggactgccctactcccctccttccccatctccagcaccccttccccctccctcattcagccctgtttcaccctggtccttctttgctctggaggttaaaagaatctggtgacttgtcttaggcacaatttaaagttgcgggacaataggtcattgggaaaaatgtattcagagagttgtttttttggaaaattaaataatggaaaatcagtcattcagggatttgacttggagccccagggaagagacctggagcccagattacccaggctacccttactggccactagaaggcggccttgagaaagcgaagatttggaccctgcagaaaccagctcttcttccaccaaactttctgtaaagagcgggtgcctgaagcccgtgggttttgcattaaaaaatgaaatgcaaggccagacgcggtggctcatgcctgtaatcccagcattttgggaggctgaggtgggcggatcacagggtcaggagatgaagaccatcctggccaatatggtgaaacccggtctgtactaaaaatacaaaagttagctgggtgtggtggtgcgcacctgtagtcccagctacttgggaggctgaggcagaagaatcgcttgaacctaggaggcagagattacagtgagccgagatcatgccactgcaccctagcctggtgatagagcaagactctgtctcaaaaaaaaaaaaaattgcagatgctcacccaaaattgtagggtgaagtaatgtggaatctgagacgtaggactacttcatttaaaaatgtcgtgtaaaaaagagtggcgaaggaggtggttttctcttaacagtgccctgtgaaggttccctggtgggggcggtgggtggatgaggggcccctatagctacagatggacagatggacagcacggcaatctcctgcgtcatgtccatcttcagagtcttttctcatttagttggtaacagggctgttcactggcaagaaggaaaaggaaagggttttaagagattcacagaaaaacacaggaatgatttaattttgttgaacagatttagaattcaaatttgttaagagcttaactttaaaagttgccgttcaagaggacagcaggaaaagttaaggatgctccatgcagaggtatagttttagtaatctgagaggtcagccctcaggacctgggatgtcagtggttctgttgcttggttgcccagggggaattcgtaattcaggatttatgactctgtagcttaaaggacttttatggtcctctgtgattgttttctttgttctggcaaatacccaatcatgatgatgcctatagaaaaagaaaagaataatcagtgtcaaaaagatcagactaaaattcaagcttttcttttttccttcatacttttttctttcttttcctggctcccttctttcttccctctttctttctccttccttctttttctttctgtttttccttccatctctttctttgctttcttttctcttttcttctctttccttttattttctctcctcttttttccttgtcaaatgacttgattactttttccttacatgctggaacattttaactaattgcatctagttttcaatattatatttctccaaatttcttcattcaaattaagacttttcaggttctgttttttcgtttgtttgtttggttggttggtttttttttttttttagacggaatctcactctgttacccaggctggagtacaatgacgggatcccgactcaccacaacctctttctcctgggttgaagcaattatcctacctcagcttcctgagtagctggcatacaggtgcccaccaccatgcccagctaatttttgtatttgtagtagagtcaaggtttcactatgttggccaggctggtctcaaactccggacctcaagtgattctccctcctcggtctcccaaagtgctggggtcacaggcgtgagccaccgcgcccggcccaggttctcttttgaattcgttcccactggcctttgtgtttttagtaaatttggccctctctgtctttgtgatgtcatcagcctttgcggacctgcaatgtcccactcctctgccagtgtggagcccaaatacacatcatgtcctctttctctttgcaagcctggagggcatccttagactaggctaacttgagctcagctcttgtctggacattgctgactgtgtggagtctattattctgaggtggacagggaggagcagggagggaggggctgagagctgaggtttctgtcggggtgggtggtctaaacacctgctgcttgcattcaaggatctgttagtttctgctagggtcactgtgaaagcggctggacttagatcatttagttgacatgttgtcctgtaactacccaatgggttcaccctgcctgctgcctagacagagccaacttatcaagacaggggaattgcaatggagaagaagtaattcatgcaaagactggagttttgttgttactgaaatcagtctccctggcgtttgggatcagagattttaaggataatttagcaggtatggactcagaaagtggggagtgctgactggtcaggttgaagatgaaatgacagggggtcaaagtgagtttttgctgacttctgttcctgggtgggatcacagaactggttgagccagattttcagtctgggtggtgtcatctgctgcaccggaatataggatctgcaaaatacttcaagcactgatcttaggttttactatagtgacgttattcccaggagcaattgggagaggtccagactcttgtagccagaggctgcatggtccctaaatcatgatatctaactgtgtagctaatttgttcctacaaaggcagactggtcgccaggcaagaaggagtttttctgatatctaattttgtagctaatttgttagtcctacgaaggcagactggtccccaggcaaaaaggggtttttttgggggaaagggctagtatccattttgtttcagagtttaaactataaactaaattccttcccaaggctagctcggtttagatggggtgggggaatgaacaaagacagtttagacgttagaaggaagatgggggtccgggggtctgttaggtctgatctttcactgatataatttcctcagttataattttgcaaaggcggtttcggtcctgcctctcattacagggccacttgttgagtaaaagggtctcaaaagataaagatattggctttgatgggggtgatggaggagagaggatgagcctgacgtcatgtcccatgccagtgagtggggcgtcaggaaaaagaaggagattctttaacaatggaaagctgctaaaaatctatggaattggactgagagaccattagcagtttttggaagaagaaaccacttcaggtttgctccctgggaaagaaaaatatcttgggcccccaaaactcactaagctaaaaggaaaactcaagctggaaaccgcttagggccaacctgcctctcattctattcaacctacctcccattctattcaacctacctcccattctattcaacctacctcccattctattcaacctgcctcccattctattcaacctgcctcccattctattcaacctgcctcccattctagtcaaagttatctccctgctcattgagatgaatgcatatctgattgcctcttttggaaaagctaatcagaaactcgaaataaggcaagtttgtatttcacctatctgtgacctggaagcccctccctgcttcaagtcttcctggctttccttcaaattgtcctatctttccagaccgaaccaatgtacttttcacatatattgattgatgtcttatgtctgcctaaaatgtgtaaaaccaaactgtgctccaaccaccttgggcacatgacgtcaggacttcctgaggctgtgtcacgggtgcgcatcctccaccttgacaaactttctaaattaactgaaacctgtctcagattttgggggttcccatacctaacgagtcacatcagtcaaatcagttataacactttgccgagtaagttcccataaacgttttattaccatgtttgccataattttaagggagaaaaacaagggcccgagagttttaagtccttgtccaggtagacacgcaggtgggtggtggcagaggaactggacccaaggccttcgccttcacctctctggatggtttctagtctgttcagcttcaactgtgacatcctttctgctccaaagcctttcaagtgtccagttgtacctgacttctgtcttcttgtacatatattctgattcagccctgagccatactctaggccacagttggaggctcttcaatccacagaaagagcaaaaccaccttatgagagatggaggcagatggaggcagccaaggaaaccatgtgtggatgggccagtcaggctccttcacgctggccggctggacgaggtgactcaggtgtcccatccatgacacctccaagagcaagatggagaatgaggaaggagactgagatgagctgagttctgattgtatgtcaggggctggctgggctggatgagtgccacataaaggttatctcactgagtcctcacacctgtccgggggggtccatttattctactcactttcatacacccaagaatgcaagaatcagagaagttgtgcagcttgtccaaaggcccaggtctgtctgacttgagagtcagcctgtggtttcctgccccacgtggggttcacggtgacctgctttggtgctgggtcatagtcgctggatgagagattctctagtagctggaggaaggggatctaaggggggctgggctcacagaacatggggaggtgaggaaaaacacactagaagctctggctcaggtggaggcaggaacgctctggggtgaaatgtgttgtcaaccatgggatgacggctgccccgggacaggacatgtctaatcacactctgccctggtttctgcaagagtcactgggctggttacgaagctattgtttctcagccccaagttccctactcagtacctgctttgcggtggggcggatctgggaaggtcctgctcagctctgcccacagggcagggagcgggtagggaggctggtggggagtgggggaggctggtggggagtgggggaggctagaagggacgtggggaagctggtggggaaaagggaggcttacggagagtggggagcctggcagggagtaggggaagctggtggaagaggggaggctggcggggagtggaaaagctggcggggagtagggaggctgatagggagtggggaggctggcgtggaggtggggatgctggcagggagtggagaggctggaggggatgggggagtctggcagagagtgggggaggctggcagggagtgggagaggctggagggagttggggaagctggtggggagttggggaggctggtggggattgggggagctggtgcagaggtggggaagctggaggggagggtggggaggctggcggggagggaggctggctgggaggtggggaggctggtggggacggaggaggctggcagggagtggaaaggctggcggggacgtgggaggctggcggggacgtgggagcctggcggggacaagggaggctggcggggaggggctcctcctgtggctgcttcctgaggcctccaaagtctctgagcaggccccctgacctacgtgtaccccgacctggcagcagcagtttcttcttgtggcagcagctggatttgattttgcgtgtttcccacttagaatcagcctcataataccctgttgggactcagtaagggcctgtgaggtgaggcaggcgtgttagctgggtctgcatctcttgttcttcctgccactagcagactgcctctaggcaagtagcagacccagaagcatgatttacccccagggggtggtctgttattcactccttgttaggtcgctatcagtctgcatggaaagtctgctgtgaataggactctgctagacccaggggtacaaagtgctctgagacgcagggctgctctgggctgcgctggggtccaggtgtgagaggtggtagaaggtgcagggtgcgtgtgcaagcagagaatgctcaggaggtttcggtggtttaaggggagaatgtgtcaacttaacataatagaaagggtcagaaactagtttacagagggtttattcaagtgcagaggttgaaaacgggacatctctgggaagcacagattccaaagaatggaagtcagtgttaccaagtgtagagatttgggattgctttatataaacaaagcttaggggaatttcacagaatttcaacatctgtgtaaggcttaatgcatagttccaatgatctgattacttgaggggggcctcttttggaaaggtatatctaacattccacactgccatctaggctgagttatggtcgggactcttaaagaggtggtaaatctgtaacaaaggtctgtgattagaaggcggagatctggtctccggtgtttcctagccattacagaaaaagaagaatgaggaagagttaagctgtaatccaagcaacagaattgcaaaacatgttccatgacccagatcatagccacacctctctcaaggcttgaggagtcctggaagttccaacagcttttaaatgtaatttattttcacaaatgcaaatacatatttaaatatcctggctaggaaatgtccaggaatgcctggagcatatattttagaatactctgtaagactaattaacaggggagaactgcccagaacgggtttggaggcacaggttggcggacagagagccgtgcccagagcggaaggaaagtgagagctggagtgctgcctgggaaaggcccagaggggaggagctcttagcgaaggaggtgaaatgggatgtgaggtttgtgggattcgagacaccaggagaaagttaagctttgcccagtagggctccatagggagccacagtgattactgtggtgactgcagccttaaacaaatggtaggcgactttgttaaaggtgtgagttgagcttatctaggcaggtatattagccagtatgtgaaagccaggtatttatagtcgaatgtatttatagttgcaatgtgtatttctaaactaagtctactgtgcccagcaaagtgacatcagagactttagacagaatgccccacaggcttggggtggggatggagccccgctggcaacaagcgtggatgcttactgtgtgctgagagtaagtggggttctgtctggggggctgcagagacagcagaaaaaactatctttagagtcccttacaggagacctgtttttgtgacttgtctgaagaagaccagtcaggtcagacttgactaagcccaggagcaatcatttcggcagttcccgcgtgtttatcagtgaacctggtttttagaaaacagcaaaacaaaactgaaacaaaaacaaaatcagaaacccaattaagcaagactctttacttacctccgtaggtgtctggtctctacaggtagaatgagtccagggagctgggagggggcagtgatgacacctctctgcatgtctggtctgatgtcagttacaataatcaaacacgggccgggcacagtgactcacgcctgtaatcccagcactttgggagtccgaggagggtggatcacaaggtcaagagatcgagaccatcctggccaacatggtgaaaccctgtctctactaaaaatataaaaattagctgggcgtgatgacagacgcatgtgatttcagctgcttgggaggctgaggcaggagaattgcttgaacctgggagaaggaggttgcagtgagccgagatcatgccactgcactccagcctggtgacagagcaagactccatctcaaaaaacaaaaacagaaaaaaacaaaaataataataatcaaacacacagcaggacccctggccagctggggagggggccagtgtgggtgcgtcttcctggggccagcctaggagaaagtgcttttcctgggtgtgtgcccaggtcacctggctgtgggacatgcttcaaggaatgggtctgccaggtcacagtgttcctggaccaaactgtgggtcaggctgctatttcttgtggcccaataatgagaggccaatgaactggggaggaagagagtttttatttctgtaaccagttacaggaagaaggcctggaaatgataaccagaccaactcaaaattacacagttttccagagcttatataccttctaaactgtaggtctacatgtaagtgtgcactcatcgaaagacataagtgattaacttcttttaatctataactaaggtctccatcctgaagactttcttctggatcctcagtaaatttacttaatctaaatgggtctaggtggtggggtgattacccttatcttgtctcctgatgaatcataaaggtttggggagttctgtagaccccaacaaacttgtctatggaggcctggggggtttattcagacccccagtaaaacttgtttaaacttgaaggtcctgttaagaatcccttcattatcttgtcatgctccaaggcccacgaaaagcctagagaaaacttttggtgggctcgttgttacattccagcctttgtataagggcactggctcaattagctttaatgtttaatgtagctgctcagtcagtgctgggacagttgtaagggaggcctacattagtgagacctggcccaccacaacagggcagcaagggaggcaggggagaaccaagtaaggtgaggctgagatggggggtcagtccccagccccatggtggacctctggtcctcctgcacctgggtgagctccagcgagagccaggtggctttcctctagagaagagcctgtaacccctcctgctatgggagtctcctcctcctcttccaggtcttgtggatgatgaccagcggggtgatccccagtgggcaccagtgtatttgcctgtcaacaagggaacaagcgaatcaagtccctgtgtggttcacggagggggaagatcaggtttcacttgtaaagaatggcgggtgcttgcacttggagactatgccagtgaatgtggagggctgcaccctgactaggcagcaacagggtctttagtctgcacacatttggttaaaacattctacgctgttcatttttcagaaaggagtcttcctttaggtgaatgaggcactgtcggagtcactctgagttctgagtcaccgttcagtctgggctggttggaagaaattgggttgaatctcagcattcaggtttgacatgttctgggcaaggactgctctaaatggaaacttttccctttctgttccttaaggatgtgaagaacccagcagcctttcctgaggctgtgtcttctgtgcacagcatctactaaggccattcaaaaacacccctccatggatcttaaagcaccccctttttcccttaggagggggagttctgcagctccttaagctaaagccagatggatgcaactaagagagaagagagaactccatgctgcccccttggtgaataggctgggcccagcatggtgcagtccttaaagaggaccacggtggatgagatgaagccaccagggcactgtgtgtacagaaacagcaggaatcaaaatgccatatacccgatgagtgcaatgatgaaacaaaaaatttatgtgccgactcagattggagaagtatactgggaaaaacaggccaatagtagatttgattggaagagtagtattttgagcaatttttgttatagcactgttttgtattttgactgattgtgacaagcgtgtatttttctgctgatatttgtgggttctcaggctttcgtggcataaaacaaccttgatcaaaaatgtgaatggtataagaagttagtgaatcagctttcatgcctgtccagaacagaacaaaggggcacccacatgacagctcactaaatttcttttaaaaacctgttgtcttccaagatttgggactaataataaaaaagcctcaagtggcttttgttcataaattaccatcagtccgtgatctaacagaagagataaaggcaggggaataactatttctcccaaggctttttattattgtgattttaaaaaactattatttttcaatattttggatagttcatgtattttcagaagaaagcagccatgaacaagtgtatgtatattgggagttaactggaaatatccattttcatggaagttctccttctaaacaatggacagaatcaggtctatcccctaaaccagaggttggaaaacaatgacctttggccaaatctggcttgctgcctgttcttttgaacacagttttatggaagcacagccactcccatttacttatgtgtcagacaaggattctttcactctgcagtgacagagttgagtacttgcaacagatgggatatgactcacagaattgaaaatatttattatctggccccttggaaatatttgacgacccatgtgctgagccactgacatagccatctaatcccatgtggcaaccactggcggtacatctgtggtttaaactcctcctggccactactaaaagtgtaatcagggtccattgatacaggaagactttttttttttttttttttttggacagagtcttgctctgttgcccaggctggagtgcactggcacaatcatagctcactgcaacctctgccacccgggctcaaacaattctcctgcctcagcctcccaagtagctgggattacaggcgcccgccaccaggcctgacttttttttttttttttttttttttccagtaaagatgaggtttcaccatgttggccaggctggtctcgaactcctgacctcaggtgatccaccgtccttggcctcccaaagtgctgggattacaggtgtgagccactacacccggccaggaagactgttcaatataggggccacacaagaccacatgctggctgttttgtctcctttctctctttttcaacagtcatgctccttttttttcatcatggcattggtttcttggagaaacaaggttatttttcctgtagaatgtctcacactctggatttgacccactgcttcctgtgctgttgtttcgcttgtttccgaaagtcctgtattttccgtaaactagtagttagatctagaaactcaattagtttcaggttccatttctttgggcaagaatagttcatgggtggtgctgtgtaattcttattacatcacaacaggaaatccattaatgtctggttgtctcagttttagggagggtaagactgatgatcgagtgcacccttaaccctcagttatcaaattccctgccaagcttttcaccaaatggttctaaaacagtccattgatgattgctttagacctataatttcattcagggttgcaatatggtgattttattattctatcatccctttttcatttattagttggggaaattctataaagaaggcatttccttaactattgttcaccctaaaaggcagtttgtactgaaaatgcagaataaatttctgaagtgataagttggtgctgtaacaagctctaattataaatgaaactatttaattgtcatcatgaactcatggatgtttatgtatttgtgtgcgtcaatcaattgttatcattagttactgcagttaggaaaaatgtctcatctgtggccattgggctcccctttgatttggagctggtgttcttttggtgcgacccttcagtctttgagatgtcttatttctagcacagcaaaataactcaggcttgtcttgtacatcttatgttccagacttggaggctgccatttctccaagtagtcctggagattctcaaatgctaaagttaaccaacacagtgccctaagaccagaaaggagaaaaaatggaagttctgggtcctgccaaaggactatttcactgagcagactgctgagacctctgaattatgtggacacttgagaatcagtcatgtgttggggccggcgtcgtggctcatgcctgtaatcccagcactttggcattttgggaggccaaggcgggtggatcacctgtggtcaggagttcgagaccagcctggtcaacatggtgaaaccctgtctttactaaaaacaaaaacaaaccccaaaaattagccaggtatggtggccggcacctgtaatccgagctagtcgggaggctgaggcaggagaactgcttgggcttgggaggcagaggttgcagtgagccgagattgtgccactgcacttcagcctgggcgacaagagtgaaacaccagctcaaaaaaaaaaaaaaaaaaaaaaaaccaaaaaaaaaaaaaccaaaatcagtcacctgttggtttgtggatcaaacaaagtggaggtgacatcactgaagcctaggacatcactccccttttccaggcaggctttgtggttcgacctgtctcacgttccaacccatgcaccctaaccccctacttctttacctcttccaattgagacacaagattcattttggcccaaaggaggtatacttcaaaagcaattttcctttattaaaagaatgcttataaaaagttcatttcacttctgcgtcatttcttctggtcactcccagctcacttgcagcacttggccttccctctgtaacaggtgccttgaattttggtaaagatcgggcaggcagaatagagacattgccctccactgctgacgcaattgtaatgatcagatctgtggccaaggcctgtgagaaagttaccacctgtaaggagggaacacaaacacttcagactcatggcttgtagctgcaacgatttgagaacatctcgcgaaagcagaacaaataactgcaaaacaccggagagtcttctcttccaagaaattggcccatgattgatctttggggctactcatgaaatgaggtgtctgaacagcttactcagtctggggctatgccagctgtggccaaatacaagccaaggaatgagcagtggggttctgagtggggttttcttctgctgagagattttaaatgtgcagggaattcaagttatttttccaaacaagttttctgccttgtctcaacacaccccaaaatcacatcctgtgttttagaaatgtggaagcagctgccactcttcaaacacagcctacacttccctccttccatgccttcagttacgctgttccctctgccttgaatcccggccccctcacttcccacatcactatttcagctgaaatctaggatcgtttcacatcgggctgaaattatggttactctctaaaactttcatagtttttttttctacttggactttattttgcccttctcccagtatcccagatctgataaatagagacagtactctggaatagccttctattccatgcaacagggaacagtcgcctgtgatattcctggcgagggaccagcaggccgccatgttgcaagtctccactggtaggcgttttggactgaactgaatcccctaggaaaagaattcctgtgtcgaagccctaacagtgcctcagaaggtgattgtatttggagagagaaactttaaagaggtgattcaagttaaacacggtcattggggtgtgctctgatccataagacttgcatccttataagaagagattgggacagacacacacagaggaaagaccatgtgaggacccagggaggcggcggtcatctaccagccaaggacagacacctgagaagaagccaaccctgcttccaccttgatcgcagacttcctgcctccaggactgcgaggaaataaatttctgttgtttaaactgcctggtctgtttatgggcagtttaaacgataaatctggtagcctgagcggactaatacaagaggccatcgctaccctaggagacagtacattctcatgttgcagatctctgttggaaagatggctttcacaccgatggaaattgtctcatcagtaacttccatccaaaggctatttttccactttttgcagtaattccacttttgaaaaactcttctcattgtcctcaatgcctggtttctggtcccttcccaaacctcttcattctcctgtggatgtgtttaagttggccagtacacttcccaaagtttgaagcctggtatcaatacagagtcccttcaatgtgttccgccaaccaaggtaaatagaggcttcatttctctcattttgttctcaaagcagcaccatccaatatggcagccacatgctccctgtggctgttctcttttaggttaattgaaatcaccctagccgcattgcaagtgctcacgagcactatgtggctagtgggtgctgcattcattgaacagcagatatagaatctttttaccactgcagaacgttttattcaacttcatttcaatagaaggtactctgtattgataccaggcttcaaacgttgggaagtctattggccaacttaaacacatccacaggagaatgaagaggtttgggaagggcccggaaaccaggcattgaggagaatgagaaaagaagagtttttttgtgttgctgtggagatggaagggaattgagaggcactctggttctcccatcccagtactcagggaagcatcttgggccaaggccactcatttgttcatacaaaacacagtctcttgattgccagcttatattctttttctctgactgattcctaatgaggctgtctgagattgtactatgttttaataatctcgccataatgttgacctcaagtaagatcatgaccagctagactctgccaaagtctccactttctgctttagtctccctgcactggaggctcccagtgctggaaagatacttagaggatgcctactccaacccacactgcgaaagatggaacctctccaagtgattatctgttattagagagatcaactgagcatataaatttgaaagcactttgaaatcgagaaggtttatacatctttgttcttgattgttcttctcagtaatcaaatggttgggtgtatatatgctgattaagcagaggaggcccaaatttaatatggatgtagctttttagagccaggatggacttcggaactcaattaattcaacctttctgtgatcctctccccagatgaaggaacaaggtccagtgatgtccccagagcatgtagctggtcaaagaccaaccccggaccagaatggatgcctcctgatctcacttcagttctcattccacttcaccacactgctggttgactgtggtgtcacggtgcataaccagaactaatttctggcattaccttccaggatctagtacattatgggacacaaaaggaattgcagcaaagttagtgagagggtactttgattacattctgtgttccacatctaatctactgtgtgatcttttgcaaaccactcaacctctctaggcagcagcttctcaaatttaaaacggaggagactacgcagccataaaaaagaatgaaggtgtgtcctttgcagcaacacagatgcagctggaggccaatatcctaaacaaattaacacaggaaaagaaagccaagtaccacatgttctcagttataagtgggggctaaacactgagacactgggggctactagaggggaaaggaggcagaggagtgtggaaaactaactgtggggtactatgctcattacctgggtgacaagatcacattccattcctcagcatctgagtgggtctgggttggggctgataatttgcattttaaaacaagctcctaggtgacactgaagcttctggtccagaggccatacttttacaacctttggtctggaatattgaggttccttcctgttggagcagtctatgctgctttcagtctaggggccttttaaaagcacttgcctttaacattttcatgacatttgccttcaccttgtgttagatattgctgtgcctgtgtctgtttctcttacgtgcttcttaaggatgttagtgtaatctaaatgcttctgaaggtttttgttttccaataattgtggaccaggcagcccaaaaagaacagctagaatatctgacatacacacacacacacacacacacacacacgcacacacacgcacatgtgcactttgtaggtattagagaaccaacagtaaagaattactaggtcaagatttgagagaaagaccgaaacaaaagcaggaacatcacattctactaacataaaaaaagttattatgaaggcctgaaacattttgaaatgaagaagacctaaatgagtggaaatgctctgttaaagcatttgaagattacttttttaaaaaaaattaatcttctggttcaaccaaataccatgggaatccccagaggttctaatttgacaaagtgattctaaattttatttggaaattcaaagggccgagaatagccaagacacatttggaaaaaaggtgagaggtcttgctttactgtatttcaagactaagtgtagagcgtctgtaattaaggcaatgtgcttatggcacaaggacagaaaaatgtccaaatggaataagatagagtgtagaaagaggctcatgcatacatggagaattgatgtagaatagtagtggctcagcagaacagtggggaaaaatagtcttatcaacagttggttctgggctgggcatggtggctcatggctgtaatcccagcactttgtgaggcagaggcaggcagataacttgaggtcaggtatttgagaccagcctggccaacatggtgaaacctgctctctactaaaaatacaaaaattagccaggtgtggtgacaggcgcctgtaatcccagccactcgggaggctgaggcaggagaatcccttgaacctgggagggaggggttgcggttagccaagattgtgccactgcactacagcctgggtgacagagcgagactcagtctcaaaaaaaaaaaaagttggttctggacaatcagatattcatattggggaaaaaaagtaacttgaccgttacttcataccgaagccacacacacacacacacacacacacacacacacacacacacacaccccattgccagatggattgtaagtctaaatgtaaaaagaaaaaggataagcttttagaagacaatattggggactatcttcatgtctttgatgtaaagaaagtcttcttaaacaagatagaaagtgcagtaaccttacggaaaaagacatgacacattcgactacattgaaatcatgataaaagcctcttttctaggaaagtttccattaagagagtgaaaaatcaaaacacaaagcaagagaagatatttgtgatgtatataattgacaaaaggcttgcatagaaaatacataaagaactacaaaccaataagaaaagacagataatccaaaagaaaacatggacaaaagacaaacaggtattttacaaaaaataacccagttgcctgtaactatgtataaaagggcccaacttattatttatcagggaaatgcagattaaaactccagtgagctattgctacactcaccaggtggttaaaatttaaaaataattgatgttatcaaatgttggcaaggatacagagcaagaggaactcttattcactgcttgtgggagtgcaagttggtgtaaataatcttggaaaacagtttggcattgtccaatacaattgaatatatgcatagcctatgatccggtgatgcaacttttcagcatgtagaaatagaggcataagggcacctactggccaatagaaatgtgtgcacaaaccaagctgtactattcaacctgaatattaattagtgtggcaaaagtgtaaagaatatgaaaagttaccaccataaaagtcaagtgagtgattattcttgggggtaggagggagttgtgactgggaaggctcgagaatagcttctcataattcaatttagatataatagactgaaaacaaaaattctttatgttaacaaagtgcctttcaaacccttttgagtttggactgaaccaccatcagaaagaaatttctcactgctactcagtaaaaacatatgcacacaccccaaactgaaatatgggtgtaattaaatagcatctacttttactacatggcatgaagtaatattttctattcctttaaaaaaacatgggctgggcgtggtggctcatggctgtaatcccagcactttgggaggcggaggcaggcggaccatgaggtcaggagttaaagaccagcatgaccagcatggtgaaaccccgtctgtactaaaaaatacaaaaattagccaggcttggtggcatgcacctgtaatcccagctaactcaggaggctgaggcaggagaattgcttgaacccaggaggtggaggttgcagtgagctgagattgtgccattgcactccagcctgggtgacagagcaagactccatctcaaaaaaacaaaacaaaacaaaacaaaaaaacacggtaggctgagtggagtggctcatgcctataatcccagaactttgggagtctgaactaggagggttgcttgtgcccaggagtttgagaccagcctggtcaacacagtaagaccttatctctacgaaaaaataaaaataaaaaaattagccaggtgtggtggtgcatgcctgtagtcacagtttcttgggaggctgaggtgggaggatggcctgagctcaggaggcagaggctgcagtgaggcgagatcacaccactgcactttagcctgggtgacagagtgagaccctgtctcaaaaaaaaagcaaagcaaaaacaaaaaccaaaaaccaaaaaccaaaaaaaaaaacaaaaaaacaaaatccattgtagcaactggcagcatgaaaagttctgcatttagaatgcttttgtactcagctttcagatggaaaaactgaggcataattggaataaattaagcctatctgctggatacagtgatggcctagagaaacttacaataggatcttacagagactttctgaactggagtgcttgctttcaggatcatccttcccagcccctcattctgcagatgaataaaccaaggcttagcaccatgtgactcgtgtgaacaaggatagggctgggataaaacatgttcccgattcctcctgcacgtcccaccatcatgtcagggtcatggctgctttggcccagagaagctgacatacacctggctcacaggaagccccctcctattgactggggagactgctaacctggagaatgtggatgcatttctcaggagagggagaggaccgcctgcctgcacaggaggtgagtccaaggcaccggctgagctggcctgatgggtggggcggcagcacctcacctgtaccagggcaccccaggaggctgcacccagtgacgtgggctgaggatggggccggcccctctctctgcataggaagctggcctctcagtgtgaggagtcgtcttgcaggggaagcagcaatctcatccacataggatactgtctacatgtccaggacaaggatgcaggcagctgcctgtgacaagcgccatgaccctgccaggctcactccttggcggctcacagaccctgaaggcttggcagggcttgcctgctgccttctgccaactgcaggccactcaaccacgggatgctttcctgctgcttgttcctcgtcccttgggacacggaggcagccatccgagactcacatcagccccattgtccccagccctggggatgggaaactcttgcaggtaccagagcttacctgaggccatctcagacaaaagtaagcagagagtaaacagcagaaggtaggaagttctcatggcgactggcaggcaacacccaggatttcaggaactggggagacgctggctcctttggaggctgagctgacagaggcttccagaggctggagcgtcactgtatttataagactggtggattgcacaacctcgtcgacggaactgaagggaggtgccacagtcaagggtgaacttctaatcgctaacccctggtgtcatttgccctgagcagtcagcagtcacatggcacattgtctccatctggctgccgctggatttagctttcagcctggagccctggtgccagctcctcctgtttggttttctaggttaggcagttctgatggggtttctggaacaggcagttcacactggagtccctccttctggatcacatggaggagagccacagggaagctctgagcagggggccgctcggctctaagctggtgttggcctctttagtttgattgtcttcctgcaagacaaactcaaacttcaccctcttcccttgcagaaggagagctggttgtaatgaagtttcttcctctggccaaggctaccttctcatctctccccttatgcagaacactctcctcgatggaccaacttttctcttttcccactagacgtgttcctgggacgtttccaaagggcactcctcagaaagtgagcccccagtgtggcccttggagggtgagggtctgggccagcttgggcccaccctgcagagctacaactgccagattggggtgctgttagcgactctccaagtatccctcaggttttccttgattctaaagatttaagaaacattttatttattactgattttcattgtaattctgtgagcagctttcctgatgtctcagtggcttatttgcaagcagcagacgctggctctcgctgaccaaggaagggaagagtttattcggaggatatcagggttggtggggggtggtggcattgctggagaacccagcttgaggctcagtttccaggaatgacatccaccctacactgtcacggtggtccaatgagaaccccatactgcagccacatggcatgagacacccagagtggagtgaccctcagccactctaccgctggcagaatgccattctgcacccaaacatgaacctgccgtatactcccacttcaaccctgccagagaaagacagagagagatccagaaagatggacaaacaaaaacagagacagaggaagagacagagacatgcagagagacagtagagagacacagagaaacagagagatagaaacagacagagagagatggaaatagagagagagagagagatagagagaaatagattcagagagacagaaagaaggagacagaaagatgcagtgggatcctgtagctagctcattgaggcagttcacaaagggtgtttgggagaaaacttggaagaggctgagccatgcctgacctaggagcagtgagattgtggaaagagaaaagaaagaaccgaaacacagctttccttgctggtgctgggtaagacatggctcagcctcttccaagttcctcccaaacaccgtctgtgaactgcctcaatgagctagctacagtattctatcggatctgtttctgtccctttccttctgtcttattgaagccacactatgattctttgaccaggcaatataatcctcatgttagagaagaaaaacactggggttcagagaattgaaacaaattgcccaaggtcaccctgctggtaaatggaaaactggtgtaatggcctggaaagcctcattccctagcctctgtgctgaccgcctcctggggaggcttccaggttattacaccaggtgtgggttcaataagattgtgaaagaaaaatatctcaggcaccttcaagctgggaactgcttattgcgaatctgcctctttttctattcaagtcatctttttgctcccagagatacatgcgtatttcgattaacttttttggaaagacttataataaattcaaaagaatgcaaccggtcagggcgcagtggctcacgtctgtaatcctaacactctgggaggccgaggcgggcagatcgcctgaggttaggagttcgagaccagcctggccaacatggtgaagccccgtccttactaaaaatacaaaaattagctgggtgtggtggcacacacctgtaatcccacctactcaaaaggcggaggccggagaattgcttgaaaccaggacacattggttgtagtgagccgagatcgcaccactgcacttcaacctgggtgacaaaaccgcactccgtctcaaaaatacaataaaaagaatgcaactgtctgtctctcacatacctgtgacctggaagcccccagtggtgggggccttgctttgagctgtctctgcctttctggacagaactattgtacttcttatacattgattgatgtctcatgtctccctaaaatgtataaaagcaagctgtgccttgaccacctggagcacatgttgttaggatttcctgaggctatgtcagaggtacatcctcaaccttggcaaaataaactttttaaattaaatgagacctgtctcaaattttgggggtttacaagataataaagtaaaaaatctcagaatgctgccgggcaccatgtgaggtccgatggtgtctgtagatcctgggagtgaaaggaatctaaaccctggaatcctgattttcaggactgatgttttctgctctgaacctggaaaactttttttctaaattttatttttattttttatttattttatttatttttttattatacttgaagttctagggtacatgtgcacaacgtacaggtttgttacatatttatacatgtgctgtgttggtttgctgcacccattagctcatcatttacattaggtatttctcctaatgctatctgtctcccctccccctaccccacaacaggccccggtgtgtgatgttacccaccctatgtccatgtgttctcattgttcaattcacacctatgagtgagaacatgcggtgtttggttttttgtccttgtgatagtttgctcagaatggtggtttccagcttcatccatgttgctgcaaaggacatgagctcatcctttttcatggctgcatagtagtccatggtgtatatgtgtcacatttttcttaatccagtctatcattgatggacatttgggttggttccaagtctttgcaattgtgaaagtgctgcagtaacatacgtgtgcatgtgtctttatagcagcatgatttatagtcctttgggtatatacccagtaatgggatggctgggtcaaatggcatttctagttctagatccctgaggaatcgccacaccgacttccacaatggttgaactagtttacagtcccaccaacagtgtaaaagtgttcctatttcctcacatcctctccagcacctgctgtttcctgactttttaatgatcgccattctaactggtgggagatggtatctcattgtggttttgatttgcattcctctgatggccagggatgatgagcattttttcatgtgtctcttggctgcatacatgtcttcttttgagaagaaacactttgctttttaaggttacattttcaggatttcaagcatcctgtgagggtgctagaagaaggtcattttagtcccagtgtccagggcatcaccctgttccgctcacgtccatcaacagggtgatgctggagagcagagctcactcctgggcgctcttgaggagtgaggcgtggtagccagctcggaaggcatgggagcccgggcgagatgataaggaggccaggtcctgtgccatgtgcccaggagaaaccacatacaagcagaatgcagcatctactttcacataaatattgcagtgagactggccagagtcctggcttcatcactcacaattgaccaaagtgtggcctttgtgggtgggcgctgactaaggagactgatgggggctgtggtggcagaaagtgcacaagcctttgacagcccagggatgaggctactgacccacctgtgatgaatgacagtctaatggaggaaatgacacccgggatgaggttgtagagcagatgggggccaagtagatgaaagtgtggtgggaggaccacggacatctcaggagagcagggaccaaggcctatataggagatgcatgcgtgtgtgtgtggtgcattaaggcttatgtgtggtttgcatttaggctcatatctttgtgtgcgtgtggtgcacatttaggcttttccgtgtgtgcatttaggcttgtgtgtgtgtctgcctgtatttgggattgtgtgtttgtgtgtgtgcatttagatttgtgtgtgtgcatttaggcgtgtgtgtgtgcatgtacgtgcatttaggcttgtgtgtgcgtgtatttaggcttttgtgtgtttgcattttggcttgtgtgtttgtgtgtgtgtccatttaggcttttgtgtgtgtgcatttagatttgtgtgtgtgtgcattttggcttgtgtgtgtgtacgtgcatttaggcttgcgtgtgtgtgtgtatgtgtgcattttggcttgcgtgtttgtgtgtgtatttacgctgtggtgtgtgcgtgcatttaggcttgtgtgtgtgtggagggtgcacatttaggcttctgagtgtcttattgagcagctttggttttcttcttaggcaatagggagactttggaagaggaattacatgagcctgttgccattatagaactagtctaatatggaggtgtcgaggatgcatggagagggcgtcagcttggacttgggaagacccaggaaggggctgaggagccattagggtctcacacaatatggggaagggggaagaaatgagacaggaacttgagaggaattaagaagctaaagttaaccaccctccactggcagatggaaggagctggatttctggtcctggatggaaggagctggatttctgaccctggatggaaggcgctggatttctgaccctggatggaaggcgctggatttctggccctggatggaaggagctggatttctggtcctggatggaaggagctggatttctgaccctggatggaaggcgctggatttctgaccctggatggaaggcgctggatttctgaccctggatggaaggagctggatttctggccctggatggaaggagctggatttttggccctggcttgactgagtgtggtgtcaggccctgagctgggtgaggggaggaagagccggtatgggaagatgttgagttatgtagacaagtgagtgtaaggggtgccctcattcgccatcacagtggctgatgtgtcctctgcatgctggtctctccctccagtcatcagtgaaggctgacggaggggaggggctgcgtgggatttccacagtctcccctcactggagggtccagggtctggcatagataatcagtcactgttttggaataaatgaataaacagaagagtgttgctatggacggaacacattccctgcttgcataaatatataaaaggatatttaaggaggtaattaggctaaattaggtcataggactggtggcctaatagttagacgaagagaaatcagagctctgggacatggcgagaaggcgtgacgcacaaaccaagaagcgtccctcccgggaaccgaatcagccttcatcttcatcttgagcttccagcctccagaaccatgagaaataaacttgcatttacccagcctgtggcacattgttgtggcagctggttagacttatacaagtgttgtctgtattcttggtgaactcttcatttcttctaggacaacaaaactccggggactccattcctggcagcaccccaacctcctgttaccctcacccctatgggggcttcctcttcagggaggaacttcaggtttttaagacatggatgctttgttttggcttgagactttgcaagtcccataagtggtgagcacaacttggaacactattgcttattcccttatccgcaatagtttgtttgtttttttttttttgacagagtctcactctgttaccgaagttggagtgcaccggtgcaatctcggctcactgcaagctctgcctcctgggttctgggcattcttctgcctcagcctcccgagtagccgggactacaggcaactgccactatgcctggctaattttttgtatttttaatagagatgggatttcaccatgttagccaggatggggttgatctcctgacctcgtgatctgcctgcctcggcctcccaaagtgctgggattacaggtgtgagccaccccgcctggccttttttttttttttcttttttttcaagacagactctcacacagtgtcgcctaggctggagtacagtggcgtggtctcgactcactgcaacctctgcctcccgggttcaagcaattctcatgcctcagccccccccaagaagctgggattccaggcgtgagccactgcacctggccactcgcagtagatcttgattatgatctgctaaaggcacgtccttgactgctgaccttacaggccacgccactggcagctgcccagagcaggagctgtttgtgtcaggtgcttgtcacagctctggagcatgagacctgagtgtgaagaggggagggggtctggggtgggacagaagctgtgtagggcagtacctgccctggggctccacctgcaaggtcaacaggacacagtccttacatggtggggttgagctggtttcagtcccaactcaggagctcctcagagagtcagttccacccacgtaggttggagctagctcctcaatgccactgtgaaggaaaacgaaggacacagcctcaccaagcaccaccccagccaggtgtgacgccactgtgaatgtgtctagtcctcaggaccacgagaggctgtgtttgaagggagctgggccagcccctgagtcagacaggatggattcagcttctgtgcctctgtggagaggcagggccagctgggcctggcactcacctgtcctgctgctagtagcagtggtaaactgtctaacaccagaggattacgtgggtttaacacatttatgcgcacagatgaggagtgttcaattagtgctggttcttaccatgattatttctattctttcccatattatgaggtcatcattaccccatttcctagatcatacacctagactggcagagagtaatgtacaggtaatgagtggtacatccagaactgacccaagccatcagcatagggggttgagtgtcatcctctcttttgcaggcaggacatcccagtgctaaggagagtgacctcagacaccagagacacagcaagtgcagcagagctgacggctctgggaacactggtcttcaaagtcttccccgttgttggttttgttgtctttatttacaaataaagtaaatatttcttatttatagataacattttatttataaaaataatatacgtgttgcaaaaagttaaaacaatactgatgtgtagcagcagaaaaggaaagttgtcttgaatcctatttctcatggataaacagattgctaacaattgggtttctctcagttaatgacattctcttctacacacataaaggtatctattcatgtacacttcaatacttacagattgtaaaaaggaaacactttgtaatgctgatctgcagcttgcttgttttcctttccacctagtagttgtacgtctttcaatattttagatcaaatccatttttatagtgcatgcattttcagttgatccttgaacaactcggggctgaactgtacagctccatttacacatggattttcttccacctctgccacccctgagacagcaagaccaacctctcctctactcctcctcctcaacccactcaatgtgaagatgatgaggatgcagacctttgtgattatcctcttccacttaatgaagagtaaatatattttatctttcttatgttttctttaataacttttgtctctagcttagtttattgtaagaatacagtatataagacatataacatagaaaaagtatgttaattaatattttgttttattgataaggcttctggttagcagtaggctattagtagttaagtttttggggagttgaaagttatatgtgagtttttgactgtgcctcatgtataacttttcatgtacttattacccagtgtgatctactgatacaatgcaatccctatcaaaatctcaatgatttttttggcagaaatagaaagtccatcttaaaatttatagaaaatgccaaggaactctaaatagccaaaacaatcttgaaaaagaatgaagttggaggactcaaacttcctgactttaaaactcattacaaaggaacaataatcaaaacagcttggtactggcataaagacagacatataaatagtgggatagaatagaaagcccaacagtaaatttttgcatatgtgttcaaatgatttccagcaagggtgccactccactgaaagggagaaaagacaatctttccaataaatggtgctgggaaaattggatacccacatgcaaaagaatgaagttggacccttagctaacagcatatacaaaaattaactcaaaatggatcaaagacctaaacacaaaaactacaactacaaaactcttagaagaaaatataggcgaaatagttcactataatagatttggcaatgatttcttggatatgacaccaaacacacagacaataaaagagcaaatagataaattgatcttcatcaaaatttaaaaaatatttttatgcatcaacatacattataaatggaataaaaatgcaagtcatagaatggtagcaaatatttgcagattttatgtctgacaatatttttatgtccagatatataaagagcttctaaaactcaacaacaaacaacccaacatgatttaaaaatgggcaaaatagacatttgtccaaagaagatatacagatgctcagtagaatactttttaaccacattcctataaatggacattagattgtttctattttttttactactataagagtggtgcagtaatcactgttataataccaaatgtatgtatatacatgtatttacttgttataattactcatctaaattattactcatgtaacaaatatatactaagaacctgtaaatgcttggtccctgctttaaaggaggaggactagtgagcctatttaattattttgatgataaatattatgaagaaaaagcacagggaaccatgaggatgaataacttgacttgggcaactcaccggtgggttttcctgaggtaggtaatatggggtttactgcattaattcttaggcttggaattgttggctgaaaggttaaaggggtttcatctttaaaattttaatacatattgccaatttgtcctccacaaggtttactaatttacaatcacatgcaaaaaaaaaaaaaaaagtatagacttgcacctgtttccaatattaccattcatactggcctgggtttatccattcatttataaattatgaactttcttggatactgactacatgccaggcaccatgccagggtgaattagagacatagttccttgtcttgacaacttcactgtgggctggggagagacagacaataaatacgacaataaatacattactttaaatgacttagttatgtttccacacccagctgaaatgggcccgggagaatcactgtgtttcttgttgtcgatctgggatgaaattagggcagctgggttaaaaacatagttgaaagcagtggttttcaagcaggggtgattttgccactcaggggactttggtgatgtctggagacacttttgctgctgcagcttaggagggagcactatgagcatctggtcactagaggtcaggggtgctgctgaacatcctgcaaggcacagggtggcctcctatgataaagaattatcgagccccaaatgttaattgtgccaaggttgagagaccctggcaaaagaaagaaccagacaaggcagggttcaaatcctaggctagccactgtaaaggcatctcagcggtcgtcaacatgcttgtcttttgcataggggacgagattagatgttgtgattattagatgagaaaaatgaattgaactgtggagcacaggacacagcagaagttgtccatgaatggtgggtcatagtataatgatgacacaccacagtggaagaaggatgggagatggatatttcttaatgtgtagctctgggaccactttagaggaagcatggtaggagcaggaggagctgtggggcttggtgacttagggaaggatggatccgtgcctctcgttgtttctctgctatcttgtttgcgttgcattttcttggtcagttctgtttgtcatttttgaacagtttcttggatcatttaaaaaattgttttgcagctttttttttatcctttgaaatcagtgctgttgtttctcatgcatgttaccagtgtttcccccactttatcattcaacctgattcattatgtttcttctttgttctgcaggatagaattgctcagtgtaataacaatgtttcaatgtcttctattttgaatataatcacaatgtccactcctttgagtaaaaaatgataggtccggtgatggccattggcccaaatggtggccttactgagctacacagctccaaagggagccagcagtagaatcctggctttctgggccacatttgggccaccgtggagatagatgagtgtgtgatgtcagtgtaccttacagaggtgatgcaagtagctcagactcacactgtgaatccacagtgcttggtgctttcaaagggtttcaaaggatttcttgagaagcaaattctatttgcagataatttctatttcagttcctttctgaaatatgaaggcaaaatgttaaaaaagtgacattgatattataactcataattcgcataacaacctttttgttggccgggttggagacgttacacacactttgaagaaacacaaagccagtagtaattctacaattcagaaaaagctttatctggcagcatctttttgttctacatccaaatcccattgtgatatctaatagaaaaagccttagaggtggcaaagaggtggatggatggtcttaatgtccaccctagctccccagcgatcctcctaggatgtgttgcaatgcgtctaatattctttccagaaccgagtgttgaatggtgttccccactgcaatagaaacacacttggaataggatagcatttatagtcatgaccaacctgtaccccgcagggagttgcaagctgtgctctggcagatggaaccgaaaacacacctctgccagggaagctttgagccaagcgaggaaatcaaattcttcctgttgtgcccagaattgtgatttactgcccatccgaatcatagcctcataatatctcagctggaaggacgtagccagtgtctactccagggagtttctgggagtccctgggacttagagttctgccagtaccaacaaggctgcgctcgacaccttagcccacttcctagccatagccatttcttccacaggccaggacttctgaatggcttttgtgtgacagacagtttctggcagttaataaaaggaaaggtagaactaatctagctcaacatcatcagataatttacagatatagaagataattgcagagtgtaaagagatttgttcaaagtgacagcgtgaaagctaaaaaagggacaatcagaggcttccctgagcctctgaagtgaggtgactgtacctgcatctgtcccagcaccgggcccagccaatcccacttggctggggtgggtggtgctgcctgagagtccgggcagtcccttttcacccctgagcctgaccctggtttctcagaatctcagaatctagctattttgaaatatacaatacatcatggtcaactataatcaccctactgggcagtagagcaccagaacgttttcttcctgtttaatggtaactttgtgcccattgaccaacccctccccatcccccctccccctcccctccccatcccccctccccgtcccctccccagtctcaggtaaggctattctcctctctgcttttgtgagatccactttttggtttctgcatatgagtgagatcaggtggtatttgtctctctgtgtctggcttactgatgattacacaaggtgtacatatgtcagtatcacagtgtaactcatacatatgtacaattattatgtgtcaattaaaaataaagcaaagaaaaataaaaacaaacaaaaaaaatctgagcatacatagggctcttcaaggtccttaacttttggggacttctttttgtttcacaccaaaaggaatcatggttgtcctctgccaaatgccagccaggttgtttcatactgttttaaccttgttgaaaacaaaggcaattggaagcatttcagcaactcaagagatcatgtgtttatgtgatttattgtgagtgtggagtaaaagggttactagacgctaaaggaagtaaaaccaattttgtgtgtgcaactatcagctcccatctgaaatccccccagacagcttcctgctgtaaccagctttttcctgtgagtggtttgttcattggctttgcagaaatgagaacagccaatgatgtcaggagtccggatttgccgaagtcatcagcatctggcaaagcctgagctggagccagaaggaggcgccatggcctggtgggaagccccgatgaagagtgggaggtgaagctggagtcagggttttgtggaaccgcctgtgcccgatctgtgagaagctatgggttatcagccacccccggtttcctcccttttaaaagaagagggtgaattttatgtctttttagggaccaattttcaaactaggcagctcatcagaatcacctggtgattcttcacccaaaaaaaaaatcaccctcgaatcagaatttttgataatgaggctctaggatctgtctttttaacaaaccccccaaatggccacaactcacacaatgttactgcttcatgcttttacacatcttgatgtatttctaggatttgtgaatgtatgctttttcaattttagcattttgaagttaaggtgaatcttataattgatgtaaataattaatgtggtcttctctccccttcccccgattctccttgagaagtggataatgaattgtgaatcttatatgcggcggtatttttaagtgaaggaaacacctcctctcatttccaactttacaacaactacgtgaagtaggttgtgcaagaattatttatcccctcttcccagaagaagaaacgggcttgaataggttaggcacattaccctttgatttatttattcaacccacgttaataataagcatcttctgtatgtaggggctgggctagattgggagaaagcagagatgaagacctggctcctgtccccaaggagcttgcaggcttgtgggggcatcagagcaataattcgtgcccgtggctagatcaatattggctctagaagtctcctctgggaggtgaggggaagagcgactggttctcatggggcttaggaaaggcaccgttggagaagtggcatttagagggagcttgaagaatgggtagggcatgctggacactgttatagtgctatcctcggagactgcaaagccaaggaatcaaaccgtagacacacagcaggattctggtggtggaaacacatgttggcatccttgctctctcaatgtgacttggggcaatttgtgaccatctctcctctgaagaacggagggctgttgttggagttaggtgagacgatgttggccaagagcttgcatagtgtcgacacttcagcaacacaggaagtggggtaggacccaggtgtgatgggtaattttctttatcaacctgactgggctgtgttcagaaagctggtaacacactcattctgggtgtgtctgacggtgattgggagagctgttagcatttgaatctgtagtaaagaaaatgtgcactcaccagcatgggcggcattgtgcaatttcttgggggaggaatagaacaaagaggcaaactcgctctcttttcttgagctggaacatccatcctttcctgccctgggacattggaacttctagttcaggcgctttaagactccgatcaggattttctccgtagactgccctggtgctcaggccctcgggtttggactgcacgacatctgcagctttcctgggcctctggcttgcagatggcagatagtgggactgctcagcctccgtcatcacatgagccagtccctcctaataagcatctttctatctatttatgaatgtgcttttggttctttttctctggagaaccctgactaatgcaccaggataggaatgattcggaaggagggaagaggcttagggccctgccctgctgggttctgttgcaagtggagggcaggctgaaggggagctggctttgtgataattcatggggttgaacacttggtaggctcttcggcgtgaagagatcagacccatcctgcactcctgccctcagcccacttttgctcttttgtccactgtcactgagggacttggcggcgtcagagccacagagagggaaggcttggactcaggaaaacagtgagcatgccacctcttctgtcatccaacagtaggcctggaaggacttttatcaatgctgtgcctggcactacacacacacacacacacacacacacacacacacacacacacacaaacacacacggatgagacagagatgggtctcattctcagcacggcatacaagtgttaaataattttgcaggtgttaaatctcttgcaggcgcagcacacggactagtattcatgtgaatccagggtcgtgacatcgtttgggtgtgagggaagtcctttcagagcttggggtgttgaagttgagatttgaaagatgagcagaagctgttcaggcaaaaggagtggtgcagggagagaggggctatgagcactctaggcagaggacatagaccctcagaggccatccatgttaggaaccagcaaagtgcattgcagctggccctgaaaaacggggagaggaggacagcaggctcaggggcttggccaccatgcctggggaaccctgccaaggatggggaacttttcttttcttttttttttttgagacatagtctttctctgttacccaggcttgagtgcagtggcctgatcatggctcactgcagccttgacctcccaagctcaagagatttccaggccccaccttagtctcctgagaagctaggactacaggcaggtgccaccactcctggctaattttttgtttctttttctgtgtgtgggcagatggggttttaccatgttgcccagactggttttgaactcctgggctcaagagatctgcctgcgcagcctcccagaggctgggattacaggcatgagccactatgcctggcaatgtggaacttttctacaaggacaagaggaaaccgttgaacagtttcttttctttttaaatattgtggcaaaatacacataactcaaaatttaccattttaacaatgtttaagtgtgtagtccagtggcattaagtaaactcacgttgttgttcagtcatcaccatccatctccagaacttttttatcttgtaaaactgaaactccatacccattaagcagtaactcccactttcctctcgcccagcccctggtaaacccagctatactttccatctctgtgaatttaactagtgtaggtgccttgtctgaatggaatcgcacggtatttgtccttttgtgtctggcttctttcactgagcacaatgtcctcaaggctcatccatgtagcatgtgtgagaatttcctttcttctaaggctgaatactatttcattgcctgtgtatactacattttgtttatccagtcattcgtttggacacctatcaaaagattttaagagagtaacatggtccgatttacattttggaaacatcagcctcgttgctttgtggaggctgatttggaagaagatgtgagtggctgcagggagcccagttaggaggctgccagatgagtccagtataagaggctgggtggcggtgaggatggtagaaatggaaggtttaagagctattaatacttagaaggaggaatgaaaagtttatttgggtgtaggaagtggaggagaaagaggactcaagagtcatttcaggtggatggggctgttatttacaagggcaagctgcagacaatgagttgggctttgggtttgtggagtttgagaagtgcatgggccattcaggcagggatatatgcttctaagctcgaggctcatttgggaaagtactggcctagagaggcaatcagtgccaaaggggtgcgtgaaactcctctctgcagaatgaaaagcagaaaaggccaaggagacattccttagtaactccaacatctgaggtctagtagagttggattggccaaccaacaacagtacaaggggttgttctgagagcaccaaaccagaggagtgtggtgtcatgagagccaagggaagataagggcttttaggaagaaagtgtttggtgagagagactgaaagagcgctcactggtttcagcaacacagaggtaactggtagcattggtgaaggcaatggcatattgagaagctgcagaagctgagacattcgatggttaccagctgtgtgttcttggtgtagttgttcaatttctctgagccattaattcctaatctgcaaaatgatacacccaataactcatagcacctgtgcatttaggggttggaggtagatagaatatggcttccagagtcaaggcaaggtctatctgtacaaggtgatcttcttgactttgtggttgactccctggactctctgttctatgcaagccggcaacaaaggggttttgcagcgttggtcaatgttgtcttcaacatttgcactcaggacttttaatggatgggggattaggatgagcaagaacaaccaggcttttctgctgcaggaaacatcccaggtgcatttactcactctctggtgttttatttctgagaagccagcagcaagagagaggatgctggggttgggaggcttggactctgggctcaatgctgtgggtgactggccatgcagccttggcaagccactgactcccacctttgaaattcctaacctatgacatggagccttcttcagctagataattctggaatgtacttcctcatttcaggtgtgtctgtattgcaaataagtccctaccaaaaaaagttgttgtattttggacaaaaagacacatctccaagccaggtacttgcatagctcttgtcacagttaattcccaaaacaactctgtgatgtgggtactgctaatcccatttaatacatgatgattgcttggcttcaggggctaatgacttgctcatgtgggagagagtgtttgtatcaggtagcaggaagttatgtttaggcaggggattattaattgaaaccgtaattgatcacttgctcttttgcaaaaggaatctgttgtgtcagccaatgcctggaagaacccagacactcattcctgtcctgagagtaaatctaagatcctcagctgacgcttggagacctctgttctttggctccaatcacattttgctggtttagtgtccacttttctcttgcacttccacttacacctatgctttggttttactgctccctccaagtcctacatcttctgccttgatagctttgggcaggtgactcccttggcctgggacaccctttcttggtgacacagtttggaattctgtcgttgtgtcaaggccagtgaacctttcctgacctcccaatgctgtagcattttcctccttttgaatctgcactgtattttttactttcctcctagtgtctctgccttgaatcagagttatttgcctctttattgcctttatattagaacatgaaggtgatttagtctttgaatttcatacaaaggaaacccatgacaacagttggcacgtaatgaaagctcagtgggtatttgttgatttcagatgcatgcatccttaactggttttggctcacttatgcactcattgattgaacagctaattattagggtctaagataatgaatatgatgttccatcacctttagcttggagaaaacatcccatgaaatggccacacatttcttctgggatgccccccgttagccgtctcggctggggcttcctgtcctggcatgttcgcacagcatgtaagaggtcctgtgggacacacgctctcatatgatcactgcctcagcctgtgagactagtatagcagatccatcttccccaaggtcccattttctggaggtggaaactgatgttcaacagtgtggaccgacttgccttgtgtctcccagctactgggtctgtagatgctgagtcttctggcttctgttcctgtggtatttctgggagtcaaggaaggataggaagaaaaggtaaaggaacaagtagggaggtgaggaaaacacaccagagaacagtgtggagaaggaagaatccgactcctggggctcatggcctggcgtaagagcaggttgcttctggggctgccaccagtttacccatgtgaaggcagactttgctcctaagtcctggatctcactcactgcagggtggcttctgggcagcagaggccaatgagctgggcacagagaccaggtcggaggcaagtcttggcccagatcttcacaaaatcctgccctaactctacctatggacttcaaaattacaactgcgtttaaaagtgtcccaaaccaagcaagctttattgtttaacagtattgagagtagggtaattcaggatgtaatggaacagctgtcttatcaggaaaaagggggtgtactctctcccccaatttctccctcctacctctgtaaaccctcatttcctccttaccgcctaccaaccagcatagctgcttcccagcaaagcccgtggaaggccaggctgggtgctggattctgggtccctacatgcttagtaaatcatcatgcacctgccatgtgagccctggcttagagccaggctttctcatcaaagcaaactgcttgtgttgtgtccataagcggcaagcactgccagacactcccagccatctggaagagcaagctggatgctcccagcaaggcccaaccagaatcttcacggggtgccttcgtggccttggttcctcgtttattaagtatgagtgtggccctcatgagttctaaggtttttaccttcctcctttggaatctacgatccagaatgggatcagctccctccaggagagtttcatgcagcctggaaaccttcctcacctcctggcttgggttatgggactaggctgcaccctacagcatggcagacctgcagactcaggaggctaaaaccccggttacccactgtgaggaactgggtggtgttaggggagttacctaatgctctgtgcctcagtttccccatttgtgaggtggtgacaataaccagtatctactgcaaaatattgttgcaaggattaaatgttgttatgaaatcaggatagtgcctgtcacccagccagcgatggtgggccttactgtttttgctgtttttgtaggcacctggaggctcacactccttgaaggtgggcacttcatctcaatcatctttggattcctactccctgtacttgtgtgggccaccctgggctcccagcaatgtccctgagctggggtcgactgcccttccacctattctaggcctgctgtgtacccctggttgagtatttatcccatgctcagagcactggagctgctgtgaatcataggacttgttggataccaccctgggctaggatatctgtcattctcatcatacaacaaacatgtttatatatcaaatgcaaataccaggtgtagatattttcatttgtgtgatcgtggaatttgctaacattcatatattaaacagtgactccactagccagtgatgcagtgaaatgaaggcactggatggagcagttgcgctgctgcgtcttggagggataggatagcaagtgtgctgctgtggtgagacctccgtttcctcctggagatggcagctgagctaggccttcacctgggatgccaggtgttttggtgtcagggactgagggaatgctcttggtaggggttgctcaatgctttcaaattttcacaggttcccaggtttgtctctagacacacaaccagcagtttggtttctgtcatagagagaaaggacttgtgagccagtggtacccctggctgtactctacagccatgactccaaccctccccgaaaccatctccactgcaccttcccggtggtctgctcaggacactggagagatgacaggctttgaacaaaggctcaggtttccggcttgaaaacagccttgctggaaagcagcagcaccctcactggggcaagaaactccatgggcccaatctttccagttgtggcatcaccatcactcttgacttctgtaagcttttcttaagatctgaccctcacaaacagacaaataaaagcaaacatttatttcttgtgccatatacttttttctggtaatatacatatatatgtatgtatatgtatatatacacacatatatatgtatatatacacatatataacatatatcatatatgtgtatatgtacacatacacatacacacacacatatatgatatatatcacatatgttacatattatattacatgtatgtatatattatatattatatattatatatattatattatatattatatatattatattatatattatatatattatattatatattatatatattatattatatattatatatattatattatatattatatatattatattatatattatatatattatattatatatataatatatattatattatgtattatatgtattatatatgtatatttagaattggccagctttttagatgatctcaattttgttggcaacacccaaagcattgtaatcaggatccagtcaaacatatgccttcttctctccatcaggccgaatcagggagttgaccttggccacatccatgtcatagagcttcttcacagcctgtttgatctggtgcttgttggctttaacatccacaataaacagaagtgtgttgttgtcttctgtcttcttcacggccgactcagtggtcagcggcaactcgatgatagcatagtggtcaagcttgttctccaggagacgctctcccgaggatattttggcgcttgttctcccggtgggggggagctctctcgaggatatctgggctgcttgttctccagggggagctctctcgaggatatctgggtgcttgttcttcggggggcgctgtctcgaggatatttgggctgcctccggagtcgcagtgttatcggaaagtgggtgacgtgcggatcttcttttttttttgtggctgtggacgcctttcaacactaccttcttggccttcaaagccttcactttggcttccgcttcaggaggggcaggagcttccatctttgctttcggcgccatcttgtgaaaaggctacgttgttttttttttttaattatggaaaaatctatataacataaaattcaccattataaccatttttaagtgtgcagttctgtggcactaactatatttgtattgttatgcaaccaccaccactatccatctctagatattttaaaatctctcccagtggaaactctgtacccatgaaacaccaactctccatttccctggtaacccccattctactttccatctgtatgaattcagctactctaggtacctcatatgagtggaatcatacagtatttgtccttttgtgactggacttatttcacctagcgtaatgttttcaaggttcattcatggagtagcacgtgtcagaatttccttcctttctaaggctgaataatgttccattgcctgtggacgacccattctgttcatccattctgcagtccatggacacttgggttgcttccaccctctggccattgcgaataatgttgctgtagacatgaatgtacaaatatctgtttgtatctctgctttcacttgttttgggtatggatatggtttggctgtgtgtccccacccaaatctcatgttgaattgtaatcccctgtgttggggcagaaacctgctgggaggtgattggatcatgggggcggatttcccccatgctgttctcatgatagtgagtgagttctcacaatatccggttgtttaaaaatgcatggcctctcccttcttctgctctctcttgctcctgctctggcatgtgagatgtgcctgcttcccctttgccttctgccatgattgtaagttttctgaggcctccccagccatgcttcccgtacagcctgtggaacagtgagtcaattaaacctctttctttataaattacccagtctcagtctcaggtatttcttcatagcaatgtgagaatggactggatcatatagtaaatctatgtttaatttttaaggaaccaccatgatgttttccatagcagctgcaccattttatattctcacccatagtgtgcaagggttctgatttctctacatcctcatcaataaatgctataacatatagtttgcaggcatcatatttcattcttacaacaacccagcaaagcagaccgtaatgcccaaatatagacaggcagtttggagatattagtgaaatacaaaacaacctttccagggccagctaggaaaagagtgaagtcaggatccagacttggctttggattccaaagcccatgcccttcccagcctatcagactatatctctaatagatgaatgcattcttaattcacctaaaatgttagtataaattattaccttttaaactgggtacctgctcaatagagtattttgggcactgggttgtcaacaaatcatctctgcaccatggtgtgccttggttccgggagagcatattctaatgcataattagtagaaataatggagtctatcatagatttgctctgatctgagatggttagtaacagggcacacggtgcacagattcctttccttttactcatttggcaaacagtcacggagcctatcctctgtgccgggatgtgcatggggctgggattttagggattcaaaggtttggttcctgcctacgagccactgaagccacaggtggcagggacagtaaacaaggtctgcccacagccggatgagataaaagctggtggaggttaagtgaaagccatccctgctctacttttgaaggtaggaaccacagccaggtttcacaaataaaactgatgacagaacccatgtgtctcattgcgctggctgctgagaaattgcgcaaaccgtggcaacaatgagcttttgttttgtgaacccaaagtattagagacgggtctcaatcaatttggaaagtttattttgccaaggttaaagacttgcccgtgacacggcctcaggaggtcctgatgacatgtgcccaaggtggtcaggggacgccttgctttttaaacattttagggagatatgagacaaatcaatatgtgtaagctgtacattggtttggtctgtaaagttgggacaactcaaggcgggggcttccacgtcataggtagataggagcccaaagtttgcgttcttttgagtttttgctcagcctttcagtgaatatacaatatatatgtgagagtgggataggggaatagtcacttatgtcttagtctggctcagtgaatctgcattctccatcaacaaaagggcagaggaagcaatcagatgtgcatttgcctcaggtgagcagagggatgactttctgtcccacacctgggaaggtaagctatcagtttacactgtcagggtaaaattcagcagaactgttctaggggaaaaatcttgaggcccacaaggaatttccttgtgggaaaattgtgagggaggtgtgtagctttttaaatctttgcagctatcttatctaggaataaaatgggaggcaggtttgcctatcgcagttccctgcttgaattttccccttggcttagtgatttggtggtcccgagattgattttcctttcacaggttaaataaatatgccgtgcaatattcttaaatagatgaacaagattattagttgttgaaaatcagagtcttgaaattttttaatgcattcttttttgtttgagaccaagtctcactctgttgcccaggctggagtgcagtggcatgatcttggctcacggcaacttctgccctctggggtcaagcgattctggtgcctcagcctcctgagtagctgggactacaggcatgcgcccccacagctgattaatttttgcatttgtagtagagatggggtttcaccatgttggccaggctggtctcgaactcctgacctcaaatgatcagcctaccttggcctcccaaagtgctgggattacaggcgtgagccactgcgcctggccctttctagtgcatttgaatcagtctaaatatcaatgggttccttattagtttgcccatttattcatggatgttgattgactgcttgctgtgcatctgggagcctcctgtctcccagctggctgtgccctcagcagcaacactcttgtccctcccacgtgtgggcctgagtcagggttcactactgtggggaactcgtgagggatttggacagttttggtgaagtgcaggccaccattcttggagattggtggaggtttcttagccttctcggcaacaggcctcagccatgggtggggaggcttctgtgaccttggtctgcagcctggaggacgacacttcccctgcgcccgccctccctgtttcctggctccacttgcaggggctctgtcctgatgccaatcacatggagtcacaggacaagcaaggttccttccctcctagaacttctgttttactagaataggttaacccagtggaaaagacggacaacagacccataaactctgtgtgtgtgtgtgtgtgtgtgtaaaatatggtgtcaggcaggggaaagtgtgtaaaaaattaatcaggataagtggatgaagaggttagtttaagaggaggcagtctgagaaggcctctctagagagggagccaccaatattgtatacacgcacgcgcacagacacacacagccacacatacacacacacacacgtagacacactcacacatacagacgcacccacacatacagacacacacagacacacacacagacacataagcacacagacacacacacatacagacacagacacacatgcacagacacacatgcagacacacacacacaggcacacacagatacatagacacacacatgcacagacacacatacacacagatacacacagacacacagagacacacagacacacacgcacagacacacacacagacacacagagacacacacatacagacacacacatgcacatgctgacccacgggtgcacatacacacacaggctgagccggctggtatttcctctcttcccctgttttgcccagacacgcaggcatcacggtgtctgctggccacatcctccacccaaacgcaaaagctgggagaggagcctagagggtaggtaacaataaggtcaagggcagttgctgcctcagaggacacatcccagatgaggcacaggctgggaaggagcccaggggcagcagggacccagggggaagagaaaggacagggggaagagaaaggatgggggaagagaaaggacaggctggatgaagcccccccacgattctttctgacccagcatgccctccatccaccatccctcagccccagtcaccagcgtaggcgctccaaggactggtgtgaactgagggcatgagtgcagcctggggcacagagatgactgttctcactgcaagcctatcaagccctcctggcttccactctgtgctgcctgaaatgtctataaatggtgtctgtaagtctgtggcgtgtaaaggctgccttcctcctccctgatgtgcataagggcagagctgtaaggtgaattctagcccagtggcgtatgcgagctggacaggtagagtgcaagtacttgcctccctgagtctctgtctcatcctgggagatagggtgacagtggccttataggactgttgctgtggaggtcaaatgggctaaggcccagtgccttctgtgtggctaggctcatggctgtagcattgcaagaatcccaggctttagtgtctgcgactgtgaattccagcatggctaattattagacaagtaactgggagtatataaccaaagtgcccgggtcacattttctgtagctgcagaacaacacctgttttgcataagaccagatggcaaaatgtgggaaaatgctgcactgaatacaagtttgggttgactggctccaccgggcccaggcgtgtggcagttgtgatggaatccacttcacgtcttcctctgacagggtgtgtgtactcagcccaggagctggggagacctcatgttcatattagtttggtgcaaaagcaattgcggtttcagactgtgaattttaaaaaattataactaggctcaaatacatttttattagtcaaaataggaaccattacaatcaacacatttttgccaacaagaaataagtttgtttattcctgtagtgtaaaaatttgtgtttcaggatttgagtaactgttggaaagcatttttctgcatcctgctggttgcggaagtgtattccctgcaaaaagttgtccagatgcttgaagatgtagttggttggcaagaggttcaggtgaatatggtgcatgaggcaaaacgtcatagcccaattcgttcaagttttggagcatggatcgtgcaacttggggtcgggcattgtcgaggagagaattgggccctttctgttgaccagcgccagctacaggcattgctgtgttcgatgcatctcgcggatttgctgagcatacttctcagatgtaatggtttctcagggattcagaaagctataatggatcagacctgcgcagaccagaccaccaaacagtgactatgacctatttttggtgcgagtttggctttgggaaatgctttggagcttcttctcagtccagccactcagttggtctccaccgcttatcgtataaaatccacttttcatcgcatgtcacaatctgatcaagaaatggattgtcgttgttgtgcagaataagagaagatgacacttcaaaatgatgattttgttttttaaatttgtgtttggctcatgaggcacccacttattgagctttttcacctttccaatttgcttcagatgccgaatgaccgtagaatggtcgacgttgagttgtttggcaacttcttgggtagttgtaagaggatcagcctcgatgattgctctgaactggtcgtggtcaatttcccgtggccggccactacgcttctcatctgaacccccactgtactgtgtgttcattagcagttcctggaccaaatgcgttgttgatgttgcaagttgtctctgctgctttatgacgcattttgaactcaaataagaaaattgctcaaatttgctttttgtctaacatcatttccatagtccaaaataaatataaaataaatagcaagtaacaagccgttagccaaaaaaagtgagaaatgtgcattgaaatgtataatataaccacatttatttaggaagctattccaatgtcaattagcaaatttccacaatacaaaaactgcaattatgtttgcaccaactaatagaaagctttctatgcagatacatggaaaagtgggagctcctaaacagcagggaccaggccatatttcttatagttcttgcactctggccacttttcgcatagtagctgctcagtaaataagcacagaatgagtgtggctgtagttccatgttcagcttaacggtacaactaaagtaattcttgacccacagctgggttgagctatgcatgccgctggagcccactcactgtgtggtcctgttcgattccagtcatccacccacccatgagcacagaagagaggggtcctgtagaagtctaataccccttcttctcaggcctctgttatcacaacatcaccaattccctgcaaaccctcccagagcttgcaaaatgccaaatcccaaaggtgccatgaaaggatccatggcgccctggatccctggcagaatcttttccacggcaggatcttttaagggagtggtggagagggtgaacatttgacttcagttatctttttcagtgaagaagccactaaaagtgattctaccatgggagggacaccagtggaggagagaagtggggagcaccaggggccactaggattctgggtgctttgactgtattttctcatttaatttcagaaccccaaatctgaatagcaccatgtcaaaataactaaagagataaatttcatgagagctagaaataatattgtcatgacggttattatttaaatatttttggtacaatttgggattttttttctaaattctcatggcacatctgagaggtctcacagagcaccagtgtttcaaggaataggaagacatgaccaagagtgcaactcgtggatggctgagttcttgcttctgcctctggaacaatgtttggtcaggtcaaaacaatttcttaaggtgcttacaaatcttgacagcaaaaacatccattttttaaaaattttttaaaaagaatggaaatctgagaagtaatcaaattcaaagaaaaaatgttattttgacgctcacaaactgttggcagttcggcaatactataacatgtacacacccttattattatttttgaaaaatgagataattaaaagtattttatgtatgtttgttttatgttataaacttgaaatatttttaaattgcttataaacatacataaaatacatattaaatataatggttgtagttaaacacaggtttctgtggccactatatctatattatatggaaacttcaacttcatctctccctaccaaaaagacttctgggaacttgaaatgtagtttaaaaaccactttgtttttcttttctttttcttttttttgttagacggagtcttgctctgtcaccaggccagagtgcagccgcatgatctcggctcactgcaacctctgcctccccagttcaagtgattctcctgcctcagcctcccaaggagctgagactacaggcgcctgccaccacttgggctctgctaatttttgtatttttagtagagatggggtttcaccatgttggccaggatggtgttgatctcttgacctcatgaaccacccgcctcagcctcctgaagtgctgggattacaggcacacgccactatgcccaggtaattttttttgtatttttagtagagatggggtttcaccatgttggccagactggtctcgaactcctgacctcaggtgatctgcccccctcgtcctcccaaagtgctgggattataagcgtgagctactgtgcctggcctaaaagccactttcttagccaacctctttaacaaaactaatttgcaagaaacagaatctggaaacttagcgtttggttattattcattgtaccactcaaccaaagctttacaaattttgactttggcatatgacttcaaaatttttagaaagacacactctagctagaattcccaactatctcctctgtctatccttccatttgagcaaacattttatgcagctctctgtggtggactccaactttcagagactcagaaacacggctgcctgtgcaatgctgatatcatagagcaatagaagcagcgccatgaaagaggtcctctcctctacctgatcattttgcagaggaggcccagagagggggagggacggcattaattcattcctttattcattcatttggcatttattgagcaagtgtgctgcaagtatgccattagggtgtggaattacaaccataaataaaatactgtttcgaccatttcagaacatagtttagttgaggaaaaagacacaccaacaaccaaagcatgatgagttatcataggagcacctttccttcaggaaacagctgttggtcgtttgttgtatgccaggttctgtgctaggctcggagaatataggggataagtcagagaggtccctggtcctgatggaatttaaacacacatcaggaagtagatttgaacaagatcatgagaaatgttgagtggctggttgtggcagctcatgcctctaatcccagcactttggaaggccaaggcaggaggattgcttgagcccaggagttcgagaccagcctgggcagcatagcaagaccctgtctcaaaaagaaaagttaacaaataaataaaaaggaaatagcgttcagcaaaaatgttgcaggtcctcaccacgttcttcacaggcacacgtcggggagagaagagagggcatcagaggttgcagacttaccaacagccgtggtggagcccgttggctccctggaactctcgggactgcatggtgtggctcagcataggtggcctgcgaggatcttggtaggcagtccacagagagaggccttgtcctccgtagtgatcactatttcagggatggactagaggttaggtcaaggaacaactaaatgtcatagagagtgatgctccctgctcagagaagtggctctcttagaaaggggacatctcggtggcagggactggcacaccctgatctgccaccgagctgactcaggtgtgcagggccggccctctctaagctgcataatggggaggaaatgggcccccacgtctctgcatttgcctttccttcaatactgaaggccatgtgcatagggctgtgtgattatttcagcagcgcttggctgggtaaaggtggcagaataaacggaacagacaggatgatccagacctaggtccgcctagacgcatgcatgtggcacaacgtgtgacggagccacttcacagctgcctttttgataagccatttacaggacttcaggatgcttcttgaggacaatgggatgtcatcgaaggtattgagaacgatgtgaagaaatcgttttcatttttctttttttttctagagacaaggtcttgctctgttgcccatactggtatgcagtggcacagtcatagctcactgcagtctagacctctctagttggagcaatactcctacctcagcctcctgagcaggtgggcctccaggcttgtgccaccacacccagccatttttttcttttttttgagacagaatcttgctgtgtcacccaggctgcagtgcagtggtgcaatcacagcacactccagtcttgacctcccacctcagcccctagagtagctgggactatatccagctgtttgtttatttttttgttgagatgaggtctcactctgttgcgcaggctggtcttgaactcttgaactcaagtgatcctcccaccttagcctcccaaagtgctgggattataggcatgagacactgcacctggtctaattccttttcattttaaaaagatgtggaggaagtagattggaacgagggcaaggaagatccaatgagacaagctgagtggctgttgtaatgatctaggttgctggagatttttaaaaatgtattttgttcactgttttattcccagaacctagaagagtgcttgtttccaaatagacacccagtaatagttaatcaacaaaattcagttgctggtttgagggtcagtggaacgtgggtcccttttactgacacgtggaattgctgatcaaatctcctcttagcattattatttccagtgactctggagagggagggcccttttccaggctttagggccaactgacagagaaaaatgaaaacccaggtaccacaaggctgaaaggtgaagacggagtcatctcaaattcttcccaaccagctcatcaagatctgctggttgatataaatgtgttacctggaaggatgacttcatgtgtttgttttctgttttgaagaaaggaagtgtatttggcaagggaacttcttcctttgttcagctctgggaatccttaaagtcaacagatttccagcaggttatactcaaacaaggttgtgtctcatggcaaacaaggccttagaaacagacaggcccagttttgaacaccagctcaaccattctcaagacatgcgatcatgggcaattaacctatttaatatccatgactcagctttttccatctataaaatgaaataatcctggtgcctatatcatagaattgttctgaaaaataaatgagataatatgtgtagtgcattaattaaaacatggaagcaataagcacttgctggatgtcaggggtcattacttccactacagttaaagtggaaaatggaaagaggcctgctggagccagatgtcccctggcggacgctctggtctggggacaggcgacacacctgagtggcctattgccttgtgctgatggcttagcctggtatgtctgctgatcacgagccaggaggagtgggaactgagccatagccacgttggaggaaaatccaggagcaaactccatgagagagtcatgaaatctggcagtggaagggctgccgcctggaagctagtgcttggtatatctgcatgagaaattaagggatcaggatgggaatgtctttacgttaagccttttctgcttgaggtgactgcatatgacaggggacccagagtgacagcataagctgtggtctccctgcagacttacatgtgtcgtggagtctgcgtaggtggcagagagcttgagttgctccacggccaaagaacccatgctcagttaagagaatgtgaagaccacacgcttgggccaaccatgctgggccggtgttggatttgcaggcaggttctgaacacagagtgtcagccgctacttagattgttctttttcacatggggtcgccagtctgaatgcctccctgatgggatccgtgctaaaaccctaggcaggggaagtgtaagttcccaaatgaaaagggtgagtcactgaagtagggtcagagggaggaggcagctcctggggtaaaacctgcatcagaggtaaaagggaagagcctcttagcagggagccggctggccttgctgcctgggcagatgcatcttttactttcttatatgtttatcagtccaggaaaatgtaagcccagcgcattcagggggcttaacgcctttgttttcctgctgtgtccccagcttggagaaacaggcctagcacagcagagatgctcaagacatatttgttgaagaaatgaatgaatgaatgaatggatgcagattcacttacgcagcaatcccctgtcaggtgagaaggtagagagtgctgctctaatcacttctctctttacctctctgccttaccaaattcctcctatcttatgaggtttagtaaaaatatcaccattaccagctgttttattttcccctaaaatggctttttatctgttgttgacatgtacctcggccctggatggtttatggttttgccttattttgcctttgttcggtttggtatgaatttgatatgagattgtaagttttttgagggagaggccatgccttagaatcacagacctctccagtcacagcgtcccgaggaaaggaactgaggctcagagaagcaaagccacacaaacactacacagccctttgtgtgttaaagtggctccaccatttctttctggggagacttgtgaccttgtccataaatgcattcttagcactcctccaaatggtagtgtgctggccttctgtggagggatgtggcctcctaagatgcctcaactttctccagaggatgacagcctttcacaaaagcacgtcatttccagttgaactgtggtaaaaagaaaccaggcggcatttcaatgagaacatagagcgtctgtatcccaggcatctgctgggatgttcctgtcaatgccctccccacagcacttaccacagttgcagcaggagacacgttctgtgtagaggatgcttcgttcttttggtgctttaaaaattacgcctgggttcagagcccagggtgcccacctttacacgatggaaccaccaggagagattaactgagggtctgacaccttcttaggtctgattagagacatttaccgtctaatctccctgaagcctccctggaggcttcatctgtacaattagaaccttggtctctacaacgcattatcttaatccagacactcttttctttgattccaggtctttagataataactctttcaaccaattgccaatcagaaaatctttcaatcagcctgtgacctggaagcccccagttcgagctgtcccccctttctggtccaaaccaatatacatcttacatgtattgatgaatgtctgcctgtaacttctgttcccttaaaatgtataagataaagatgtaacccaaccacttctggcacatgttctaaggatctcctggggctgtgtcgggggccttggccactcatatctggctcagaataaacctctttaaatatttttttaaaatcccccgattaagccagattgacaggggaacctacagggagacattaagacattcgttttttgttttgttttgctttgttttgttttgttttgttttgttttgttttgttgagacagggtcttgctgtgtcagccaggctggactgcagtggcacgatcatggctcactgtaacctcaatctcctgggctcaagccattcttctacctcagcctcctgagtagtgagagtacaggtgtgtgttaccacacttagctaatttttgttttttttttttttttggagagacaggtttcaccatgctgcctgggctggtcttgagctcctgagctcaagcaatctgcccgccttggcctcccaaagtgctgggattacaggcatgagccaccacatgtgctgacaacatgagttttcttctttgatatatgtatatgtttttaatgaactgaactgtgagtctacattgagtgacatgatgacaaccagccttcgaaactcgctgtgtggacattggtgaggacatcgtacccagcattacacattgaacaagtgggcttagagaaaatgaaggaagtttccattcaggaaggagctaaaccaaaccccagttgtaggggacactattgttctaactgaatagttaatttctttggagcaggccaacatgaaagttataggaatgaaatgtccatgtgaggttctcagcaaaacataagtaggaaaagcaactattttcttttggcgtcatgtgccaacctgccctgtgaatgcttggagggaggacagacttttgctctggagcattttctatcctcgtgtgtagccgacatccttaatcaatcccagcatgactgatttcctgatttctccacagccaaggtgaatgggataaaatgacttggaccacgtttgcatgcgatggaagcctggccaccagccttcctttaggagtagcaacctagcttgtcctagggtgcaataatctcaagacctggggtctagacaggaagaattcctccaaggaatcaaatgggcctcaagttaatgatttgggctttgcctcaaccagaggctggactacagagcagatctggtttttcaaaccatctcttatgttcataggattcgatttcaaagaattgagatagtatctcaattcttccttgtaacaacacccagagataagaactaccttaaattttacagataaagataatgagactgagaaagttttaagtgactttttctacactaagtagctgagtgtggatctgcgcatgggccactgaacatcagccactgaatgtgggtcacttgcccaagcctactggccctgaggcaaaggccagagaaaggaagccttggaagagatagtgtaataggagctgtggagtggggatctgcacactgggccatgctgcttgcagatgtgagcttgttgtgatttccctactcttgggatgccgccttcctttccccaggatgttctgtacgcgtgcatcctccttccctgctcactgtggtgcctcccaatcggtcaccccacttctgtcctttctcctctttaaccctttcgccactcagcaaccaaagtgatttttctttaaaaaattattttagtttggattcagagggtacacgtgcatgtttgttacatgggaatattgtgtgctggtggggattgggcttctactgttcccattatccaaaaggtgcacattgtacctgatagatacattttcaaccctcactccctcgcttcccagtctcccctgctcttcagagcccccagtgtcttctatttctatcaaggtgagttttctgagatgtaaatcagagattacgccatttccttgctcattactccctcgtgacatttcgtggtacacagacaaggagcacgtcctctcccttgcactcaccttctcctctgcaggtggttgttgcccgcagctccctgcgcccggctcctccttgccactcagacctcatcaacacctttcctgatcatctgggatgaacgcatcgcccccatgctactttactttctggagctctcatcctcctccctctttgtttccttggccagctttgtttttcttggcagcatgggtggctacctaacattggatgctgtgtttaattgcttatagtagacacttgtttaattgttcactcttcacccataaaggcagagactcctttgtcggttggttgctgctctctctcaccaaaatgtaagctccctgagggcaggggccctgactttcttggccattcctgaattccacatggctaaggcaattgctgatacatgatagacctcaaaaaaatgtttgttttttttcaatcaatgagaaaaaaaggcagcgttttgaattgcaatggagagaatagggaaataaaagcttcaacccagacctcatccctggacagagaaaatcccatgtactgcatatatggacaccaagatgggaacacataccccacccttcagtgcattagtccctcattctgtttccaaacctcacccctccctcggccccacatccctcagaatgtagctcagtgtcacttctacggcccaccctgatcaacttgttcatatccctttaagcacctacctggcaatttggtaactgtagatttctctgtcaccccaaccctggaaggcaggggtgggcttctccatcccagggtcccttgcatcgtccctgcacatcacaggggcttggggaacacctgataaatgatgaggagagtggatgagtgactagcaaagcctggagtcaacttttgatgccctgaagtcaataaaatgacacaggatgaaaaggtcaaaaagtttcttcaacggctcctgcaggaagcatttgaggagaggaaatgatattactcaaacagcattgactgtattttctactgtattttctatattcttgatgctgtggtgtttggtgccttgatcctgtagggactgcccatcaggatcagtgaggaaaaaaagacagtgttttgaattgcagttgagagaatagggaaatacaggcttcaactcaggccctgcccctgaacagagaacattcccatctacatagagggacaccaagatgaggacacatgtcctgtccttcagtgtatcgtccccctcattctgctagagctagcaagcagctccctgtgagcacactcaccgaaccagagcccataccctaactaccttctctatcaaacttgcgcataccaagtaatatttccccggcctgccctaagtcaccctagagccatgtaccaaaaaatcaggggtcacccctacagctcagagcctgtcaaaattatcccaagtatccaattctaagcgtggggacctaggagacctgccctgcttcatccattccttgctgtgagaacccaaggaaggctctgggccatgctctcccctcttcctgctgctgcctcctgacgcatcgtggtgattccctcatggcctggtgtggcggccacaccccctgcttctgggaatctgtgagcttcagcttcttccttcataatatcacttcatgcgtgtgtgagtttaccatgactaattaaaacaaactcaagcatttttagaacacagatcctgttccgatgcttttttgcatcccccaaaaaataaatccaatgaggtcatgcattcgatatacctaagagacagtgatcaacttgctagacatctttctatgcaaataaagcataaaaatgatgtacaaatctttacttagccaaaaaaatgtttctggtggattttatgcaagaagatggaaaaagaaaatgatgatcatggttcaaaatgttctagtttcttagggttcaaagtacagggaaaaaaagaaagagaaaaaaagtatttaaaacagaaagaaaaaaatttaaaaaaagaaacaaaaagaaaataacaaaatgttcttgctagcttcttggggttcaaagtagaagacaaaaagagagagaaaaacatagttaaaacaaaaagaaaaaaattaaaaaaagaaacaaaaagaaaataacaaaattttcttgctacaaaaggaaaaaagacagtcaaggggcctgacaatatccagggaagagagagacacaatctgctcctactctgcagtcctgtgtgtgtttgtccatgtgagtcctcatagcagaccagtcagagaaaaaagtcatcttggcatcactttctagagttaatcatttcatttttcttaagttaattaaactatttttttcttaatgggagagcgtcatagttttcccctttcattctttgagaggtaaccatgtcctccctgaagtggcagaaacctctgttgactgctcctatctgaaaggaaatacagtccctctccccttcaggagaatttatgctttttccactaaagatgcggatattacttacattcctacagtgctttaaaattttgatgatctttcaagtccattttgtcatctaattcctccaataagcagtgatataggcagagtagagaatgtttttacccattttacagatggagctcgaagatgaggtaaaagactgaggcttggagataaggccactttttccccgttaacttgaccaagatcagctgcctagaaagtggtagagaggagacaagaaacacaaggcagcagggttcagcccctcatcagtagctagtttcaacatgtaatagtttcattttggctgggcgcggtggctcacgcctgtaattcggcactttgggaggccgaggcgggcagattgcttgaggtcaggagttcgagaccaaactggccaacatggtgaaacctcgtctctactaaaattacaaaaaattatccgggcatggtggcacatgcctgtagtcctagctactcagaaggctggagcaggagaattgcttgaacctgggaggcggaggttgcagtgagctgaggtcgtgccattgttctccagcctgggcaagacagcgagactccctctcaaaaaaaataattttatttgaattatctttctgtgaaagaaataggttctggctcccgcacttcctgtgcactgatcttatttgatggaacaaaatttgaatgtgctacctatatcataggctgttcagggataccaagaaagatagataaatagacagatagattacgaatatagatagatagacatagagctagagatagagatatcttccacctatctgctcactatgccagggtatccttgaagcatttgttaactcgacacagccacagcatagaagaaacttgggtcttgaatgactgcatggagcagagtctgctcttgcataggagccccaataccctgtattctggaccctgctgcatccactcgggctgaagaattcaagaaaaagccacctatctgttatagcccttccctccagagagatcagtgtattagtaatcgccttatttattttgactttgatagtattttttgttataaaacaactcttgatgttattaatgtgagatagtccgaagattgtttcttctcactgtataatgaaagcaactggggcagaaataaccaaaatcaaaaagtgcattaaaaacagatggctgcaggtgtcctattatctttcatttgtgttaattaaatttagtgttggcagataatataaagagatactcagttcaatctgacttttggagaaattacaatttttattagtacagttatttccaaatattgcaaatatgagaacaaataacccccaactcatagtgattcaatgcaatagaggtttatttatgactcatggaataggctgcaggatggggggcattggggcactcatgtgggggcagcctttgctccttgcagtcattcaagacccaggtttcttgtatgctgtggctcttttaagttcaataaatgctttgagaataccctggcatagtgagcaaacaggaggaggatatctgtatctctatctctgtctctatcagacctgtatctaaaatctctgtctctctctctctctcactctctctatctttgtatcactgaacagcctatgacataggtagtacattgaaattttgtttcgtcgaataagattgatgcacaggaaatccaggaaccagaatctattacttttattgaaacataattgaaatgaaaccactacttgttgaaactggctgctgatgaggggttaaagatgaaatctaaaaatacagtgtcattttattttgtataaaagttaaagaatattctgagtttgctgtaggtttttacttcttcttttatttctgcagataactctgaggttattttgtttcgatgtgttgttgaaacaaagcatagaaattattcagatacatagtatttcctgccagtagctttgtcatcaatctgactgagacacatcaccaaggaaaagcaaactttaaatatgaaataggcagtcttcattcaaaatatttataggcatttaatatggataaccactgtttcacgtataacttttgcttaattataattgagaaagaacagtaagttacgaagaggacggtgattctctctgtttcatgcctcccagcacactagcattaaacaacaggcacagagatttttttttctctgtaccatgttttgttctggttatatttattggcatgtaattttgtgtttatggaaacaaataataaaaatagaactaattatatatatgccttaaaaaatgtacagcttggcacaagaaaaaatggaaagaaagagaaaagggtctttcactagagaatatttgggagggaagatggagtgggtgctgccaggtggatgtgtggcggaacctttttgccagcttgtttcccttgggccttgggccactttgttttctctgaaagtgctttctctttagcagggactttggtagcatgagcggaacccctaggtgttcatggaaacctggctgtccaggggcttggggacaccatgggacacgctgccaccctctagtggtagaatagagacgcacttcaccaccagggggtctcctctctgtcattgttttccagcctcaaaaagtcacatcctagccctgcgctcatggtggctcaggcctgtaatctcagcactttgggaggccgaggcggttggatcacttgaggtcaggagtttgagaccagcctgaacaatgtggtgaaaccccatctctattaaaaacagaaaaactagccaggcgtggtggcaggcacctgtaatcccagctactccagaggctgaggcaggagaattgcttgaacctgggagacggagattgcagtgaactgagatcacgccactgtactgcagccttggcaatggagtgagatgctgtctcaaaaaacaaacaaacaaacaacaacaacaaaacctcacatcttttttggataacatgaaaaccctatacttaaacccccttccctgacccagagattcttagcggtgtctgtttgagaatcactgaatttgttgcacaattttgacagctgagatttggtgtaatcattgttgaggcttgtaatacaaaaagcaaaatttctttttgtctctttcacttgtcaaatacagataatactgtaaccctgaatatgcgtacgtctattcaatagttaccctcaccctagtgttccctcagaggggcacacagaatcctggttgctaagcattgctttggtgcatgctgaagatcccagtaacttcaagctctctttattttgaattgtatgtctactaaggggagtgacctgggttccagtgaaatggtttccactgcacctgctcctttcacttcctcccctgctctgtcctccccttgctcacctctctttcaatttctccttagcctgccttgcctttagcaggagaagaatggtgagaatagagagaatctagtcctgagcatggtcgacctgggttctgggcaggttacctgtgccatgcccttattctacccgttggcctgtgcagggaggtgagcactgaggaaagacaggtgtgttcactctgcccaggtgagctccgggatgggactccctaggagggatcgtggggagggacgtccaggctaccattcagggctggccatctgggcttcagggacatcctgacgtctttgccttgtcctgtggtctccacagagacagtgttggggctcccctgagttgctgtaattccacaagtggggagctcccctcacatctctctgcttcctcggccaaccctcctctccagctgccagggccctgtctacctgacacttggaccttgctgcatatttctcagcttccgtccacctctcccatctggctgtctttgtgtgtgtgtgtgtgtggctttgtcagttacggcggggtttctgggccacgtggtccgtgctgtttgagccatcctgagctagaggctgtaccatgtctctaggggaaggggtgggtatgaggcctggagaactttcagggctgtcttgcgtggaggactgtctacaaggtttaggagccgggataaaggtagtccctgcaaagcccggacagccacagcccacctcgggggccatcgagtgctacctgggaggtctcctccccatcatttgctcaggctacgtgttagtcaggttctccagagaagcagaaccaattccttaactgtgtggtgtggtgagccacaggccagcaggctggagacccggggaggagctgcaggccagtcccgaggccacctgctgccagaactccctcttgctctggggaggtcagtctttgttccattcatgtcccctcctcattatggaagaccatctgctttaccaatttaaatatttatctcatagtccaccaacttaaatatttatctcatctgaaaacaaccttacataaacatccagagtactgtttgtccaactgtccaggaaccatggcccaggcataacatcaaccatcaaaaggcatttctcgggtttgcgtgttctctggcgtctgacccccaaagccacattctccttgtcctcaaggatgggtttctggcccttggcagctttgagacagatttgaggtatttgaggttccttggaagcgccagtcatgccctggtattctgtgtcccgggggccccgatgctgagcatggacatcaggctggttcacagtcggtgactgcagcaccctcaccagcctcgcataaagcaggaatgtttagccctgtcttaagggtttgcttggggaaggaaatgatggtgagcaaggtaggacttttcacatggggagtcattgtgcttacattgtggattacgatgatcccatccgttttcagagagtgttttctctatttgcttattgccagggtctggtcctggggaaagaagcaattgggggctctggtgagaaggcacaggggctcccccagaagcaaggacagagagagcacggctgtgcttgctcaggtgtgctcagcaggctgcgacgtctgcagcctggggctcctgcgcctgtctctttgatgtgagctctacctctccttcaccatccaggctgtcctggggcaaactccaggtggtcacttttagctgtgtctctgggcagacaagtctagacaagacaccactttcttctccactcctgtttcctgagtgtacctagggaactacaccaggtcctcccccaggcacctgctccattagtgactggtggccatcttcacactcccggtgagcaaggaagtggcaccagctgggatccttcttctcaagccacacccagctgagaaggctgaagtaggcaccgcagcctgtcctgtggacttgaactgctccgctgctgcaggcgtgtcctgccaggtggaacaaaaggaagaacacacttcacatgcacagtgcacactagaatgctatttaattctgaggggaattgggtgacccttgactccctcctccctctgacttgttaattttcattttctagatctcatggactttttcataaagcttacgttttatattttacaatttgtattgaagcataatgtgcagagtgaaaagcaccaatcttgggagttcagccaggtatgttttggcgaatgtgttcacctgtgtgacgccggtccccattgtgacatggagcattcccatccagccccagactacaccttccccttccctgcctcctctcatgatctgctgcactgcattccctacacagcagacagagcaggagtcatgcctttcttctaaggaacatcctccagtgacttcattgcactgagaagcccctcctggcccttgcaggccgctgtgctctgggccctactacagctctgactggtcctgcagcccccaatccctggccttcttcgtggctccgagcacaaaccccgtcttagcacctcagggcctttgcatttgctcccctgcctccatttctggaattctgcccctgagatctgcacgaattgagccctttcatcatctgggtctcaggtcaggaacgctaaccaagactctgcccttgaccaaactttagtcaggctcctctgagccatcttttcaagtaggtcctgtctgtctttggtctgtccagccccatcttagcaaagaatcctgctaggtcacccctcgactttctaggccatccccccacttgctaggccaccccctcacttgctaggccacccccccacttgctaggtcacgtctccccttgccagttcaccccccacttactgggtcacccccatttgctaggtcaccccctcactcactaggtcacccccacttgctaggtcacccccccacttactaggtcacccccacttactaggtcaccctccacttgctaggtcaccccgtcacttgctaggccaccccccttactaggtcaagtcaccccccccgcttgctaggtcaccccccatttgctaggtcaccccctcactcactaggtcacccccacttgctaggtcacccccccacccttcctatctgactgtgttatttattccccacctttgatgtctaagtctctgaccaccgttatgaagaatcctgttaggtcccatagtcaagttttgagacagctgccacaaggttatggaggaggaaatgaagcctccattttcgtgctgggtttgtcaagtccattcaggtagaaagtggcaaagtcaggcttggaaatgggttttgtgactccatgtttctcctcgttcagacctgccttggagaacctttccctccacgtcttctgtctgtgttttagagaactggaaaataggccactttaacatggtctctcctacaaagaggtaagaagacccagcagaagggcagaagaactgggagtctggccagacctctggatgaatgtcagggttgttgttatacccaggactgttgtcaccctcttgtctctggacatagtgacaagggacaaggcaaagagagagggcctgtgttcttgtggacatgtggttggcaaggttctggccagagtcggaagggccaggaccccacgttccttcctcctatgtttgtatcccattcaaaccaagattaaaattctaagccctccagccaactgaatggacgcctcctctcagcccaaggcattctagtgttaacctcaaacactggttcaggccatgatgggacgtggggatcaggaatacctcatgatatcctcctcccattggaattcaggcacagctggccagcattaacattaaaacagagtgcctaaggccacgtgcggtggctcatgcctgtaatcccagcactttgggaggccgaggtgggcggatcacttgaggtcaggagttcgagaccagcctggtcaacatagtgaaaccctgtctctactaaaaatacaaaaattacttggcgtggtggtggatacctgtaatcccagctacttgggaggctgaggcaggagaatcacttgaacccaggaggtagaggtttcagtgagccaagattgtgccactgcactgcagcctgggcaacagagcgagactccatctcagaaagcaaaaaacaaaaaaacaaaaaacccaaatcctctcttctctcaacatcctctctaccacttctctggtctacatagaaaactctttcgaagagctagtgttctgagatacgacttgggtttttgtttttgcatctgaagaatcctgaattatcaaacaccagaaaagcacaaacacaaaagaacttgctgaaaggactttatttgagatgaggaaacaaagttgatggcaatgtataggacacacgacagtttccttctaggtcataaagtaaattatgaatatatttctctctgttctcatccctcagaggcagcagaatctgtggttaatacccatgacagtgcaggtcccataggaatattctgttgaataacaggaccttctgcaatggcaagtgaaagcccttgttgagcctggggacagagagagagagcatcagaaattgagcaccagggtcagcagcgggcagtaaagagaatcttcaggaagttgcatgcttgctgacatgtaatgctggctgcattacagccaatagcatgatcacaccatcaataggaataaatacgcagagcagtgttggtcacacacaggattagagagccattctgatatgctgtacttatctgctccttccctgtcacacacacatctgaatgcacccatatgactgtctccagtttgcaacggttcctataaaagtcagattaaaaaacattcctttagcagctggatgtggtggcttacgcctgtaatcccagcactttgggaggccaaggtgggtttatcacaaggtcaggagttcaagactagcctggccaagatggtgaaaccccgtctctactgaaaaaaaaaaaaatacaaaatttagccaggcttggtgtctggtgcctgtaatcctagtgacttgggaggctgagggagagaattgcgtgaacccaggaggcagaggttgcagtgatctgagatagtgccactgcactccagcctgggtgacagagcgagactccatcaaacaaaacaaaacaaaacaaagcaaaacaaaacattcctttaaaattaggctctcttccttgaagtagagactcctcaatacatttctacatggcaaaaaattagaaaatttcatagacttatcatagaattaaaaaatctttagagaaaagtcatgccttgaatatcactgattcttccttttcagtacaaacataaagtaattgaggcctggggaggtgatcacctaagagaaagagccagctgttggatctaattctagaagtgcttggttttcctctctacactcctagctctgcaatgctggtgtctcttacccaaagctctaagacttgagcttgcatcctctgcaaaggagacggcaaagtcctggtcatttgccccacgctgctcctgggcatcagcctcataagcttttgcctgcagtggatcatcctcagcttggagtggctcagccttggcctggagggccacgaggagaacagcagtgaggatggtgagggttctcatggctagggtcgctggaggagagagagcaggagcagatgtgtggggagtgaggagccagcctggatttataggtctgctgggagaaggctcagggacagatgttgcggtgagacggggagtgcatgtgattggggagcagaagagctacccttgccctccatgtccctttgatgctcctttgttctccaagcttcattgtagtgtgaggctgtttattgagtgtctgttctggtcccagctgatagtgatgataagaacagtgttacattgtcctgttttccatctgctggaatatttacttgttaatattcaaaaaagaaaagaacagtgctttcaatgaataatttcaggaatcaaatgcctcttattttctgaaggtggggctggccactctctggaggtctagaccttgaggccagagctggatcccgctagagtagagagttaattcattgcaggattcagggggcatttctgccctcatgaaggaggctttgagattatggggtgaataggctcttgtggggcacagtgtggagaagataatgaccttatcagcctataagggaaaagaactcagtgggatactaggtaaagagttagtaaaactaaagccaaaagatttatttcaagaaacccatgtgatctgaatgtatcaactaaaatatgtactaggtatttctctccactttgagaaacatcgaaacaattgacatgcccacaatccccctctgaaattttattttatttttaattttagaaaatgttgaattgcccacaaggaccattcaaagggtaaaaggagtaatgagcctccatccttgccccagccctgcagctctgctccaggaaatctccacttaaaaattaaacattggtttgtgctttgttttttctccctaatgctgtaatttgaatactttgtagctcaaaacatatagaactctaccattattttcatagtctcttgtttctggtcttctattcaggtattttatccattttgagttaagttttgtatatgccaaaagagaagggtccagttttattgttttgcatatggaaatagtattcccaccaccatttattgaagagactctcctgtccctattgtgtcttcttcatgccattgtcaaaagttacttgaccatatgtgtttcgatgtgtttctggactctcaattttatttcactggtatgtgtctggttttatgccaataccatattgttttgattaccgtagctttgtaatataatttaaaaccaggaattgtgatgtcttcaactttgtttttttttctcagaattgttttgtctatttgggttctttcaccatttcatacaaattttaggatttttttttttatttctgtaaagaatgccatggggattttgataggaattgtgctgaatcggtatattgttttgtttgggatagacattttaacaatcttaattcttccaattttcagcccaggatatctttccatttatttttacattctttaatttctttcactatttttttttttttcattttcagtgtgtagatccttcacctccttgtttcttcctaggtgttttattttttgatgctattgtacatggaattgttttcttgatttttgtttcagttttgttagggaatctatgggcatttaaaaatgcatttgttctgtatttatttgaattttgccttcatttacccagcaggagatgaccatttaactaacatctaaatttcgaattaaactttccctctccaacccaaactgtaattgtccattgtgacttatagctgtctatgcctctttccccagtagttcatgggacaggcaataattactctatcacctggaaatcctaccctggagctgttactcagataccctgatctagctaacaggacaagatacttctgtaaataagtgatctaatttgtcttgacttaaaggagcattttggaattgtatgctctatctttggaaactaagaagtgttcccagcctattttaattgaaatagaagataatgcagaccaatccccatgggcattggtaaatgtttagacagatggggtgcaggaaggcttatcaggatccatatcgcagcttgtaaagtcaccacaatcaccacgccaacagacggaacgcctggaagtaaacagaacttctagaacagtagaacatcaaagggtgtcagggacaagggaacttcacgtagttcctttccctctctctacttaccttcctgcccctagagtcacatacatgcaaatactgaagcacaagctctattttgaagagcccatttactctaggatccagctttcaatgatcatgcacaaaatcgaggcaggtatatctcccccttgtttagccatcaggctcctgcaagagaagtaacctccctaccgtgacccgcagtcacgaggacctcatctctgttaactgcctttcttgagttaaccccaccccactcccacatggaagccctaataagaaccgagcatcttggagatgccaccgagatgaagttgacttaggccaagggctgtctctgttgtcctcagtggctccagcatacctccaccctgagatgtcctcacacatcagacgctgacctagcagagcccacactatcttccagtaaagaagaacctgcccttacagagaactgggcgcgcagcactgcagtagcaccttaaggacagcaggtggccctcctgcccttaaacaggagttgacccaagagggacttcaaatgggagcgctgtaaagtgctgttcagcaaacacattgctttcttctgcaccccaaagtgtacatattacaacattagttcagggggcacagaatacactgctgctggttccgtgtcagcggtagctgctggccctggaaggctggcctgccccgtctctaacctagtgtcatgatgtcgttcccccttgtgctggctgcggggctgaggacctgagtctgggggcctctgctctttctcctgggtggcaatgctcctgtccctgcctccttcccagtctgtggtggggactcgacagccagggcaggtcaggttctcagtctgtgctgaggtctcacctgggccttgcctctgtctcccccaggtggctcccaaaccccaattagaacagagtgagtctgtatctcgtggtccctttcacctttctttctgggctgcaccagaaccttggcagaaatcagtggtttaagcaaaaaatggtgctacatgtaaaagtctttgcaacactttcacttccacccccacccaccctgcccccagcacagtgtcctggacttgccaccagtgtcaactctgagtgtagacacaactgaaactgttccttcatacacatgcagttcagctttcagacactcaacaagagccttgacaccctcaagctggggtaaatatcctggggaagctacaggtgggggtgcaggtgtgggtgtgagaggagaaaggccttcagcagcagcaaggatattcccacactctctgaggctgtctggtgaccccagcagacacagtgagtgtggaccttgggcagggccctgggacatggttttgacccagtgtggaagggcagttttggaacagagtgtgtgtgttagcgtggggtagagcgggggctgcgtgggggtgagctctgagaactgtccatctcccagcccctgagagtgcaccgccctgtccctcccctcagccttttgtccacctccctgcagggagggtcctggtgctgcctgtgccacacagcaactcccgggcctgcagatccagctgggacaggcaggagctccaagtcccctgccctttgtctgcctttcccagccgcctctcacatgctgtctatgtgtctggtgttgttgcctgcagcaatttttacaaatgactatgaaagaataactctcttgggctgttttaaaatgtggtcccaattcttggactcttctcccacagaaagggaggtttacttctttcctgttggatctaggtcgggtgacatcttcaccaatagaatgcacctgacttagtaccatgccgtttgctgggcccaggtgctaagacactggtatttttcactttcaccgtcttggatggcgctgcagttggaatatttttgtccctctgaaattcatatattgaaatattaaaccaccaggtgatagcattaacaggtggtgcctctggggaggtgagtaggtccggagggcacctcatgaataggattagtgtccttatagaagagatcccaaggagctccttcattccttccatcaggtgaggacacagtgaggaggtgccatctatgaacgaaaaagctggttctcagcagacaccaaatctgctgccaccttgatttggacttctcaacctctagaacactgaaaaatatatctgttgttcataagcaactcagtttatggtatttttttttaaatagtggctcaaacggactaagagggctggtcacttgggggcccagacaccgtgttttgaggaagcctcagcctcgcacaggaagatgaactgagggcacctgcgagggtgagctagagaacacagaacagccagctttctgggaaaaaccaaaactctgatttacagtgtttgtaaatttctgtggttagaatcctcccagctctggaccgtttaaaaaatgtcacacaaaccacctttctcatgagccggcatgatctggccccagcgcatcacaaggtcccatccctcagccctgtgagagctcccagctgagccagcactgcctgccacctgtgcgcgagtgtctcagccctgagctcctcagatcccagcagaacctctcctctgagccaggcccaaattgccaaggtatgagtgaagacctgatggtgctgtttcagtccactatgtttgggatatctttccacacagcagtagatgaacagagggcattgtcacagtcttggcgagaagttggacttgtgcatttctgcgtgtgtaaacttctgcttctccaaaatattggcgaagtaggactgaatcctcttaccttattcccaaagtgtcacaaagagcccatgatggtgggagcatgagattgtggactgtttggagtgaccgaagaaccctctcacccattcctagtttaaattcttcccgctgggagcaggggtggtgtgggagccaggtggggtctcaacctctgccctcagtaacagactcagaagaggccataggactcaggagttggctgaaacaacagggaaagaagtagggattttctctaggagattagctgcgaagggcacagagagatgaccatgaatgacatggctgtcacctggggagagatcccaaagtaagatcaagagaaacaaaggggaaaaaaggtaaagacgacaaagtaactcatgctttgagtccttggaccaagcatttcctaaagccagaattccttggtatgggagtgaaaatgttgactcagggctggacaaggtagctcagcttgtaatcctagcactttgggaggctgaggaggaagaattgcttaaggccaggagtttgagaccagcttgagcaacatagcaagccccctgcctcttaaaaaaaaatggtgactcagcttgacctgatttctaatgttttactccaagactccactaagatgcctgaaaaagatcaaaaataccaaactcggagagcctgaggcaaagacagtgccgtgcacaaggacaggagatgagagcagatgacaagtgtcccaatgcagcttgagggcagatgacaggtgtcccaagagcagcttgggtatcaggctccctggtgattcccatgcacagcccccgggagaacagccttattgatgctgatcagcagggaaggagggacggctacattagaggctggaaggacagcgggtgagtcagggatggggagcttcatagttgatgttcagaaatggaggaattccaggtggtggcaggagctagtgggtggccatgggttggagggctgggacaaagagggagtggggtcactgtcatccaggcggacaaagcactgagaggctgggagggtgaccggccaggtaacattacagtgaaagaccgtttcccgtaatcttaagtttctgagtgagttgagtggctttgagcagcaaaagggaaaaatacataggtttagaaaagagaataggtagttgtctgatgtcttccattctggttctgcttgtaagaagagttcaagttctcaaacagagaaacagaagagaaaaaaatggctgtcttttattaaaaaaaaatcagaaggcttttaagaaatgtcaaggaagtatttattgaacactgttgaaataagagtcaaaacgctgcaatagggtgagccgttgaactcaactgtcctgaagcccaaggcaggaatatgtaggccctgggttaagctagtggaaaagttctggtggttgttggtggggaagttgagcagtgtgattgggcaatctttgtttgctaatttattaggagataggctcctgtcttcccacagagacaaggctgctatccccttgagtaattacatttatagggatgaggcatctgacttactctttattgttctaccactcaagtgattcaaggtagaaaatgtcttgtatgtcatcagtaaacatagagtgcatccacatgaacgtttctgggtctcacttgaggctgagcaacttgccctggttgtttggagaccctcacacctctccctgcattctctgtccccagagtttgcagctgtcatagcccaccctagactgcagtagcagaagccacatgtggtgctcccagtgtgtctatccacacagaggagcagggaggctccttcctcgtctggccctttcctttggattgatggatgcttctcagcacatcaacctgaattctactccatccttctgtgttgcaacagcaattcctcttaattcaatggaggttgacctcctcctgcatagctcttgccctgattctacattctctacctaattttctgctttaatcattcttttattctattgaaagtttaaacatctttatgtttcagtttaagattcaccatgaaatctatccttggcattccatgacagaatggtcttttcctacttccaaaagtcctaatgcttcattaaaccacattttacccatcatagtctcctatattttagtctttttaattagttttaattagtcttttttaaggaatgttgtcacatggactagacacacgggctgctttacctctgtaggcttcagtatttttttcgtaaactcacatactttggagcacagaagtatccctaagcccatgaacgtgtttgaatgctttctctgcatgtgaggctccaacctttccggccacagactgagtttgtgctgaggcatcattagctggtttgtattcatgcctggtcatggggaaggccacctgcctctgattgtgggggttgctggtgtttaagctttagtgccatgggtcccattcaatatctaaggatcgggtttcctggcttggatccagtcaggtggcatttggggttttgcccctctagcacattgcctcaacatgccacagttttccagcctggggttcaattttgtgtcaatataaattttgagtacaattaattaatttagttgaaattaatttattgatcatgtgcaacgtattaggtggtcatctatgcactgtggtaagatgatgaggaaaacatgcagcttccctcccagtgttgggagacaaatgttccagagagtaaatgaaatgcacagatgtgagatagcttacaattctacagttaaaaataaagagaagagggggatagaggtcaccagggggaactagttgcaatttgaaattaagaaatcagcaaagtcctcagtgacaaagggaagttctagcagagaccccaggatctagggcgcaagccaggtggacttctgggaagtgcagaaaccgcgtgatggagtcagccggactcagtggacggttaggagcaatatgcagagttacagcaagaaccgcgtgacttcaagtcagtggcggttacaggaacccaaggaagactgtccccctttcacatcctgaaacccaaaatgtcaccttcaccttcaatacaaggggaagaccttggaccatttctttgtcaatcacagacccactgtgtcttccctgggacctgtattgggttccccagctgtgaagtgtctcagtggggtgcctggacccctgagctgcctcttcagacaggcagagcctcagtctggggctgagacctgctcagaatctgcatgggtagatgtggagaacacctgcttccttctcctgggctctgggcattgtgggtggttggtgttggtggtcacagctgtgtcttggcccatcagattgttttggtcaagaatggggaataatcctactagaatcactgtccctttatttgcaaactgtagtttctctgtcactcttggaagttgtgggggcattctatgaatgaccctccagataagaggagccatggcttgaacagagaaggtatttttccaagcatgtgtagtggattcataaactggaactgctagatccaaaatataagaaatctgtgggccaagctggacttgtccctggagctttgtgatcatgtcctcataggccgttgacaagacatcctcaactattgttaaaggtacagtgggtttctagggtagggacagagaggagagacaggaagagaggtcacatcacaccccagcaagatgtcagcctggccctcagggacacccgggttaggcagtgaccctgttctcttggaggggaggaggaagacaagctcaggaaggtacagaccccacgtgtgctgtgcctgatggggaggctgcagttgaaggtaggacagcaggggacgctgtggcctttccgggaaatgctctgagcatctcagagagcgctcctggttcattccctttccctagacctggtttcttgctcactcactgatgtgcaggatgttgtggttatcagagccgcagcctgcagcaacaacaggaatgtaaggtttctggtgaagctgtattttcccagcagaatcaggttctcagcagctttaaggcaacccaagagagtgcgcgttgcaaagtgtagtggagcatttgtgtgtgtgcgttttctgggtgtgaagacgactttatgggtgtgaaatccaggtcttcatagacgtggctgaagggtgctcttaatgaggacatcccattgtgggctgctgtgttttgtgttccatgcaccccgcctttgctaacaacccatttccctcttaattaaagttgtttcagtggatctcctataaccctatgtcttaaaaggcaaatgtgtgacctggacatgttcaataaaactccaatattttgacgcagaggatggtggtttttcccgagaagtagtgaggttgtgagtagctaaactggaagctgacgttgattcttttgcctagtatatgagagttgtctttgagagtgaatccattcaaaatgaggcagaatgaaaagacagagcagtggatggtgagatcagtggcatcatttgtgccttcgtttcagtttgtgtctgaagccatggctcctccttaaaaattctagattttgaaactttaatttgttccaaaatattcatgtaggattctggcagttgctttctagtgtcttgacacagacacatatcaaattttaaagaggtgtaaacaaagacatcttgttacgagatatatatttaggatcaagaaagatgttaaggacaaagtataggagaaacaaccatttcctgtagctctcaaagcaaattatgagctcatttttctctattctgcaagctcagctgcagaagcatgtgaagctaacaccaccgatgatggcgttcccagcatgacattctcttggacagcagaacgttaatcgacacgcgtgcagcagtatgtgaaactcacaccaccaatgaggcagttcccaacacgaagttctgttcgccggcagaatactaatctgcaagagcagaccatgccccttgttgagcctgggaacacagaggaagcatgagaaattaagcaccaaggtcagcggtgggtggtaaagggaatcttggagaagtcacatgctggctgaccggtgatgctggctgcattagtgccggtagcacaaacaaccttagtcaataggaataaatacacagagcaatgctgctcatacaggatttgagactcattctcttttgctctgatttgtgtgcttttgccccatcagacacacacctgaacatactcttaagcccatctccagtttttaaaatttcctttgttggcagaatgaaatattttccctataatatctacttgtttagatccagaaagaactggtcaatctgtctctccgtatcttaaccctagcgaattttatagacataccttggaatcaagtctttggagaaagaagactacttacatttgtttgtctctctattcagtttggagataagaaaatcgaggcccagagatggtaagtaaagccacctaagtgacatccaccattgagatgtgattccagagcccatctcccatccgtctctctagactcggtagcttttttatgctggcctctctcacctgaaacctgaagagcagagcttttatcccatgcaaaggaaatagatatgtcctggtcttctggcccacgctgctcctggcctggagcctcatcacctcttgcctggagtgggcctgcccggacctggagggctaccaagagaatagcagcgaggagggcgataatcctcatggctggggtgacctggaggagggagagcaggagcagctgtgtggggagggagaagccagcttggatttatagctttgctgggagaaggcacagagataagaaacctttggccttctgagtgagaggaggtgtgcattttgttagagaggatgccgactcctattggccttgacatccctggaatgctcctctgctctcccagctttcttcacaggaagctctatgtttagtgtctgtgctaggttgaagttgatggtgatgatgaggaccctggcattttttcctgttttcaggaaatacctaatatttcctggttaaatctttaatattctaaaaagaatggaaacagtgctttcattcaataatttaagagagcaaatgcctcttatttcctgataatgggccctactattctcttcaggtctaaacactggtgccagacctgtattccggtggagtagagagtaactcattgcaggcttctaggtcattataccctcatgaaggggcgactgaggtaatggggtgagtagtctcctgtaggggccagagtgaagaggacaatgaccttatcagggtacaggtgaaatgagctcagtgagagagataaagagttgtgtaaggttcatgagttgctaggtgcatacacgtggtcctttctctcacagcatgtaaaaaatcagctcaacatggattgaagactcaacatagacttgaaaagacctgaaaccatacaactacgagaagcacatacaaagataaagctttggacattgacgtgagtaatgatttcttggctatgacaccaaaggcacaggcaataaacaaatgggaaaatagacaagcggggctgcattgaacgctaaagcatcttcatagcaaaggaaacaatcaactgagggaaacggcaacccagaaaatgagagaaaatgtttgcaaagcctacgtggtagaaggggtaaatatctgaatacataaggaagtcaaacaactcaatagcaaaaaacaaacaacctgattgaaaaacagacctaggacctgcagaggcttctctcacaataaaataatgttttaagaagctgtgatcgtctttattggacatgtcaagtaggacacgtgtgtttggaaggaaactttttgagtttctctattgacttagctagtagccattacccccagcagccgccagacacccagatagaagttcacagcaggggcttcacccgctgggtccctctggggtggccccacagtgagaggtcagactggggacacagcttcaatattgaaacctcaatgtgaaagtttaagttttgtgttacttacagatcctcaagctaggcagggcgagcagagagggcagacagcagtcctgtgttccaggtcttatgtagcaagagcagccatgcacacagaggagaggacttccttatttaagggtcttttggtatcaggtgtcctaatttttcagggttactttctattgggtactttaaataactgttaacaagggcagttgagaaatttggcagaaagctggagttcaagcaggagtccacggaggtaccgacccctcgtctactttggtcagccctggccaggcccaggcagcaatcaactatggattcctcatgactcctaagacaattgaccccatgatacctatgctggtggctgaggctgaactacctggaccgagggaatatttaaagccaccaggagagcctggcctgcatattgttgtatacaccttgcgaggagactaggatcaaaatgccacccacacacagatgaggatttggaatgtggtctgaactgacctccccaggccctggggtctaaccataaaaacaaatccaagccattcagacaagtaaggttggagaatacctggatgagactgaataccgcctgggcttgtgttgctggatagggcaggttgcaggctcccgagtaaaggatgtgcatatagcatgtggttccctagaggggacagtcacctttttgcttggccttagatagttcaagcctaaatgactgtctaggtcatccaggccaaggactcatcaaatgattgcgtgacacctaatgtctgtcagaagtcccttaggatggtggccaaagctgcagcgagattggtgttagcttgcatcaccttgtgttgtgagctcaaataccctgttcccaaaccaatcccgtaggcttacgagtctccctacacccagagttaggaagatggtcactgggtgggggggatgcataagctttcccttgtgtggtccctcctgggttatttgaaggggagtcccagggagactagtgcacattttaaaatgtaccactctccaccatcctcctccttgtagtgaggtaaacgggatgaggtttctggaaatgagaaaagaatgcagttgttcctgagggaatgaatacctatagtgaggttgctgaacccagtatgcagtccaggcagcccctgccgccatgggagggccgtgcacagcgctggtccagcaggctgggtgctcagggcctcccctgcagctctgcgtgaaggcagcaggcactgggctatggaggactgggggcagcggcgctctcagtcttaaggagggaagaggcatctcaagcctcgctaggggtggtcgctgttccagagcagtgaagtcggctgcccctatgaggaagcagtgagttcctgatctgttgcaggcccagcaatttcacctttggaggaagtgggcactggactcattccagcagaggaagaaattagggctatttggggaactgggccccagatgatggttttaggttctagggcattagtaggtgcctgaagggcccagtggatatggatgtagaggcaaaatgagaaggggtgtgtgtgcacgtggggaaggtctggtggttgtggggatgtccagtgtcctgcagaagtgaaacctggaccagcctcctgcacacagaacacactccaatccataggcattttcctagtaacataggagagagctgttattggcagagctggttagatttgggtgtgatattataacagacaggtcttccaagtccatattttttggcataacttgtagggcagcctcctgatctgatccaagccttgtggtttccttgcagtaggcggtttaactaatgggttacactgaagacaaatggggatcccagcaaaataccattctaaggggtcatctgcagggtcctcaggaaagcatgagctaagaaagcacgggtccaggtactggacgtgagccaactccatgtcccgggggtggtgagatccataccttgcggcaggaaggagagtaaggtgagtctggtttggggatgaccccacagtcaagatgagattccttggtgtctctggttctggtgaggccactgtttcccaggacaaacccttggatcagagcactgtcttctgaggtgatggcctttcgggtaggggtggcctttccagctggtcactcaagaagagagagggtatgggctggtgttgcacaggcctctggcctctgtgggactccatggaagcgtttagtgaaagcttgagtggtgctttccttggtcgggggataggacatttccatccacaactcacatactttggagcacagaagtatccctaagcccatgaacgtgtttgaatgctttctctgcatgtgaggctccaacctttccggccacagactgagtttgtgctgaggcatcattagctggtttgtattcatgcctggtcatggggagggccacctgcctctgattgtgggggttgctggtgtttaagctttagtgccatgggtcccattcaatatctaaggatcgggtttcctggcttggatccaggtcaggtggcatttggggttttgcccctctagcacattgcctcaacatgccacagttttccagcctggggttcaatttctcacagtggctgtcctgttccagcagctctctgggatgccaggccccaggcctaagagcagccgtacaacatttacatacataagatacccagcaaggccaaagatagagagcactgacagcttataactcagggatttcctcaaggtacttttacgtcgatattgattatggggtgggctttcaccaacatttcttcagagcatttttctgcaatcgacacaggacatggtgatggtagttccatgtggtctttgtctgatgtagttggcgtcctctagtttgatggctttttctcctcatttagtgacccagactgtaccctctttgggctgcagagaaacaatccccacttccttcagggaggagtgagtgggagatattagctacctttcaaagcaggaagaactggagcttctgctggaggctgtatgtcaagaggtgaggtctggtgtagcagaagcatcttagggctgctctgtggcagctgcctggaccatcagtccccagaggatcacagctcactatctgtattagtccattttcatgctgctcataaagacctacccgagactgggtgatttatgcaggaaagagatttcatggactcacagttccacatggctggggaggcctcacaatcatggtagaagacaaaaggagcaagtcaagtcttacgtgggtggcagcaggcaaagagagagcttctgcagggaaactccctatataaaaccatcagatcttgtgaaacttattcactaccatgagaacagcatgggaaagacctgcctccatgattcaattacctcccaccaggtccctccaacacataggaattcaagatgacatttgggtgggaacacagccaaaccctatcactgtccatcctcgatcgagtctttagtaaatgtttgatgctgagacagtggacatcttgtgatggtatgagggggtctcattattgcagaaaatgtgggtgatggtatccataagggaaaaagagctcaactcttctgtgatcaccagggtgggtgccatggttggtctggtccaattgtagaagagctggtggccatggtgttgagaattaagatagttaaggctctcaaaggagcttggttcccttgatgaaccacttgtagggggactggagcctttcctaatttgacttagtctgtgctcatgccacaactttaataagcatgactttaggaggccactgtgttgcttgaggaggccagtggctaagtgagggtcccctaacccccatgctgagttgcccagcaccaccctgaagtgggagccctgatctgcatcagtgatatctggtggttcacaagaggtaatagagcaaatgtcacagaaagagagcacctttctctaccaagagccttgggttggaagagtcaatggaagtgcggtggatgtgtgtctgctcctgcacagcagaaggtggtggctgtgatgggagaggcccagtgaagtccatttgccaccagctgaaagggtgatggcccaggaacaagggattgctggccacagttttgcttgcctgaagctatggtgggagacagctgtggtgtgggttgccctctaatgtggctgtagctctcatgatctggggctgtaggactccactctgtcagcacctgaggaatacagaacttgagattctggagtctgtaaaaataagaggatctcacccaagccctgggaggtgcatctgaccgctaacctcctggggacaggacatcaggggctgtcagcaggctcagtctggaggccaaagatggcagtcgtctcactgtggatgcctcacccttcgagtggtggaaagtagcctgggcatgtttgttctgaatgcatgaggcatgaatcacctataggaggactggagtgtcccctaatttgacccaaacaggtccacgccacagaggccattccagaggcattggatccagggcactcacaatatgttgggcacagcccaggaatctgtaaaaactgtccccgagtgggggttatggccacagcaacctcccctgcaaccggcaccaccagctgtatggctgggctcagcataccctcccctcctatgcaggccctgctgtgataaatgtgggaggtggttgccggccagtgggctcccggcctgcagggcagtgctgccttccctgaggtatgtggactccccatgtccaactcttcccatggcctcatcaggtcaccaattgttcgggcaatagggtcgctgctgctatttctctctgcttgtaggcaggagctgaataacagggaaaccatggcctcagcttcctgtcacttgaaaggacttaagtgccaggtttgccttgtcctacaagtgctgttcccattttcccagggagacatgaatggctgagcctctgtcaggaggagtcagacatggggcatggctggagtctggggacacagcagcaccggaacctgtcctgtagtgcctatgtctatacgggcattgtgtgtagtggtagccagctttttaacgggggataatgagctgcagctgccaggaagtttatgcctgcagaagcccatagccaggatggacgtgctttctccagaggctctgggagtcatgattggtggtactgagggcctctatatgaaactcagaacccgggacctgggcatggcctgagagaccacctgctgagccagctgcatgctgtatcctgctgtggccccagttaagacatggagggcttctgggtgacagtgtctgtgggcctctgcagaatggacaagtgaggtgtaggtgcaggcggaatgtcccagtatgcgcagggcctgccacaaagtggctggcaccctaatggtgaagactttggttttaactgcaaggtgaatttggtggcccactgaggaccaggttatctctagaatctttacagcagtgcggggcctgaactttgtgtgggttgtggcccagccatggtcttggaggaagccactaaaatgaccagcatggttttcacttccttcttctaggggcttctgaggaaaatgctatcaatgtaatgccacaaggtacaggggttcacactgaatcacaggaagtcccgggggcacgagttatgggcagtagctggcttactgagacagcctgagtgcaatttggtaaatgtgcactgggtcccttccaaagtcaaagcaaacacagactgcgacccgtctgtgatgggaatgggcagaatgcattggccaagtctcctgctgtgaaatgttgtgccctgggcctttgtatgccctctgttaacttgactgtatctggaatcagggccttaatggtcctggaggacaatctggtggctgctctacttggattccagcgccacagagtggcaagcactgtttccgtcttatattttagtggaggagacaaacaataggcaaagttatgatgggtatgatacactatgcagccagtggttattatacagaataaaaggataacattgaggtgacctggagtgcccaggtgacacggtgttgggggcagggtgctgctcaatagtgtcaccatggcagcctcattgtggagagaacatcagagcagaggccaggaggggctgggtgagtgctgcagaaacctggatgggtccaggaaaagggagagcaggtgtagcagccctgcagcaggagtgtggcctggcccatgtggtggcctcaccagcagcacccggagtggtttcaggaggtcaaagagaacacatgccctgcaggttgctcgagtcagtggtggctgctggtgctgccttttccatccccaacccattgtcctgaggtcattccctcccatgcatggctggaggggtggtaactgtaggctggggggcgctactctgtggcaggggcggactcagcagcccagggcccgtcaggttctcagtctgtgctgaggttgcacctgtgctttacctccttctcgcccacgtgactctcaaactccaacccaaattagaagagagggattcatctcttgtggtctctttcacttttctttctgggctgcaccagaaccttggcagaactctaaggtttaagcaaaaaacaaaaaaagctgttttgtctaaaaatctttgcaacactttcgcttccgtgtccatccatgatctccccagcctgagtttcccattcttttcaccagtatcgactcccaggcacagtagacgtggctgaaactcttctctcatccacatcgtcttgaatttccagggaatatttaaacgagtctggacacttaataagagcctcgacaccatcagcctggacaccgtcagaaccttgacaccacgttctggtgaagctgtgggtgggggtgcaggtgtgggtgtgagaggagagagaactccaggagcagcaaggatattcccacacatgctgagggtgtccaggggccccagcagacccagggtgtgtggaccttgcgcggggttctggtacgtgatttcgtcctggtagggaagggcagtcgtggaacccagtgtgcacgttagcatggggcagggtgggggctgtgtgggggtgagctctgaggaccggccacctcccagctcttcagagtgcaccaccctgcccctcccctcagccctttgtccactgtcctgcagggagggtcctggtgctgcctgtgccacacagcaactcctggacctgtagatccagctgggacaggcaggagctccgagtccctgccctttgtccgtctttcccagcacctatcaggctgtctgtgtgtctggtgttgttgcattttacaatatactatgagagaataagtccattgaacagctttaaaaatatgggccctacatcctgcatccgtggctcttcccaaagaaaggaatgtttatctcctctcctcttgaatctagtctgggtgatattttgacaagtaaaataatcctgacttagtgctatgttctcttctgggatcagatactaattaactggtatctttcacttcttcagtatgggatggtgttgtggcctgaatatttttgtccctatgaaatccatatgtttacatcttaaaccccaaggtgatagcatcaagaggtttgggcttttacccagtgatgagatcaggagggcacggtcctcatgaatgggatttgtgcccttgtagaggcgaccccagagcactacgtcattccttccaccaagtgaggacatgtcactgaacacaggtcccgctgctcgccacgtgcagcagtgataactggacggaggtggggtagaaagagagcgactttattaaccaaaactactaagggggaaatggctggattcacatcaaagcaaccacttcaagtttttggggagaagacaagagtttaaaaagggggacttcacatgggaggcatgcaggggttaagctgggcgtgaggtctttgtgtcttgtttcggtggctaccttgggtctctgtccacctggcccatgggctggtgtcctctccacaatggctgcgctgttgactagaggccttgaggtaatctgtggaatattccaagatatagtagtcaaaatgttaacttagctcatcatgctttctgacactcgaattcaagacccaactaagatgactgaaaaacatcacaactaccaaactcagagaacctgatggaaacacggtgcagtgcacaaggacaggagatgagagcagaggacaggtgtgccgggtgcagcctaggcatcaggctcccaggtaaattatttgatgcacatccccgtgggagaacagccttttttttttttttttgacagagtcttgctctgtcgcccaggctaaagtgcaatggtgtgatctcggctcgctgcaacctctgtctccttggttcaagccattcttgtacctcagcctcccaagtagctgggagtacaggctcctgccaccatgcctggataatttttgcatatatatatatatatatatatatatatatatatatatatatatatatatatatatgtatatttagtagagatgaggttttaccattttggccagtcttgtcttgaactcttgacctcaggtgatccacccgccttggcctcccaaagtgctgggattacaggcatgagccattgtgcccagccgagaacagccttattgatgcttatcagcagtgagggagggacagctacatgagaggctggaagtacagttgatgagatcagggttggggagcttcttggttgatgttcagagctagaggaattccaggtgctggcaggaattagtgggtgtccagtgggtgaaacaaagattattggaaaaaagattgttgagggtcactgtcattcaaaggtaaaaatagtgagagattgggagggtgacctgccaggtaatagcagagtgaactctttttccaggattcttaatgagttatttggctttcagcagcaaagaaaaaaaatacacatattcagaaaagggaacaaatcattttcccatccattacattctgctttttcttgtaagcagagttcagaaaaatcaaacagagaaacagaaaaaatagcctatgtcttttattgtaaaatacaatttcacccatacgtttcagaaatgcaaggaagcatttattgaagactgttgcaaaaaagtcaaaatgttgcaatagggaaaacggttgtcctacactctcctaaagccaaaggcagaagaatgtaagccctgctcggagttagggggatagttctggaggtcgttaggagggaagttgaccggtgtgattgggccatctgtgttggctaatttgtgcttattggagttaggcttttatcctcctacagagacatggctgctctacccttgcataattacatttatagggatgaggcatctgacttactcttttgttgtcctaccatacgagtggctcaaggtagaaaatctcttatacatcatcagtgaacctagactctatctgcatcccggggaacagttctggatctcatccaaggctgagcgagttgctcaggttgtttggagaccctcacatctctccctgcattctctgtccctagagtttgcagctgtcattgctcaccatagactgcagtagcagaagccacatgtggtgctcccagtgtgcctttatccacacagaggagcagggaggctctgtcctcatctgcccctttcccttggattgatggatgcttctaagcaaataggcccgaattctactccatccttctctgttgcaacagtaatttctctcatttcagtggagattgacctcctcttgcatatctcttgccctgatgctattctctccattgaacatgctgctctactcctttgttaagtgtctccaggttttaaatatctttatgcttaaccatacaattttttactgccactgcaagccaaaataatctcttttttcttctaaagtcctaatgcttcattaagccacatattgcccaagatatttttctgtatttctgcctttaatgttttgaatttgattcttaaaggtatgctattacaggaactagaaacaaggacagtcttaactgtgtagttttcaggtttattcgacagttttgtaataacaatgtgattttgtaatgatacgtgatgttagagattattaattagtttattcataatgaatgtattgatcccctatgatgtgttaggcaatcatctatgcactgtggtacgatgagccaaacatgcagtttcccttctagcataagaaggcaaatgttacagagagtcagtgaagtgtacagaaggtgagatggttataattctagagttagcaataaagagaaccagtgggatagaggtcaccagggggaacttgttgcaatttaaaattgagaaattgaggaagaacacagtgacaaagtgaaatttcagctgagaccccagagctggggagcaagccatgcagaatttttggtgaagtgcagatgccctgagatggagtcagcctggcccacatgacagtttaggagcacatacagagttagttcatgaccagaggactttgaatcagcggtagtgaaccagaaaccaaagaagggtgcacagccttcacaccctgaatcctattgggtccatcaccgtcactgtctaaacaacggggagagctgggaccattgtgtctatcagacccactgtgtcctccctgggatctgtattgggttccccagctgtgcagcatctcagtggggtgtgtggacccctgaactgcctcttcagacaggcagagcctcagtctggggctgacagctgcttagaatctgcatggggtggatgtgggcaacacctgctcccttctcctgggctctgggcatttgtggttggtgttggtggtcacagcagtgtctgggccatgagaggtcttagcctggaatggtgaataacccactagagacaccttcctttctttgaagcctgtaatctctgtcccactcaaactccttgcatcatcttaccagtgaccacccgctacgagtagccatggcttgaatatagtttctttttcaaacgtgttttaaattggccaactgcaactaccagatccagagtaaatacgaggggctcatgctggactcctgaaaatggtcatgtcctgaaaggccatttgtaggacatattggacaaggattcaagggtcagtgggaatcaggggagggaaagggaggacagacaggaggaaaggtcatgtcacgccccagcaagatgtcagtctggccctcagggacaccggggttacgcagtgaccctgtcctctcggaggggaggaggaagacaggatcaggaaggcgcagacccctcgtgtgctgtgcctggtggggaggctgcagttggaggcaggacatcagggggcgctgtggccttcccgacaaatgctctgagcatctcagagggctctcctggttcattccctttccccaggcctggtttcttgctcactcactgatgtgcaggatgttttgagtatcagagcctcagtgccctgcaacaacaacagggccgccaagctcctgatgaaatttatttcctctcttctcttttcccctgcgaagctgtattttccaaacagaatcagggtctcagtggctttaaggcaactcaagagagtgcgtgttgcaaagtgcagtggagcatttgtgtgtgtgtgtgttttctgggtgtgaagacaactttgtgggtgtgaaatccaggtcttagtagacgtggctgtagggtgctcttaatgaggatatctcggtgtgggctgctgtgctttctgttccatgcatcccacctttgctaacaacccatttctctcttaatttaagttgtttcagtggatctcctgtaaccctacgtcttaaaaggcaaatgtgtgacctgaagatgttcaataaaactcccattctttagcacagaggatactgattttcctggagaagtaacgattttgtgactgcataaactttaagctgacactgagtgtttgcccagcacacaatggatccgaagaaaatgaggccgagtgaaaagccagaacagtgaacagtgagattggtggtgacactggaccttcatttcaacttaggtttgaagctcaaattcctgcttgaaattcctagaattatgaattatagtttgttcaaaaatttgatttaggtttcacgtacatgtatcccaaatgtgttgacacagacacataccacacgttaaagaggtgtaaacacaaaagtcttgttagaagacatttatttgggatgaggaaaggaaactgaggacagggtataggagtaacagcaattctctgtagctctgaagacaaattatgagctcgtttttctctcttccggaagctcagctgaagcagtatgggtagcgtactccaggagcactgcaagtccctctacggtgttctccaggactgtaggaatctcatctgcaggtgcaggtcaagcccctccttgagcctacagacacagagacagcatccaaaattgagcaccaaggtcagcagtgggtggtaaagggaatcttggagaagtcacatgctgagtgataggtgacgttggctgtattagggccggtagcacaaacagcctcagtcaataggaataaaaacacagtggagtgctggtgtcacaggatttgagactcactctcatttgctttcatttttgtgctccggccccatcacatacacacctgaacacactgttaggcccatcccgagtctttaaaagagattctctatcgacagagaaaaatattctcctaataattaagtctacttgtttagatccagaacgaactagttagtatgtctctctgtattttaaacatagtgaatttcacagacatatcttggaatgaagttttgggagaagaaaatctcttagatttctttggctctctactcaatttatagatgagaaaatcaaggcttagagatgctaagtggagccacctaagtgacatggaccattgagactcgattccagactctgtctcctgtctgtccctctagacactgcagctctgcatgccggcttgtcttacctgaaacctgaagaggagctctttcatcccatgcaaaggaatcaaccacttcctgatcatctgctccaggctgctcctgggctgtagcctcatcagcaattgcctggagtggctccgcccgagcctgcagggccaccaggagaatggcagcaaggagggcaaggctccttatggctggggtcacctggaggagagagagcaggagcggatgtgtggggagggaggagtctgcctagatttatagctgggagaaggctcagagacaaaccttcttgaaccttctcagtgagaggaggtggagattcgttggagagggtgtggatatccattggcttcaatgttcctcctttccttctctgctctcccagctttcattctagcatgcatctctatgttgagtgtcttggctgggttggagctgatggtgatgatgaggaccctgccatgatgatgtgctttcattcagtgaattcagggaataaaggcctcttactttctgaagatgggctctactgttctctggaagtctagacctggacccagtggagtagagaattaattcattgcaggctttgaaggcattaccaccctcatgaaggggtttttgaggttacgcggtgaggaatctgctgtaggggccagggtggagaggacaatgacctcatcaggctacaggtaaaacaagctcagtgacataaagagttgtctaaggctaaaaatgtctatgatttccatctctatttaggtgtgagtgacaaaaattatatatgtgtaatgtatactaccttatgagttgatatatgtatatatttggacctttatcttataccatgtagaaaaatcaagtccaaatgattagaagacctaaacatagacccgaaaccataaaatgatgagaggaacagatgaagataaagctttgacgttgatgtgggtaatgatttcttggctatgacaccaacgacacaggcaataaaggggaaaagacacaagtggagatgcactgaatgctaaaggatctgcacgtcagaaaacaaccaaacaatcaactgagtgaaaaggcaagccagaaaatgagagaaaatatttgcaaaccctacatgatagaaagggtaaatatctgaagacataaggaaatcaaacaactcaatagcaaaaaacaaataatctgattggaaaacagaccaatgacctgaatagacttctctcaaaagaatgttctaaagagctatgatcatgtctactggacatgtcaattaggacacgtgtgtttagaaggaaactgcttgagtttctctgttaacttagctggtagccaatgcccccagcagccaccagaggttcagacagatgttcacagcaggggattcacctgctgggcccctctggggtggcctgggagtcacagttcagattgggggcacagcctcaatgttgaaacctcaatgtgaaagtttaaattttgtgttacttacagatcctcaagctaggcagggtgagcagagagggcagacagcagtcctgtgttccaggtcttatgtagcaagagcatctgtgcacatcccagagaggacttcccctatttaaaggtctttggggatcaggtgtcctaatttccagggttattttctgttgggtacattaaataactctggtgacaaggacagttgaaaaacttggtgtgaagcttgggttcaaacaggcatcgacagagggacccctcacctaccttggtcagccctggccagacccagacagcaaccacctatggattctccatgactcctaagacaattgagcccacaatgcctatgctcgtggctgaggctgaactacctggaccgagggaatatttaaagccaccaggaaaggccagcgtgcatagcgtagtatacactctgtaaggagactaggaaaaaagcaccaacctacacactgaggagggtttaggattttgttctctatcagcctctgcaggccgtggggtctaaccgtaaaaacacatcaaagccattcagccaagcccgtagatgttggtgaacacctgggtgagactgaataccacttcggcttgtcttgctaagcagctcaggttttgctggactctcctgagttaagcaagtacacgtagcacgtggtgccctagaggagatagttatctccttgcttggcagttagatactttaaggctaaagaattttctaggagtaagagttaaagtgttttcagtaatcttaaggtggtatgaggcatctcaggtctctaggtgtgattgctgttctagagcactggggtcgctgtcactctgaggaagcagtgagtttctgatctctagcaggcccaggaatttcaccatttgaggaagtggccgtggtttcatcccagcagaggaacaaattagagctctttgaggaactgggaccaggagatggttttaggttctagggcattagtaggtgccctgtgagggcccagtggatgtgggtatagacagaaaatctgcaggggtgggcgtgtatgtggggaaggtccagtggttgtgggaacatccagtgacctgcagaagtcaaacctggaccagcctcctgcacacagaacactccaatccacaggcattttctcagtaacacatgagagaactattattgggagagctggttagatttgggtgtggagttgttacacacaggtctcagaagcccatattttttgcctaacttgtagggcagctccacgatctggcctagtcctttggttttttgctgttggagatatagctaatggggttactctgaaggcaaatggtgatctcacaaaataccatcgtattgggttatctgcagagtactcaacaaagcctgagctaaggaagcggtatggcaagggtcggggtatgtgccataaaccagcgtcatgtgctgggatagggagtgcagcagtaaggagtaaggagtatcctgtactagtaaggagaggctgctttgctggtgaccccacagtcaaggcaagtttccttggtgtctccaattccagcaaggccattgcctcccttgacgaccccttgggcaggggcgatgttgtctgaagccatggccattcccatggggatggccttcccaggtggccacccacgacgggaagtgggggtctgggcattcgctttactgctgctgttgcacaggctgttagccctgtgggtcttcagggaagcattcagcgaaagcttgagccgtgttttccttagtggtataggacgtttccatccacaactcttatacatcagagcacatgcatatcctggagcctgtgatcattttggaagctgtctttgcatgtgaggttccaatgtgcaagctgcagtctgggtttgtgctgtggcattgttagccggtttgaattcacacctggcattggcagggccacctgctggtttttttttttttttttttttttttagacggagtttcactcttgttgcccaggctggagtgcaatggcgcgatcttgggtcgccgccatctctgcctcctgggttcaagcgattctgctgcttcagcatactgagtagctgagattacaggcatacaccaccatgcccggcttattttgtatttttagtagagattgggtttctccatgttggtcaggctggtcttgaactcctgacctcaggtgatccgccaaccttggcctcccaaagtgctgggaatacaggcgtgagccacctgccggtctttaaaatgttatttgtgattgtgaaggctgctggtgtttaagctcaatgccaatggacccactcaatatctaagaattgagttgcctgccttggacggaggtcaggtggcatttgaggcacagcccccctagcatgggattccagcacttcccagctttccagtgtgggacacaagttctgaccagggcagtcctgttctagcagcttttggactttggatcctgagtctgacagtagctccacaagccatgggaacataagataccaagcaagaccaaccataaagagcactgagattttatcactcagggctttgatattgacatcgattatggtgtgagctttcaccaatgtttcttcagagtctttctccaccattgacacaggctacatttgggaatgatacttccatgtgatcatcagctaatgtagtctatgtccactagtctgaaggcttctgtttgtttagtgactcattctgtgccctttttgggtcttggagcaataatccctactacctccaggaaggggtgagtgggagacattagctaaatttcaaagtagtaagaactggagcttctgctggaagctgcacgtcaagatgggaggtgtggtatagcagaatcactgtggccctgctgggtaccagtgggcctgggctgccagtccttagggactcacagcttactatccatccacaatctgttttccagtaaatgtatgatgttgagacaatggacctcttatcacagtatgaggagttatcattattggagcaaatgtgaatgatgttatctgtaagggaaaatgaaccttactcttctgtgattaccaaagtgttcaccatggtgggcctggcctaattataatgaggcactggtggccacagggtagagagttaagaaagttaggactctcagaaggggcttggtccccttggggtttcatgccacaacttcaataagaatgactttaggaggccactgtgctgcttggggaggctggtggcttgggggcaatgggccaagtgagagtcccctaaaccctcatgctgtgatgcccattcctatgtcaccaccactgccttgaagtgggagcctaggtcttgatcaatgatattgggtggtttccgagagggaaatgtcacagagcaaatgtcacagcaagagagcacctgctacaccaagggtcttgggttggaagagttgatggaagtgcagggttgtgtgtctgcttctgcacgcaaaggtgctggctgtgtggtaggggcccagtgaagtcaatgtgctgaaaggttgatggcccaggaacaagggagtgccggccacagcctgtgttaaccacggcacggcatctgcagttgagcatcccttgcttggttggagatctggtgagaggcaccagtggcctagggtaccctctaaagtggccacagcctccagtgtctaaagttcgggggcgccactttggtttgagggccaggatgccattctctccactgcagatgctgctctacaccttcttctaatctattcacattttcaatatctcatgtttcaccatgaaattaaccactgaaaattcacattttcaatatctcatgtttcaccatgaaatcctttattgccactctaagacaaaatgatctctgtctttctcctgaagtcctaatgcttcatgaagccacattttacccaggatattgttctacatttcagacttcagtgtttttgatttgtttcttaaaggtttgctatcacaggcactagacacatggactgccttacctcagtaggtttcagttttttcctatatagtttagtgatgataatagaattctatataattacatgatattggttataattaatttatccataatgaatttgttgatcccctactatgtattaggcagttatctacgcactgtggtataacgataagcaaaacatgctgctcaccttctattgtagggagagaaatgttacagatggtaagtgaaacgtacagaaggtgagatagttacaattccacagttaggaataaagagaacaagagggatggaggccactaggggaacttgttgcaatttaaaattgagaaatcgagaaagacctcagtgacaaggtgaaattttagctgagacttcaggtctgggcaaccagctggtgcccttcggggtgcagtgcagatgccccgagatggagtcagctcggcccccatggcagtttggaacaatatggaaagtaacttatgatcgcatgattttgaatcagtggcagttcttagaaactaaggaaggctcctgcacttcaaacggtgaatcccaatatgtttccgtcactgtctcaacaagaggaagagctcagaccatttctctgtcacacacagacttactgtgtcttccctgggacctgtattgagttccccagctgtgcggtgtctcagaggggtgcctggactcctgagctgcctcttcagataggcagagcctcagtctggagccacgatctgctcagaatctgcatggggtgtgcgtaaaaacacctgcattcttctcctgggctctgggcatttgtcgttagtgttggtggtcacggcagtgtctgggccatgagacgatttagtcagaaatggtgaataacccacttgagacaccttcctttctttgaagcctgtaatttttctatcccagtcaaactccttaggacctcttaacagtgaccacctgctaagagtaggcatggtttgaatatagttttttttttttttcccaaacatgtgttttgaaatcactgactgcaactacacgatccagagtaaatatgaggggctcacactggactccccctctgggccggggggtcatgtcctgaaaggacatctgcaggacctattggacaaggattctagggtctgtgggaatcaggggagcgaaagagagaacagacaggtggaagggtcacgtctcatcccagcaagatgtcagcctggcctcaggtacaccagggttaggcagtgaccctgtcctcttgaagggaggaggaagacaggctcaggaaggtagaccccacgtgtgctgtgcctggtggggaggctgcagctggaggcaggacagcagggggcgctgtggccttcccgacaaatgctctgagcatctcagagggctctcctggttcattcccttttccccagacctggtttcttgctcactcactgaagtgcaggatgctttgggaattagaacctcagcgccctgcagcaccagcagggactcaggttacttggagaactctcgtccctctcttcatttttcctgatgccttagaagcagtattttccaggcagaaccagattttctgcagctttaaggtaacccaagagagtgcctgtcacccagtgcagtggagcaattgtgtgtgcgcattttctatgtgtgcagacaactttgtgtgtatgaaatctagattctggtggatatggctggaaaatactcttaatgaggacatcccagaggggtgcctctgtgctttctgttctactcatcacgtctttgtaacagccagttccactttaattgaattctttttttcccatggagctgattccatgtcaggtctaaaaagcagatgtacgatccagaactgctcagggaaactcaaacacttctggaaagaacgtgctggcttttcctgaggagtagcagtgttatggctgtataagcttgaagctgacaatgatggtttatggaacacgtaagcattatctttgcatgaatccaatcaaaatgaggcagagtgaaaaggcagagcagtagatggggagatgagcagcatcatttgagctttcctaacaatgtgtgtctgaagcctttgttcatctccaatattcctagaattggaactggcttttgtttaacatgtagaatttagtgttctggtacttgcatcccatggtcttgactaagacacatatcaaacattaaagaggtgcaaacacaaaacttgctacaaggactttacgagagatgaggaaaggaagctggagaccaagtacagtagtaatgaaagttatcttctatgtctgaaagctagttatgaacttactttcttctgttccacaagctcagaggaagcagaatttgtagtgaatctcaccggaggtgcaggttccatagttgcgttcttgaagatgataatctcttattctgcaagagcatctcaagagggttcttgggcctggggatacagagagcatcaggcattaggactggggtcagatgtgggtggtagacagaatccccgtgcagttacctgctgggctgattgcgttaatcacagtggccacatcagagcagcagcaagatcagctgaatcagtaggaatcaatgtacacagcagtgctgctcacaggcaggattagagacgcattctcatttgctcacctttttgtagtcctgctccatcaccaaggcatctgatcacactcataggcctcttgctagtttctaaaactcttctaatagacaaagtgaaacatgtttcttcaagagtgggctctcatcaatgatgcagggaagatggcccagtatgtttctgcagagcataaaataagtgtgcttctcagaattgtcatagactcaaaaatcttcggagaaaagtcatccctggagtatcatctggttctttccttttagtctacacatgaggaaattgaggcctagggaggtgatcacctaagagaaagagccagctgttgggtctgattctagaggtgcctggttttcctctctagactcctagctctgcaatgctggcggctctcacctgaagctctaaaacctgagcttgtgtccccagtgaaggagatggtaaagtcctggtcgtctgccccaagctgttcctgggctgcagcctagtcagctcttgcctggagtggctcagacagggcctggaggggcaccaggagaatggcagtgaggagggtgagggtcctcatggctggggtcatctggaggagggatagcaggaggggatgtgtggggagtgaggagcaagcctggatttatagctctactgggagaaggcctgagacagatgctgcagtgacaggaggtggagcttgtgattggttgtggcagggctacccttgccctccaggtcccttttgtgttctggtgttttcccagctttcatcatagcttgaggctttatgtttagtgtctggactggatccaagctgatagtgaggctgagtacccttatttatttttctgtttacaatctacttgaatattttctttttgatattgaaaaatgtaaagaaaccgtgatttcattcattaagttggggaacaaatgcctcttattttctgaagatgggccctgccactgtctggagccccagatctgaacccagtggcatagaaaattaaagcagtggagaattcagggacatttccaccctcatgaagaggttatagggtgtgtagcctcctcctggggctggtgtgaggacaaaaagacttaatcaggctacaggtgaaatgagctcattaggatactaggtcaagaataagtaaaactaaagccaaatggtgggttaattttaagaaacaaatgtcatttggacagatcaggtaaaatttctatcattaacatatctgtactttaagaaatatcgaaacaattgacatgcctatagccctcttctaggatctttgtgattgttttaattataaaatcttaaatcatgcagacggaacaacaggtagaaagggtaataggctcccgtctgttcccccagccctgcagctctgctcttggaaaccaccacttcccaattttacacattcttccacacttgctttttccctctaatgctgtgtcttgtacactttgtatatcaaacacatcgagcttcaacgttacaattattccctatacttttccagcgttcgcacatgccatcactttactatttttatactgggaaaatattgtcaagttgtcataatttgtatatttctaagctttgccatgacaattttaaacagcaatgaatataattttatagacatcagtttgcccataagtgacaatatcttttgaatatgtctttagaagtagaattctgggttaaagaacatgtcttaaatattttgagtttattgttacattgtcctcactaaagattgttcaatacactaaaaacaaaaatcactccaaccatcactgagcccagtggaatttcttttagaaggccctgttttgtgcaaacgtagttccagtttttgcattgttgaaatttgccgtttgatattggaatacattcttaaataaatgtggttatattatagaccattttaatgcacattgctcactttattttttttttgctaatgacttattagtttctgtctattttatatttattttacactatggaaatgatgttagacaaaaagcaaattccagcaattttcttagttgaattcaaaataagtcgtaaggcagtggagacaactctcaacatcaacaatgcctttggtccaggacattgcattttggcccactgcactagccaacttacagtgcagtggtggttctggaagttctgcaaaggagacgagacccttgaagatgaggagcatagtggcctgccattggaagttgacgacaaccaattgagaacaatcattgaagctgatctgcttacaactacataaaaagttgccaaagaattcgacatcaaccattctgcagttgtgcagcatttgaagcaaattggaaaggtgaaaaagctaaataagtgggtgcctcacgagctgacagaaaataaaaaaaacgtcgctttgaagtgtcgtcttctcttattctacgaaacaacaacgaaccatttcttgatcagattgtgatgtgcaacaaaaagtggatttcatatgataaccagcggagaccagctcaatggttggaccaagaagaagttccaaagtacttcccaaagccaaacttgcgccataaaaaggtcatggtcactgtttggtagtctgctgcctgtctgatccactactgattcagctttctgaatccccgagaaaccattacatctgagaaatatgctcagcaaatccatgatatgcatcaaaaactacaaaaactacaatgcctgcagccggcattgctgaacagaaagggcccaattcttatcaatgcaacacccaacagcatgtcacacaactaatgcttcaaaagctgaacaaattgggctacgaagctttacctcatctgccatattcacctgacctctcgccaaccgactaccacttctttcagcatctggacaactttttttgcaaggaaaatgcttccacaaccagcgggatgcagaaaatgttttccaagagttcattgaatccagaagcacggatttttatgccacaggaataaacaaacttatttcttgttggcaaaaatgtgttgattgtaatggtttctattttgattaacaaagctgtgttggagcctagttataatgatttaaaattcatgatccgaaactgcaattacttttgcaccaacctaatttttaccaattgtcattgccttttcttcctgcctatgtttagggcagcaatatgttcctctaggaatacttgacgtcttagactctcttgcagctcagtgacagctctgttctgagcaataaaagataatccctaagaggggtagtctttaaaataatgaaataaatttctgttttcctgttataattttccattattgttttatgtggtcttccttttttcttcttggatcgtggaagcacttggacttgcagaaacagctgtctttttaccatgaagaagacaattcctccatatggatggaggagcagaaagatacaagactgtttggttcttgaggccatggttgagatactgcacccactcctgtttgcccacctctggttgtgtcacgacttaggagaaacatgatctggcctttgaaatccactgtttatttgggtttcctggtctttgtggctgaaagcagctggtacttgcattatagagctttttaaatcttttctaaagtgataagcaaaatttgatatcacagtggagtcttggtttgcatttttcatgtaaattaggctcaagaggatttaatgcccaagaagcacttgtatttattttcactgaagtgcttttttttttttaaaccttcttggcctatttatttttattgactggtagcatctgtttatatagtttgaaattaacactttgtcatgggtattagaaatatttttagagtttgtcattctctatagggtttcttttgatgtgtagttatttttatgtagatttaaaatttatttgttgctttctgagttttgtgtctttcccacttaaccttgtaaaactcagtcttgcatgtgttcgttcatgctctgtgctatgagtcagggttgcctttccatctgctgccaccctccctgaggaggctgtgctgtcccaggtagggctatcaggatccataccaactggacatatgaatggcacatacagaggcccaacaagtgtgtaggaaacatggccgtagatgaagctgctagatcagagaaacatcaaagcgacattgtagcaacaaaggtgctctgtgtggtctgtttcacctcttctgtcccactgtgctgtgcctcagtcttccccaaagtacacacatttcattgtaagcacagaattccatttctgaaggcccttatctctgatcttgcacctgactgacttatacacacaggaagcccatgtctcttccctcctcagagacattcagatcctgcttctgcacaggaggggctggaccccaagatgaattgcagtcttgcggacctgttcttgctacaatctcatgcacctgtagaccctgatgggtgcatccagctggccatatcattatctccagtctgtggagaggtcaacagtactcctagctaccattttctgagagaaataagtctctttactcagtaatgatgatcaatgggaattctgactggtggcgtctggtaataaacttgacttcagctacttaaaggatgtggaccaaaatatcagatcccagatgcttcacatgaaatcccaaaggaggggctttacaaaggcttgagctgaggagagcctgtgatgctcatgtaagactctcagtcagcaaatatcccttgagcatcagcagctgtcaggttctaggctcagaacacaaataacccagcagcttacagaagccagcactgcagaattcagaggatagagagtatagggtatgaatgaagtatatggaatttggcatcggtcttgttgctcaataatttttgactttgattaaggtaaataatctgtctaatgttcattttctccttaatgtatatttctggaaaaaatatttaatggtaattgagagttagtaggattaatgtgagtattagttattataatggatggatatttcttagtaatcaattcatattagctaatattagtatattaaatctttttgtgttttgagaatactgtctggcctataggagttatccaattaatagcacttttatgatgtcagacaatgctgccttcaacccatcataaatgggaagaacatattagtgttctcattttacagaatactatagtttgatccataggattaaagtgttgcctccaaggataaaggtccagcatcgtcaaagctaggttggaatcccaggcccctttttccaaatcccttcatctgcttatggcatgggttcccaacccctgtgctgaggaccagtaccggtccatggcctgttaggaaccggggcacacagaaggaggtgagcgaacattaccgcctgagctctacctcctgtcagattaacggtgacattcgattcttataggaatgtggaccctattgtgaactgtgcactcgagggatctaggctgtgtgctccttatcagaatctaactaatgcctgatgatacgaggtagaatagtttcatccagaaacaatccctcagcccccccacccatggaaaaattgtcttacaactgtcattggtgccaaaaaacgtgtccccagtaagtgcctaactaaagtcaagtgacactgtggagcagtagaggcttcatgtccttcttgaagcaggacaggactggggcaaggagagaggtgagagattaagttccaagtgtggagaacagtgtgtagaggaaatgtatgaagacgttcagtaggacgctgtgtagactgtgctcactgaaggaaggttgtaaacatggggaatggcaagtgagtttagactggaaattgtggatgagaagattcctggagattttctagacacagcttcacatcttaaggatgagggcttaagaatagaagggggtgagtggaaatgaaactgccaagcacacttttctttgtgcttccatgccctgtagggattcagagcctcacaggggaagccctacaatgagacagggatgctatgtcttgggataatcacattgtgaaaacatggcccacctctgacttattctttatcgttcgatcacatgagtggattctttaaaatgcctagtaggtcttcagtgtacatacagagtttgtgttttcaataatcatttcgtggtcttatttgaggctgcgaaaattaccctggttgtctggagaccctcacatctctccctgcattctccgtccctagagtttgctgctttcattggccaccctggactgcagtagcagaagccacatgtggtgccccagttgaggacgatgggatgctccgtcctcatctgcccccttcccttggattgatggatacttctcaccatgtcggccggaattctgctctactcttctctgttgcaaaagcaattcctctaaattcactggaggtctatctgacccttcatacttcttgtcccaatgccattttctttacctagaatactgctctacctcttctttttaatgtattgaatttttcaatatcttgtatgtttcagttaaagatatatcataaactcttgtcttgccactacaggccaaaatggctagttcttcattagaaggtagtgatgcttcacaaagccattttctactcatgatattctcctgttggtttaaatgatttttattgatttttaaagcaatgctgtcacatggactaggcacatgggtgctttatccccataggtgtcaggtttattctacgaagttttgtaataacaatgtaattttgtaataatatgtgatgttagatatgactaattaatgtaatcataatgaatttgctgatcctctactatttattagggagtcgtctgtgtactgtggcccaacaatgagtaaaacttgcagctcaccttctagagtagggaggcaaacattacagaaagcaggtgaaatgtacagaatgtaagatggtgtgaaactctacagtttaaaataagagaagaaggggattgaggtttccagggggaactagttgcaatttaaaattgagaaatcagcaaagccctcagtgacaaagggaagttttagcagagactccaggatctggggtgcaagaaaggtggacttctgggtgaagtgcaaaagccgtgtgagggagtcagcccagcccagcggacagttaggagcagtatgcagagttaaagcaagcaccatgtgacttcaagtcagtggcagttataggaacccaaggaatgttgtctggccattgcattctcaatcttaatgtgtgtccttccttctctaaagaagaggtagagctgggaccatttatgtgtcagtcataggctcatctatagtccctaagatctgtattgagttccccagccatgcagcatctcagtggggtgcctggatccctgagctgccacttcagacaggcagagcctcagtctggggccgagacctgctcagaatctgcatgaggtggacgtggggaatgcctactccttcctcctggggtctgggcatttgtggttggtgttggtggcttccccatccatgcagtgtctcagtggggtgcctggacctctgagctgcctcagcaccctgcaacaacaagaaggctacgattttcccggtgaaatgctttccctccctcatcacttatcccctatgaagctgtattttccaggcagattcagttctcagaagctttaaggcaacacaagagagtgcctgttgcaaagtgcagtggagcatttgtgtgtgtgcattttctgggtgtgaagaagagtttatggatgtgaaatccaggtcttagtagacatggctggagggtgctcttaatgaggacatgccagtgtaagctgctgtgctttctgttccatgcatcccacctttgctaacaacacatttccctcttacagaaagttttttccgtggatctcatgtaaccctatgtcttaaaaggaaaatgtacaatctgacattgttcaatgaaactccaattctttagcacagaggatggtggttttcccggagaagtaatgattttgtgactgcatgaactttaagctgacaccgattgtttgcccagtacacgggagggagctctttgagtggatccagagaaaatgagacagagtgaaaagacagagcagtggatggggagattggtggtgtcatatgggccttcttttcaattagagtctgaagccaaaactcctgcttgaaattcctagaatttggaattttgttttgtttaaaaacttaggattctggtaggtgcatgccaagtgtcttgagacacaaagacacatcaaatgtgaaagagatgtaaagacagaaatcttgcgataaggtatttatttaggatgagaaaatgaaattaaggacaaggtacaggaataacaagaatttcttttactctcaaagtaaataatgagcttatttttcttgattctgcaagctcagcagcagcagatccggtataatctaccaggaagggcacaggacccaaagcgacgttgaaagaaatggcaaattcctcgtctgcaaatgcacctcaagcctctccctgagcctggggacacagggacagcatcagaaatggatcaccaaggtcaacagtgggttgtaaagggaatcttggagaagtcacgtgccagctgatgagtgatgttgtctgcattagggccggtagcatgaacaacctcagtcaataggaataaatacacagagcagtgctggtcacacaggatttgagactcattctcatttgctctcatttttgtgcttctgccccatcacacacacacctgaacacactcttaggcttggctctacttttaaaaaaccattctatagatacagtaaaatattctccttataatgaaatctacttgtttagatccagaaagaagtagtcagactgtctcttcatatcttaaacctactgagtttcacaggcatatcttggaatcaagtctttcctttttatttattttttctaaagtgaaaggattattaagaaagtaaaagagtaaaataatggctgctctccatgcagagcagccttaagtctttaaagacagaaaacctgttagatttattgggctctctcttcaatttatagatgagaataccaaggaccagagatgctaaatgaagccacctaagtgacatggaccattgagactcgattccagactctctctcccgtccaaccctctagactgtgcagctctctgcatgccggcctgtctcacctgaaagtggaagtgcagcgctttcatcccatgtaaaggaaacagacacttcctgatcatctgctccaggctactcctgggctgcagcttcatcagctcttgcccgaagtggctccgcctgagcctgcagggccacaaagagaacggtggcagtgaggagggcaagggtcctcatggctacagagacttggaggagggagagcaggagcagatgtgtggggagagaggagttagcctgggtttataggtctgcagagagaaggctcagagaccagaaactttgaaacttctcagtgagaggaggtgtgcatttcatcggggattgtgtgggatccctttggtctcagtgtccctcttttcctcctttgatctctcagcttttattgtagtgtgaatctctattcacactagaaagtgtgagtagatggatcaggtgtttggagaagatggtgaagatgaggatcctggcatgttttt

SEQ ID NO: 607 - DNA, 327338 bp, Homo sapiens
taataatgttaacttctggacccaaataattcacccatccacaaatgcattttccacctaaaatgattagaagttctgctaaatctgttgtccagctttccagcctgcctgtctgttttctgttccttgtaaaggaacacaagactaggaattctcaaaataacacttttgagacagaccaccatgctttatcaaacacagtgacatgctgtagttttaggcttttcttcacttttcttagcttggcaagagatccatactcagttcccaatccaggtgcaaaatgacaagtaaggggaaacttttaggttcatgtctaaacaaaactcaggcttacacaatccaggtgactgggtaaagggctctgcgctgatcttcaggcattgtgtctgctgctttcagtgtttcttgcccaggatcaaggacaatttaaagtcaagtggttccacaattaatatttttagttatttccaggaattccatttccaagtttggctcactctatggcaaacctggaaatggaattcttaaataactacaaagacatccttattctgggtcttgccatctttgggtttcaggtatatggtaggcctaggtccctaccacttgtggaagcataaaattacattttcatacatgtgtgtcctggtcttcttcccttaaccccttactattgccctgaggagccatcgtcagatcacttccttatctagaacaattccatctaatcaccttcaaggacaagcagttctcagtgatggtgatacacttcagaggattatctgcctctatgttatggctgtcacaggggtgggaagtctattgggatttagtgcaattggaccagggatgtgaaatgatctgtaatgtgccaaacagtcctacatattgaggaattctcctgtattgaccggatacggtggctcatgactgtaatcccagcactttggaaggctgaagtggcaggactgcttgggaccagccctggcaacatagcaaggctttatctctataacaaaataaaaacattagccaggcgtggtggcacatgcctgtagtcccagctacacaggaggctgaggtgagaggatcagttgagcctatgaggttgaggctgcacagtgagctgtgattgtacccctgcactccagcctgagtgacagagtgagaccctgtctcaaaaaaaaaaaaaaaaaaaaagaattcttctgcattgcttgcacattcaatagtcttgccagatattcatgtaggtgaaaaacctgtttataattacataattataaaaactagtctattttgcttgcaaaatgcaaaatgattttgtaatgtttaatataaatagaaggtgttatgactttaactgccatgaaaattaatagattgtttgaacaaactttgtttgttcacaacttttctaaatgtaatcaagtcaccaaaagcagcacttcttaggtgtctgaggggccaatataatgcactcacattagtctgcatttatagctactgcattaacaatgattaattcctattatcttctattatagctatgccgacatccataaatattaaaatatacattattttataataaattcatttctttttatttctccaattattttgtttacattatattgataaaaaatgaataagtaacccactgtggcagttatggagtgtaattcctgatttttcagttttctttgcctgacaaacactaattcattttagttttagtagttaataagcataaatgtagaccccaaggcgttttttcttgctcttctagtagactgaaataattacacttgtctttctaccctgcccctgatctgttggctaactaggggtctcaagtggagacacggtcgcattttctattttatccagagatttgtaattggcaacccacattccaccaagtgttctttcctcattgagcacctctcgttgatctcgacacattggtggcgtgaacacattctctccctcacagaaaacttaggaattaggggaaatgtgacatcagaagatcatctacttgtctggttcttctttggaaacgtaattttccatacgtggtgattcataggtagatctttggctgtagaactcctctcctaacaacgggtttccttaaaactaagttcagttggtgcaatttttgtccttatactccccaaacagcagctccatagattgtgaagctgaaattgtgacgtgtgtgcaaaatgcaaaggatcattatatttgcattttttttacaatctttggtgacaatgtagtcatcatcagtattataatctttgaaagtgaagacgctaaaataactagtgtgcacatcagtgttcaaaatggttagaacgtgggaaaaaagctaaaattccatcaataaatgaatgtattaaaacgtgtgacatatatatatatatatgaaatgaaatactattccaccttaaaaaggagtgaaattccgacacatgctgtaacatagataaaacttgaaaacactctgctaagtgaaagaaagcagacacaaaaggacaaatactgttcgattccacttatacgaggtactcaaggaggcatggtcacagtcgtagaacataatagaggttaccagggactgaaagtagaggggactggggagttattgtttaatgggcacagagtttctgtttggggatgatgaaaaagttctggaaatggatattgatgatggttgcacaacatcatgaatgtcattaatgccattgaatcatatacttaaaaatggtaaatttcatgttatgtatattttagcacaataagagaacacaaagaaaaataaattgtaaacctagtatgttttcctgatttaaatattcttcacaaatgaaactgaaatgaacatttttcagaaatagaatagagaaaatttgtgacctgcaggtctgcactaaagaacaactaaagttgccgggcacagtggctcacgcctgtcatcccagcactttgggaggccgaggcgggaggatcatgaggtcaggagatggagaccatcctggctaacacggtgaaaccccgtctctactaaaaatacaaaaaactagccgggcgtggtggtgggcacctgcagtcccagctactcgggaggctgaggcgggagaatggcgtgaacccgggaggcggagcttgcagtgagccgagatcgcgccactgcactccagcctgggggtccgtctcaaagaaaaacaaaacaaaaaaaagaactactaaaggtttaaaagaggatggaaatgtagacatgcagaagggaatgaagagcaatggaaagcgcaagtgtgtgtgtaaggaactgtcacagaataaatataaatatttaaatataaaaatataaaaaatatttataaaaatataaatatttattaaaaatataaagttcaaaaccgggcaatactagtttatggtgttagaagttaggatagtggaaaactttggagatgatgggatgttaataaaagggagaggaaggaagggggttagagagctagctgtcttctatttcttcaacacttgacagttacaggggtttattcacttcgtgagtaaattcgctgtgctgcaggcatactccgtgtgtgtgcgcttttctgcatgtatgtcacgttttaataaaaagttttaaaaaatggaattgaattgttatttgatcagataactctcaaaacctgtcctaactacattatagtggatgagccatcttgaatcttcaggtgtgatccacagcaattgactgttgttaaccagagtgaggtgccagttgctgcgctgagttccaaagctgcgcttcttgatagctgtgaacatcatgagtatacactggagtgcacatactataacatgctattgttaccaagccatcatgaggacgtacatttggaatgtttctacctgggatgacacatttatacacatctattaccacatgctttctagtcttccatgtgttgaaataacttgcattattcagaaaaggatatcaatttctggtgtcatctggaaggttaaacagagtaaagtcaaatagctgaattgcgtattgaacctgtgattaattttgttcctgttcataataatgaggtcatctgagagccacctaatggcctgccaccgcccaactaattatctagaattcctacaattgaagacattcttctccatgaaaggactgtctctggaacaaaatacaaatatctgacataaatgagagcaataggaaattattaggccgggtacgatgcttcatgcctgtaatcacaacactttgagaggctgaggcaggtggatcagctgaggtcaggagttcgagaccagtctgaccaacatggtgaaaccccatctctactaaaaatacaaaaattagccaggtgtaatggtgcgcccctgtcatcccagctactcaggaggctgaggcaggagaatcacttgaaccagggaggcagaggttgcggtgagcagagattgagccactgcactccagcctgggtgacagagcgagactccatctcaaaaaagaaaagaaaagaaaagaaaattattagtacttattagcatgctttagtctattggattagctggcagagcaagcattaatcggaggaattgccatcaggatcaagtatattcatgaagggagtaaaaggtctgcaggatgaagcagtgctctagaagggtgatggctgggagctttgggaactcagagagcagtcactggggccatagatgtaagaagaggtgggctgagcaacacggaacgaagtggtgcctggggcataattgcacagagcgcaggctcctgcatgtgacactgttgcatatcctcagtgcttgaatggaccacagatatgtgcccaccttgctgtctgtacccaatggtcacacacacacttgtgcttttcaactcatataccttagaaaatgaggtggaataggaatttggcttcctgagaagtagttctcgaacttacaagataattttgctcttggtgcagaaatggataacctgtatatactatttcactatttcacaagatgaataatcaaagaaatacatgaatgaagtaattttcatcctaaagtaaacatttggtatttactataatcttaatttaaaatctatttatgcaattgcgatacttaacgatgtagtagcaagcagatttttgatattgtattattttttgaataatttggataatggaattgtgctttgggttttcataaattatgacatggtgacatttcttggacattctctgcatacttagacaaagttttcagggattttaaaaagctaatgttaatatctaattttatgtttttttttattttttgagacggagtcttgctctgtcgcccaggctggggtgcagtggcgcgatcttggctcactgcaagctccgcctcccgggttcacgccattctcctgcctcagcctcccgagtagttgggactacaggcgcccaccaccatgcccggctcatttttttgtatttttagtagagacggggtttccccgtgttagccaggatggtctcgatctcctgacctcgtgatctgcccacctcggcctcccaaagtgctgggattacaggcggaagccaccgtgcctggcctaattttatttattttatttttttttgtttgtttgttgttgtttttaatgaatgaatgattgataatattactaagaaatctgaaagaaagtaatttcaatgagataaccacttcttataggtactttgttttcaaatcaatcacacataacattcgaattagctttaaaaggtcaattggtaggccaggcgcggtggctcacgcctgtaatcccagcactttggaaggctgaaggaggtggatcacctgaggtcaggggtttgagaccagcctggccagcatggtgaaacgaccatctctgctaaaaatacaaaaattagccaggcgtggtggcacatgcctgtagtcccagctgctcgggaggctgagacaggagaattgcttgagcccaacaggcagaggttgcagggagctgagatctcaccaagaggcagagtttgctgtgagatgagatcataccactgcactccagcctggatgacagagtgagactctgtctcaaacaaacaaaaaggtgccgggtgtggtggttcatgcctgtaatcccagcactttgggaggccgaggcgggaggatcacctgaggtcaggagttcgaaaccaggctggccaacatggtgaaaccccgtctctactaaaaatacaaaaattagccaggtgtggtggcacacgcctataatcccagctactcgggaggctgacgcaggagaatggcttgagcccgggaggctgaggttgcagtgaggtgagatcataccattgcactccagccagggcaacaagaacgaaaccccatctcaaaaaaaaaaaaaaaaaaaaaaaaaaaagtcaatttgtgaatatagataaaataaatatttaaaaatctattttgtatgtagccttcaacatcttttacttcataggtgctcaataaatatttattgagtgctctccagaatgaatagacacctgagagaattatcttgaaataatcatatagatcaggcaaatggtttatttacttgaattatctgaatgccttcattctttcttcagttttctttttttatgcttaagatacaactggaacagcataaattttaaaaagaacattaagtcaccacgacacgataatagagagtaatggttacaagtagcagtttttcttaggactgaaatcaaatctgttgaaaggacaacttggcagacttttgcaactaaagatgttggtagaagaaatgtaaagctccattctacttagcttggagtgttcccatgctgggcaattggcaagctttatcatctgtagagactggtaaactgtggctcacattaactgttaagcttcactgtatgctgcttacacaggtgcaaaaatatgtgataactagaattgttttcattcaatcagtctccccattggcagatagtggagtagctctatattatgtttactctgaaaaatatagcaatttagttaataatgaatccaaagttcataggcacccagttcttaatcatagatcatttcattgatcattcttagctttcataagcttataaatgtaaacaccgtggctagtctgttttctaggaaaatgtttttctgtgagctaaatcaaaactggttggcattatttttcatggcatgaatttctatatgggattcctggtgtgaattcattattgagaaacaaaatgctagcagagggggaaatattgcttttgcatttgtttgcatttttagtttttttttccattttgacatcactgttttcattatggaccttatatattaaaaaaacaattttcacttagtattcatttctgtttaattctgtatgtaattcctctacatgtttaaattttgagatttaattgtcaaaagaataacttttcttcaaagtaatgagcatgcaattttaggacctgccttagttacacagtctaaattatcaaatttaagccatatctctcccaaatttcagattagaacatactacgttttgttactataaaaagcttcttattaaacatctgaacttaagcagtttattatgtactctacaacataaaatatataaaatataaatttaaggaaaaacataagcagtttattatgtactctacaacataaaatatatacaatataaatttaaggaatatttgttagatattaatgtctaatatctaacaatgtagacacatgtacaatataatgtctaatgtacacttttctcatgtatctttcattctttttttttgagacggtttctccctctgtcgcccaggctagagagcagtggtgtgctctcggctcactgcaacctccacctcctgggttcaagcaattctctgcctcagcctcccgagtagctgggattacaggcacccgccaccaggcccggctaatttttttgtatttttagtagagatgggggcctcaccatcttggccaggctggtcttgaactcctgacctcatgatccacccaccttggcctcccaaagtgctgggattacaggcatgaaccactgtgcccggccaaatctttcattgttaatttaccctctttgcagtacggtacacgtaccatcaactgtgcttccaccttccaattgggagatgctctgttttaccttttccagatagtacctagcagggggagcctgttgggcagaggtccccaacctttttggtaccagggaccagtgtcgtggaagagaattttccacagatgggggcagtgggggatggttaggggatgattcaagtgcattacgtttattgtgcattttatttctattatgattacattgtaatatataatgaaataattatataagtcaccataatgtagaatcagcaggagccttgtgcttgttttcctgcaactagatggtcccatctaggggtgatggagacagtgacagatcatcaggcattcgattctcataaggagcacacagtttagatcccttgcatgtgcagctcaccatagggttcatgctcctctgagaatctagtgctgcctctgatccgacaggaggtggagctcaggtggtaatgcgagcaatggggagcggctgtaaatacagatgaagctttgctcggcagcccgccgctcacctcctgctgcgtggcctggttgctaaaaggccacagactggtatcaggccacagtgggggctggggacccctgctctagggattaagtgcttctgaaacagcttctactcagctttccttatggtagtcgtacctttatcctggggtccggaaatgccaggtgctgcccattgccatgcctttttaagattctagagagtaaattgggttggtttatggttttctccattgctactttgagttttaactttctcaggttttcaaagtcagttaccattcctttgctttctaaactttaactttatatccttcccagaacaaaatgtttgaaaatgactgttgaacaaacatgtattttggatacattcatttctttgatctcaaaagtctgttttatttttttaatagctttgttagtgaatgcatgtgttggcacaggagttgcaatgtcaaatgcctacaggggccaggcacgtgttttggctcctctcaaaatcctgaacaggtcagggtcagagtcagttaagtttggaagaatcccagagcaataaaacttgtgtcccatttgggaccttatgggaggagaacacttgtttcaggccagaagttagcagctgtgggggttgaggggtggtagagatgaccatgtgacacaaggtggtgagacagagggtctgagggtccccaccctgctggttccccatggtttgaacctgaggggacagtttcagaagttcctgtacgtccccagtgggggacatggaaagtaggtgagagatgcaagtcaggagcattgccatgggcaccctgggtgagaggcaaggtaacgccatgcagagcctgcaaggtaggctgcctgcgccagggccaggcagagtgcatgtctcagacagaggatccatgactccaggaaagctgagctgagagttttggaggtggtagtggaggtgttattattgcctggcctcaactatgtcaagaaaacagaccacagatcacaagtgaaaccaaggatttcaacagtggatacaagcaggaccccaggagaccagcagcccctgccttccttaggaagtcgtctaaattgtttcttcctggagatgccatcttgggaagaggaggaggtggtgaaccattgagcctaagaaacagcagtgatggactttgaaccttcaatttgactgaatattgatctgaaagagatatttaaattgaaagagtctctgttgaagcaagtgaaacttttaatttgaaagagactgaactacctttaactagcaaatttcaacgcttctatcatcagaaattttgtgctcataagaaagagtaatgagttataaaacctgaagaagccacatttatcttaaaatatttgttagtgtacatgttaaaatatgattgggttctctcattgaaatgttgattttatttgaattcaatgaatgccacttcattaggtattttttaaatcttttatgtatttattatgtttgttgcatcgagtggcataattgtttgaatacaaaactaaagaaattcagggaatttctccctaacatgcactgtaatagttaaaacacatacagacaactgcagattatgttagaatacaagattgttatttgctatttaccacaattgcaaaatcaacttgtcaaggaaagacaattagagtccttcaaatatcttgatgtttatgtgtttgatggctgtaatatacatgtaaattgtggagtatgacatacaaaaaattattgctttaaatatcattattgctagccccaaaaagagttgcaaaacatagctaagtgtatgtttttttcacatagcaggcatttgcctcccattccttttcctcaataaacaataggataaaggtctaaagccttgactttagatttggagttgacaatctgcacaatccttctgcccaaagccatgaatgtcttctcgtgtaagtgcgcgtgggtgggtgcgtgcgtgcgtgccacgcctgcagagacttaagctttgggatacagagtgaccgtgtcatagccctctgggggctttgtgcgggctcttgcgtgggtttcgcagtacagctccccttctatgaagaagtagcccttttgcttgaggttgaggttgcagtcggcacacacgaagcactcagggtgccggtacttatcccgcgccttcaccacagcaccgctgttggggaagaaaacgagctcaagttaaaaaaccacagagcaaaaatatgagacaaaggagagaacccaacagagaaggcagatgttctctatttcacagtcaggaaacaatggcctccagctgtgaaagcaggcacagccgtgaaactgtatgtaattgtcatggagatctaggatatccacaataaaccatcccgtgtttctctctgatgttgacgtgtgactatttttcagattttcaaacaagtactttatagaaaatttgtaggatcctacttcatgatctttccccatcgtttctttgaagagggagacatgatggagacaagaccaacccctctgcaaaagattctgcttttgacgggggtggttgtctacccaatgaagagtctctctgattgctttccgtctgcgtggtccagcctctattcaatggagcaagagaaaacagatcaaagacgaccgggcgtggtggctcacgcctgaaatcccagcactttgagaggccaaggcgggcagatcacaaggtcaggagatcgagaccatcctggctaacacggtgaaaccccatctctactaaaaaaatacaaaaaaattagccgggcgtgggcacctgtagtcccagctactcgggaggctgaggcaggagaatggtgtgaacccgggaggcggaggttgcagtgagccgagatcgcgccactgcactccagcctgggcgacagagcgagactgtctcaaaaacaacaacaacaataacaacaaaaacaaaacaaaacaaaaaaccagatcaaacagcagagatggaattcctttggggtgggtggattggcttctactgtgaacagtttattccaacttaggcacaatgattgcttctggtaacgtcaggcactgttgtattttactgagggcctctctgctccgagctccctgccctgctttgaccttttggtctcacgttcctccttttgccctaaccaggcttatcccccactgccttcttgggatgtatcctggctaaccggacagaggacacatcagtgtgtgagttcatggcaggaggaatggaataagggaatggggacgtggccacatggcacgaatgccatggagatgttagaattatcttggttgacttgatcctgcactagcaagtgtggctatttaaacataaggtccctgccgggcacggtggctcacacttgtaatcccagcactttgggaggccgaggcgggtggatcacctgaggtcaggagtttgagacctgcctggccaacacggtgaaaccccctctctaccaaaaatacaaaaattagccaggtgtggtggtgggtccctgtaatctcagctactggggaggctgaggcaggagaatcgcttgaacctgggaggtggagcttgcagtgagccaagattgcgccactgcactccagtctgggtgacagagcagggctctatctctgaataaataaaagttcccttgtaatggaagctgacagtttttcaatattttgtttcaacatttgtgtaacttacactgggtaaggataatgtattttaagtaacatcctgttgcctgtatttgtttccctgtgtttatacagaggaggatactatgtatactaaatgtatacacagttcatgtatgcatttactaaacactatacgttaacaggggtgggggagtttaaagtgaagtcttgattcttagacgtgacttttcaacatacatttgggcatcttttttttttcatgagaatctatctgaaattgtaagtcaaaattgctgactcatgtgatgtgacaatttggaggtatatctaaggagtgacagtcacaatgtgctaaatgttggggaccttacgtttcaagttgatgaatagaaatttggttttcacagttgcctttagtctataaagtcttaaaggagaagaaatgaactgtcgccaagctgtatcgtaaattccagggttaaaagtgaaacttacactatgccactcccacatttgtcacagagcggcatcctctgtgccccgcctgaaccgccatggactttcgtcaccggagctctcacactccgcgttccagccggacggtcatctgaaaaacaaagcgtttccatttatggctagggaacagctggccgcagcctgtgcttggcttctattttaaagtgtgcactttaacctgaagttgcatctgcaccgtcattccgagaggggcaggactgatgcaatcataagggacgctgttctgaaatagggcattatagaatggaattagtgaaaacatttattttgttgtggttggaggaaactgttacaaaaacgctcaaaggagcagagggcattattattttttattgtagcaaaatatacataaaatttaccattttcaccatggttaggggtgcaattcaatgacattaggtacatccaaaatgttgtgcaagcactgccaatatccacctccagaactatttcttcacctcacagaacctctgtacccatgaaacagtaactccccacccatgaaacagtaactccccgtgctcctgctcatagcccctggtaactttcattctactttctgtctcttggatttgcctattctggatctctcaaataaatggaatcatacaatatttgcctctttgtgtctggcttctttcacttcacataatgtttgcaaagttcattcatggtgcgccgtgtgtcagaatttaatttctttgaagactgaatactatttcattgtatgtgtatactacattttgcttatccattcatcagtcaatggacattgggtgttttccctctttgggctattgtgaataagataaatgctggcatacaggctgggcgtggtggctcacgcctgtaatcccagcactctgggaggccgaggcgggtggaccacgaggtcaggagttcgagaccagcctggccaagaggtaaaaccccgtctctaccaaaaatacaaaaattagccgggcgcggtggtgggtgcctgtaatcccatctacttgggaggctgaggcagaagaatcacttgaacccgggaggcagaggttgcagtgagccaagattgtgccactcactctagcctgggcaacagagcaagactccatctcaaaaaagaaaaaaaaaaaaataaagaatctgtttgagtccctgctttcaagtgttttggggtatattcctaggagtggagttgctggatcacatggtaattctgtgtttaacttttccaggagctgccatcctctcccagggttgctctatgttaccttcccatcagtaatgcacagggttcccatttctccatatcctcaccaatacttgttattctccatgtctgccacaatagccaccctaatgggacattttgcatttttgtgtggcttttaaaggacagtctatatcttttgggcatggagaagcctaggtcagggcaggagccctgaagatgacgggagtgggctggagacccaggtctgtggctcactggctatgtggcctttcacaaggccacccgcccatctctcagcgtctcatttgctaagtagggcaaataataggctcacctccccaagttcctgtgaggattacatgatactgtatgcaaaatactttgcacagaacatggaacacagtaagggtttttagagcattgtttagtttttgatgatggtgatactccagagtgtgggggggaggctgagaagtttgacaacattcatttaaaatgatatctcatgatttgtaagctgagctagcccttgactaccattaatgcaatttgtctttggtgtccttttgtgacttcacttggtggctacttggacatgtcctggaatctccttttttaaacgaggcaccatccatatcctatccttctgagcaaaaattcatttggctcccaatgaaaaccaagttttagactttcattcccagtatgtttgctgtcgtccccgtcccgccccctgcagtggcctctatcaatacgtttcagcaggtgtcagcggctgctcaccagagccatcgtccaccattccctggagcactctgaaggagcccgactggcgaggctgtgtgggctcattccgattgtcgtggagcatccggtacacgtccgactcggggggcaccgaggctgtgggctcgctgaaacacaggcacggcggggagcatcgtcaggtgctgggaggcaccagacgtgcaagaggccagagacatcaatactcagccattactctatgcacagccactcctgaacagaggtctagtattttcaagtgaatctctagtatagttaaaagcataatgtgaattcaaatggctgccttggaaatgtcattgaacaacaaatcggggagtcacacccacactcctccacttggcaaaatactttggaaggaaactaaaagataattgtcaggaaatagtaattaagaagaacaagacttgagtctgatggatacataatgatagatgtgaacaaaattaacttttcccagagaaaaggcaatatacacatgacagaaagtgcagcagtgagcactcagattattctcagtcatcaaattgtcggtaaaattcacattcacttttgatattaaacaaaaagtatatggtttaatatgtttttagttttaaggctaatttgttaacccctggaaataacaagggtatcattttacttgtaaattctagaaatttaacctctcagggtttgaaagcctgtaatgtagaaacttacatttttatatctgctataactgactgcactgtcttttaaaaatagccatgttaaaattcatttacaataatgacagcagctttaacatgctttctacaaatatattcataatagacaataaagaatttcataatactatatgttaagcactactttattattttatatcattttattgcattatctagaaaacatactatctgtaatatttttattccctatgtcatatttgcaaatggctttgagatatcttacactactattagttcaatgtgttcatcccaagagatagctttgggatatcactatttaacactctgaagcattataataatttaatttataaatagtgattctgtaatagtgaaagaagcagtaagattttatcctataataaatctttttaatcaaaatctttatggcaaaagtactgtgaacaaatagttataacaaagaaaaaattagtcaaaaagagaccagcaaaaattaaatatctacattaacagcctgagggtattcacctaaaaacctttatgcacaataaacattgtaaatgagtaaataatgacctctccacaagctgctatcagaagagagaagaatcatctcataaaattcctctaaacctcccacctccttcctaatttttgatccccaaaggacagacatagggtatactagattataaataactttgagaagtattacaccagatatttgtaaagtacattgtagctttcgagagacatatacatttggtccttacctgatttcattttattgctatctgacacataaagctctacagataattcctcaaatcacctttatcaccaagcctagatatttgcaataaatccttagtattttaaaaaagcttttcacatagctttctttccaagcctagatatttgcagtaaatccttagtattttaaaaaagcttttcacatagctttctttccattaagacaatgttaaaagacaccagtaaagctgacattgcccacgtgtttagttaatatgcccatggttcaaagagactcatattacctcatcaaaggtgtttcccctagggctgttgaaacctgaccctggagtgtttccataatattgtcatctgagtacaactgcataggtgtattaaactgagcatgtacaatcttcacaccaggaagttccatttccaaaggaatgttaggggccagcttagccgcaactttcaagtcacctgggcaaatggtactaacagtactgacagaagaaggggtgctgcgtccactgccacagtcaatcccggagggagtgctgcatccactgtgttaatggatacacgttacacagagatggcaccgggagccagacagtccagacagaagaacacagagaacacgtacagagaggttaaaaggaattgaagacaaaagtgagaggtgaattacatcaaaataaaaccaaatcttgatttgtcactagaatttatttataaagggaagacggtgaaaaattcatgattgaaaaaagtttaataaaattaaaaggtacaggtgatactgcattttttggctctgtttcactaggcaatgtgtaatttgagggttacatgtagaaaagttgtatatgaagtagaaaagatgcagctatcctcactttttaaaaataggccaaagactttaaaactggtcaatatcacaagtgatgaaggaaaattacattggctggacatccttttacatttctgaagtgcaacatttaaaattaaagttttagtgaacactgaatatgcagcatgaagatgcaatcacatatttgggctcaacatttcaaaatcagaagtatatttcagtaatacggttgaactttaattgaatagtaattggtaacttgtaggttttatggtacagattatgttttaaggctatcttgtaaatattttgttactattttaacattttctatttttactctttagttctgtgaggagtatactttaagacaattgttcagtggtttaatacaagccctagaaaaaaccaataaatgcttatcaccttgaaattaatgattagaggagaaataaggtggtgtttcactctttcgatgcttatatttcttacatagctattttatgcacaatttcagaagcacgcatctattcccaggcatatttcccttttccttttaaagatacatttcagggacttattaaaacatcaaaggccagtcatgcacatcgaagaactagggagattgtacattctatttggaaactggataggggtcagttaacaactgacatgctagtgactaaaaagtccatttttccacatgcatgagagataccaagagatttttgtaaaaaaagcatagtcatttaagacaaagcaaaaagaaatattagtattaatgtaaatatttatcatactttccagttagtgttgctgtaagctcaagacagagaatggatgtatatggtgtgtttaccgctaagtcaagattgtctctggtctcaagtatggccccatatctgcatttactctctagaggtattaatgctaacttcagcccatataaagataagaaaccaaaaggtattgagcagtaactttctctactccagcaatgttgcagccggattagtctggagaactcatgtcactaaatgggtttaaatttttttttttttgtcttgtgctatccagtttaactacctacataacctaaaccagacaggtgaataccagcttgctccttcacttcctgccttttgagaacctattgaaaacccaatctgtacattgtttagatcacataccaaaatatcaagtggcctattcaccatttttgtacgatctatagtgactcttgaaatggacttcagctggtaaaagaatatgagtacattttcagttgtagtgcagtttagtcaggatcatgtggatttaacctgagtgtaatgaagcttatgaaatcagtttagggatttgaaacacagagttaaatcctgggagacttcggcctcccagtaatgaacctactcaacaagcatttataactactctcaccctactgtgtgccagacatagtgcccgtactgggtagataaacaatgatcaatttagaacttttacttatgccatgttttatagcggttattagtaatatttttctgctataaaagccatgtataacttttgactcctccaaaacttaactaccaatagcctactgttgaaccgaagttttacagataaacagtctattagcacacaaatagactactacctatgtgtattgtatacattcatggcaaatctttttcttaatttttttgatatttcaaggctaccattagtgacttttttcaaattgtcgcaaatctccaaaaatttttccaacatatttattggaaaaaaaatccacatataagtgaacttgcacagttcaaacccgtgttctcagggtcaacagtatatgcatatgtgtgtactatgtaattttagttaaacatgcattcccagttcctttatcaatcaggcccatgtctattaaataaatgagtaatgaaccctaagcaaacaagaatgaacttttataaatttctgggccaatttaaaaagatcttttaaactgatcctttaagtaaacgagttttcatggattccagtcactgtggatatcactggggatagcaccgtgggtcaccacgacctgttcctgatgacctggaaaggcaggtgctaatgagattttctggggttgacttagtgacttggcaaggccacttgtaaggttgataacacactcaattacttcatgcccagatacgtcatttgacagattgctaatttctctggggtgtgtacagacattttggggcatacttccggaagcaacttgtccaaaaaccactcataggattgcattttatcatttggatctaaaataccttacatatgtatttaattgtagctttacccttaaaaattttacatatttgtatatgaaaacaccagtcttttaaaaggcttcagttatgatgaaataatcaaaagaactatagctaatggtaaaaccccagggaaattgagctgttaacaatttagcatgtccaacttactacttttttttttttttgagacagtctcactctgttacccatctggagtgcagtggtgcaatcttggctcaccgcaacctctgcctccagcttcaagtgattctcatgcctcagcctcctgaatagctgcaattacaggcatgtgccaccatgcccagctaatttttctatttttagtagagatggggtttcatcacgttggccaggctggtctcaaactcctgatctcaggtgatctgctcacctgggcctcccaaagttctgggactacaagtgtgagccgccatgtccagcactagcatgtccaacttacttttgattaaagaagttcattaacagtgtagttacagggtgactatagttaacaacaattatttgtatatttcaaaataactagaggagtggatgtggaatgttccaaagcacaaagaaagttactgctcgaggtgatggatacccccaattaccctgatttgatcattacatattgtatgcatatatcaaaacagcacacgtaccccataaacatgtacaagtagaatgcacccgaaaaaaactacatttgttttaaaagttaaaaacaaatctagttgtaggctggtatgcagccactcacaattccaccttgatgaagaatagtttggtgggaacaaaaaattcagaagttatagcaaatagtgaggagggacaggaagagaaggaggatgttgggggcactcttataattctttttttttttttttttttgagatggagtctcacgcttgttgcagtggcatgatctcagctcactacaacctccgcctcccaggctcaggcgattctcctgcctcagcctccccagtagctgggattacaggtgcccgccaccatgcccagctaattttttgtatttttggtagacatggggttacaccatgttggccaggatggtctcgaactcctgaccttgtgattcgcccacctctgtctcccaaagtgctgggattacaggtgtgagccatcgcaccaggccttataattctttaagatttgtgcactggcatctgttttttaagcaaaccttctcatttctgtttctctccttctctcttccaaattcagctacattaaaaggtgtgatcttcaaatgacaacattatgagtggcttgccattatccctatgtttaagttaaaatgaaaaatttttttaaaaggtgattatatacctaggattctctgactttcctgactttttataaaattaaatgttataggtttttagtaaaggcaggatatgtgttactctaacgtatcactttattcaagccttctgaagccccagagcttgtgtgggtggactcagtcacactaacctgaaaagaatgcaagtgattaattttactatgcttctttgggaagttgtatatattcaacagtaaaatatcatatccttttaactttaaatccagtgttttgttattggggttgggttggggtggggaagctgttgaaagtggagaaacggaaaagatgcagatgagaacagagtatgaacgagggaacacatagagagaagcaggagaggacacagagctgccagcatcgggagcgagacggctctggactcttcttgccacttgcttgggaaatgttgtgcaccctcaggatttgattcctttatccagtgagcatttattgggcatttattttgtctgtttgtagatggtcgcttattgagcatttattctgtctcatttctaggtgctgggggtataatgttgagccagtcagaccaggcccctgcagacactgagctcacgttctaggggggggaagatgtgtttgctcatggttgccttcttaacgcctttctcctgctcctctggtccagggctcctttctggatctgatatcacaagaattgtctggcatattttgagacaatcacctggctctgcctgtagcttcctgaaaggtctggacatggaaatcatacataagggatgacctgctatccgcagcttatgacaggagtcataagctcgggtgtctagaggggccaggaggtcacacatgtatgaaaatgggccgtgtctcacacacttaagagtgatgtgcattttgacaagatggtgagtttaaatgttctgtctaaaggcacttaaattctttttttttttttaaacaaaagaattaaataaaacatgcctgtgaaataaatccacctatgggccatcagtttgcaacagctgcggtaaatcatattcaatgttcctgtcggaatcaatccggtctaaccaccagcttccttcctgtgggctgactggcttagctgaggtcagaaggatggaacagaggtttcctgaagtcactgtttcctgatttggcaatacagggcattattttctttccccttaggttggagttcaatttctagagaagatatttgaaaaggatgatctgaagatgatcagtttctctactgagagacgagaaggaagagcttgctccttatcattctggcttgttcacctgattccttcctcctaaccggggctggtttccatgctcgctcctgctggcagggctttcctgacctgggatagacatactgactgcccgactcaaaggtcacagtgttctggatgggatccccagagcctcaggggtgttcgctataaatacacgtggtgattgcatacaatttcacagctctgtcatcttgtcaatatttactcttggaaatgcaagttatttggcttctgttctctgccaagtgagtttgtttctttttgcttttgaaataagcttcgcaatgagaaaagccactccaaacatctaccagttacttttcttgatgattagtaagaactgatttaagaagcatgcactgcaaactccacagtctcagcgcttatgacctgcttcggcccgggatcacgaaaggtttgggccgaatattatgcttgtgttcaaagtagttcccgtcctgtgaaaacaaagcgttaaaaaggccctcagtggaaggcggacactgttgcagataagattaaacgaacgatagttgtacagggaggatcatttaccaccaactactgtcataactaagaaaggcgatgacgggaccaggacgatgtcttctttccaaccatctatccgctaaacggtcaggcactggcggattggaccccacaacaattagaacatgttttagatgcttgtctttaaaagagaaatctgatagtgccttcaggaaagtaaaaataaaacagcaagagctggacttttgaaaagaaaagaaaccatgctatcactgttaggtacactgtggccagaacagagccggatacttacttttgaggtgagctaggaatgagaccccgcagctgtccgtgaagcgcatcttgtatattgctagttgaatagagcccaattggcgagttataggaagcgctcactacctgtcttttgtcatcaatgtttgcagctgcaacaaaaggctgggcccttctgttgtgcgcggtaccaatgggtttgaattcctgtacaatggcagacaaaatacacagccacacagcgcacaagaaagccattagtgagcgaaaccaacagcatcactactgttaataaaggcatctttacccacgacgagattgacggaaagattagaggaggagttagccataaacttttccatggttttctctgagctttacatgtgctatattcaccgatcaaatgttaaggtgaaaaggaactgaccttatttaacatattataaaataatttaaacattgcacctcttatctgcccctgacttcttcatctatagctttaagaaattctaatgactcatttgaatacagacattttgtgtcagaaatgggatttttggcttgaaaaatatacttaacgttttctcaagtagaatttacatatggtttctcttctattgatacattgataaactttcccccattttgagacatgagggaacaaaacaaggagaatgagcatttacgaataattagctacactgaatcatttaaactaagccaggtgaaaactcgtttttgaaaacaccttttaacaaaaagttcttaacttggattaagctataatcttaattttagaaaacacaagtgagagactctttttatgaaagcgggaataacatatacaacccctccctttattgtaatgatttcatgttgtgtgtttgaagacctcttcatgtttactctagtccccaaaagattaaagtcagtaattcagagagagaaaatgtgtatggttcacaggaggattttcactttattccttgggaaaaggaccaaacagcagagtcctcaaccctgagtttgaaacatgtctgaatgatctaaaatcctataatttttttttttaacgtgggaatcatgttttccagtttttgtacagatttataattttgtaaagcctttaaaacttttttcttctaagcaacagaagaaaaccaaaagggaatgctcaattacaggtcagctgattctctttccaaatctttttttttaatatttatttatttatgagacagagtttcactcttgttgcccaggctagaatgcaatggcgcaatctcggctcactcaaacctccgcctccccggttcaggtgattctcctgcctcagtctcccaagtagctgggattacaggtgtgtgccaccacacccagataatttttgtatttttagtagagacagggtttcaccacgttggccaggctggtctcgaactcctgacctcaggtgatccacttgcctcggcctcccagagtgctgggattataggcatgagccaccgcgcccagtcccaaatctttctatttggcagaattagtaagataaatctttctaacagtattttcccttacacattcacatcaacttcatttactttcgtgaatgtggcaccagtgttccagatttgaaatcgtacaaacatatataattatttgaaataatactggaaagagattatcgtctttaaaacattaaaagatcctgtaatatttagttttctccttttcatttcagataagttgtgggttatgcttttctgttagaaaacagactgtcaaaaacaaaaagaagaaaaaggaggaggaaagaaaagagagtgtctctcttccctaggtgtaagaccagagtttttcatagaagattcttgtgcctgagaatatgaacaacttcctgtagggaccccagctacaaaacgctttctttcagttcttctgagtatactccttcttctactatctaggcctattggcaaagctcacttaaaaaaacaaaaattatgccagggcaatggggtacagcttcaaatcctagcctaggagcctttgactccacccaccccaaatctcaggggatctgagaatctgtgatggggtaaagaacagcatttctctcaccaaccttggacagcatatgttaacagcctcctgaacccaaaaagaaggtctgagttgaattccatttagtctatgattttgtagtgtgattgagttcgctgataccttgttcacttaacttttttccttcataataatggctcacagccaaggagttgattaacattattgtagctgctcttaggtagaatgacccaaaccatcaaatgtagctttagaaaaatgcctaatcctagatcctgtgaaaatgtgtgtagctaaacatttataaatggtgcaatctaattgttttagctgatttattagtgaatttggattggctgagttttgtgattaaccagtataattagccattattatggcatgaaaaactagaaataattgtaagtaatgacaatggccatgattcaagcctttttgatatgagagaagacagcacactaattgcctaactgcctagttaagttttggtggattacaagtctctcaggctaattaaagaatcaggcagtactgaatcacttaagttttgtggagcttagctttttttttttttttttttttttttttttaaagaaagtaaggcctgccttaaagtctttgtaaatagaattgaattaataaaaactaacataatataatggctttatggaaaatacctctgcccttatttcttcttagccttaagatgataattaaatataggtagtgttgtcctgtaaataaggcaacttctctgaaaatatttgtgcattaataatctctagtagaatttctaaatagcagcatgtaagttaatcagctccaagcaatttctttgcaattttcggttttggttacacatatattgcaaagatcacaaatgtgtaatttgttaaaaaaaaaaaccaacaacctctattttacattcagatcataaaaggaagtgtttctaatacaggctgcaaacatttttatttaggctttgcaaagcattagtttatgggcttttagagtcattccaaaaagcacaatgaagtgtatacaccaaaggtttaccaagaaatttaagtggggcactgaggggcaacattctatccaaggcttacatcattgttgatggtcaaatgtaatcaaaagacaaaaccaattagaagtccgctgttccactttaattcatttttatttttcctggaaaaatcacaagtaactgaaaatgccagttaaaaaagtgtatacaacagttaatatagtccagctcttgtgtttattctatctagaaaaaaccacccaaataattcttatttcttaggaattcaatatgtaattattcccttaatggatacatttaaaatttttattttaaatgttagaggcttatattaaggaacaacattttgaattaatggaatgctagagctgccccagtgaaagctaagtaacttgacagaactctgctgatgttaagaggatccaaccatggacagcagtctcccatgtccttggaatgacctcagacatgacagcagtcaaaggcttcacctttcaacttcttacttggagactgctcacagataaagattcagataatctttataattctgaaccatctccaacagaaacagtatgtttgattcatagatatacacacatatatgtatacacatatatatttatatataatatgtatacatatgtgtatataaaatcaaatcatatatatatgaaaaaatggtgggcatataagagaaacaaactctatgaagtgatcttatatttgatcaaggcatgatgaagaaattatatttcatcacgtttgaagtttagaatcacttcctcctcatactcacccctcaaataaacagtaaagtcaccctcatcatccttttttctccagtgagcagtttcaagtgtttcccatctctcactgggaagagcttgaggaaatggtgactatgaaagcttgttttatatgggctgccttccagttaccaaaacactttttatttgtgaaaataaaaatgactttatcccacactcttcttgactgtgtatgtaaactctattatcttctctggcaaggatgcaatcctttttatggaaatggagacagctttcttcttatttagataagaaccatttttgtttctgaaagcatctttcttgtattgtgacaggcacagtatacctttgagttgttccactaacattaagcaaatatgagggttatggtttgagaatgtaagctttgaaaaaggacaaagagcttcattaacatactcttagtcaagagcaacacttcgtactaaaaaatggaccattttgtctatttttgtacagaaaaatagagaaaaatagattgtgttcaggattgcatggaaggcatttattcaggtgctgggagttgatctaaacaacaactaacgtgccctttaagcctaagattcaagtctaaactcagagaaacaaaacttagctatttgatgatagcatggaaaaattattattattattatttgtgagacggagtcttactctgttgcccaggctggagtgcagtggtgcgatcttggctcactgcaacctccacctcttgggttcaagtgattctcctgcctcagcctccccagtagctgggaccacaggcgtgtgccaccacatctggctaattttttgtatttctagtagagacagggtttcaccatgttgaccaggctggtctcaaactcctgacctcaggtgatccacctgcctcggcctcccaaagtgctgggactacaggcgtgagccaccatgcccggccacattttaaaaatctagatattaaaattttatatcaactattcctataaccatataagaaaatgtctccttagcttaaacctattcacaggggaaaaaaacccccagaaataaacatactaatatttaatatctgtggctgggcttggatggtatagttttttccccaataagtaagtgagaaagtgtattttattccaatgtcaaaggtcacataacttacaataaaagtttgacttgggttgagaaacaaaaactcaaatttcatattgttccatggccttttgctattcatctgcaatgacatcctgaagcatgataatattaatggcatttgtttctctaactgacacgtatttgctgtccagaagattgctgtatttgcagagttgtcattttgataaaaaagaaaaagacatcttttttgcacagctttgtattacttagaaaaacaaaaaaccctataaccatagcttagcttttctctcgtctcagtccacaagtgaaactcactgtttgacttttatcagcacgttttgttctggtttacgctaaaggatttttggatagcaggagatacactgcaatttagttatttttgtgtagggaatgtctgtcctgaagtaccaagttacataaactggccgtgcagaaatctggcctaagagtctcataaggagtagaaatcctttggttcattagtagaactgaattgttcttatcttggagcatttcaaacaccggcctcttggagaggatgtcagtaagaattagtcatgacgcaaagtcatggaatgtttcaaggctccatctgactggctgctatagcccttaacctaatctcaacctttaaaaaaaaaacaatttaatctcctttttctcatttgtagtattgtaaatattcatattttctaacccccaaatgtaggacacaagggctaatacatgcttgacaagaggtcagagtatttaaaattaggattatgccttaaaatcccatccttagaataaccatagtcataaattaatactcatagacttgcaatagaagcctctgctagagctacaacttggaaaattacccttaaactccaattctggagagatgttagcaaaacgtgggctcccatcctggtctaaactcactttgtgcttagtaaatacttgctgaattacttacatgctggggtgacggatgcaaccatgatgaaggatcactggggatttggtacttcggtcagatctatctagttggcctcatttcttgcatctcatattaacgaaattgggtttaaaaattaggagaaattcttgcatggaaaaataagttgcaaaggatgcagtgcaatattggatgtgtgctgtgtagggaaaaggaaatgcagagtcccttctggttggtccaggtaatgataagaggctgagtggtcaataagtgcatgtctattgactttaattcttaaaagcaccatatagtctctttttctcatgtgtcacctccaggtgataaattgatgacggtgggaggaagcaggtcagcctgggcatctctgcaaaaggctagatacaagtgagaactctacctcaagaactttccttttttcttccactattttcttctagcaaagaaaatgttgactagaggtgtcattattcaccagcccacctagtatgtcagggggagtcgccatcagcattcagatcccttctcattatatttattatctgtgccatccattttcttttgctcacttaccccaaagagcaaaagtcttacctagcctaagtatcccactcaactttcttttcttttctttttttttttttttgagacagggtcttgctctgtcacccaagctggagtgcagtggtgcaatcacagctcactgcagcctcgacatcctgggctcaagcactcctcccacctcagccttctgtgtagctgggacttacaggtgtgtaccaacatgccctggttaatttttaaaatttatagaaatggggtctcaccatgttgcccaggctggtctcaaactccagggctcaagcaatctttttgcctctgcctcccaaaggattataggtgtgagtcaatgcgcctggccccactcaactttcaagattactttccatgcaacagctgagagtgatggcagaacaccattttgagaactggctcccaggacaggtcctggcaatgttagaaaatgcacagctcatttttaggccctccagttcctttcatccatttgtcagctatttattgagctgtgggctatttattgagctggagggactcagagggaagacaacagcctcaaggttcctgccttcatgaacatattctctgtcctgctcactccttttggggcttattttctcctacttttgcttttagtggattttagattcagactctaccttccctttagtcaaaactctacgacaacaatctaataaactcatttcctctaaagattacattactcaggatccttcttctccaggagagattatattttaactgaaaataaagctttgttccatttgtcacgaccctcgtaatagcaatgaagaaggcattcctagcctctaggatgtcctatcatgtaggcagctaactatctcaccagcaagaaacgccaggagactttcggatcccagcctggggtgggggtaacgtactgataataaggacagctaccacttacttgagtatttctatgaataactcaatgtgccaacttctctgcttgtattattttattctaatttttgagaagccctaggagacacatgtactgatgttattcaacatcttttcacaaaagaaatcagaggcttatggagacaagtagaaaacttgaaggacaaattcaggagttgattttcttgaaaggggaaatactgctaaacataaattacaaatacgttttcagttccctttcatcagttatatagaacaactacatgctgggaatatctaatcagtttagcaggaacatgtgtttcaaaagggatggtaaattcatgtatctgtatctctaaacctttagagcttctatgtagaggtcataaaatgcttttcttaattagatttatgagtacatcacaatcaagatttgatttaatttcaggttttttgggccttttgaaagtagacatagataagcatcagatgattagtttagtttattacagttgcctccagagaaaatcctttatcttttataattcagctgtaacggcagaatatcaccatcatcacactaggcaacactcttttcttagagtaaatttaattacagaatcccagaaatgagaattaaagaagaatgtagaatgagatctgggtgaagacctcgaaggactgaaattcacagtaaccgtagattggagacacctgtttcaaatggtagaccttatttttgctttgctttgttttaacaacttaaactccttagattacctcacggtcatttcacagaagtccattataagaaatgaaaaaataataagtggactctgtagatttagccaaattctttctgatgggagcatattttgtctttcaacaagatgttcacataggaacacttctttttcttgatgtaagaaaacacggataatataaattaatctcggagaggaatgacagacaacagcttcataggtggcttgttccaatttttctatttgtctcttcctccccttggaaggcatccccatgatttaaaaggaaatacaatgtgtatcatttgctctaaaacgcatacctgtggttctgattctaagttgattttgaaaggatgggctttcccatcttcagatacttgtggagaccataagtgagtttctcccctggaaataaaataaaatttgtaaacttcaaattctaatggtactttcagttttagcatactttagtttcccattatgtttgtgaaaatactagcaaacctcactaacttatgcaaaaacaatttttttttttgctgattattctgtattttcccacataattagtcttccccccccctttttttttcttttaatgttgtctccctctgtcaaccaggctggagtgcagtggcaaaatcttgactcactgcaacctcctccttctgggtccaagcgattctcctccctcagcttcccgagtagctgggattacaggtgcccaccaccatgcctggctaatttttgtatttttagtagagacggggtttcaccagttggccaggctggtcatgaactctggacctcaagtgatccgcccagttcggcctcccaaagcgctaggattacaggcgggagccaccacacccggccgaagtcgtacatttttaatgtccttttgggtatggcagactagataaaaattgcctggagtacactgcacagtttctggaggaaggaggcctgcaaggcatgtgggaaacaggagagggagactctgcaggcacactctgcagatgaccaccaggcaagctccctagacctccctacttccctccagtcctactgaggccactgcagaagacagtgagtgatctgccaggtggatgtgttactggcatcaaggaaatgtgctttgtccaacccttctcatgcatctgcctgggacctagtggctcctaagggactgtgtgctcggcatgaacacaggttatgcatagagagtgaaagaatctatttcaccccaaggaaacggcagattggtggattgattgatccttctgtaccacagcacggaaaactgtgagtacaatcataacaggataaacacacactaacaaccactataacaaattattattatcatggttcagttttggatcagggatctgatggcaagagatcaggctcaatttcttagtgtttttggggggtggggtcagaaacatctcagtatttcacatgcccacgtgcatatgcactctcacacctgtaacattcttctgggctgaattctgtacaaaacagccaatggcagacaggatattagcaaccagttttaatataattacagtcaggcaagtcaagagattatttcaggggaatctctccattccattccattccattccattctctaccacactgagaacagtgatataactagttgtgttgttcagtgtttatgtggctaatagttctattttcatagttaattaaccgggttattactggaacaaattcttttagcctcttttattattctaacattccagagaatcctttttagaaatgatttgtcaacaactgctagattgactgactttagtaaagaattaagtagctaatatataaaaagtcagccaaaatactaggtctgtggccctccttgctgggaggatgaagttatttatagttctggttcaggttctcctgcaaaacagatcagatttaagcaccattagttaagaagcacctgtcaattttgagacacagctggtgagctgctgctttaatcctgtcctgcgcatcagcatgagtcatggactctgtcccaaagccgtcaatagccaggatgacatctccaggacacaggttggcagctgccgccttgcttcctggtgtaatctggaagaaatcatggcactatttaaaaaccaacatcccgcagtatcttgagttttgtgcctgacatttgtgtttcagcctggtaacattttaaatgtttaattgggcagaaagactgtaaatctaactaaagataactcttagttggtcagttgagttaggtctattttctcatcctgctgaatgattttgtttcttactaaccacatttcatatccttgtatctgttactctcttttaaaacatcttacataattcccagtgtgaatcatacatttttttgttttaaaaaattattttttatttttcatcacccagaagtctctatttgggaatagagttttactatatttaggcatcttttacattcaggttgaaactgctttcaatccaaatatagcaatccttactatttatcatctttaaaattcacgtaagaggcatgcaatggactttttatctccccccaaaactcaaatgttgaaatcctaaccacaatgtgatggtatttggaggagggacttttggggggtaattaggtcagaagtgaggagccctcatgaatgggattagtgcccttatgaaaaaggcctcagagagagctctcagctctcttgcctccaataaggaggaaacaataacaagtgaggtgtctgcaacccagaagagtttcctcaccagaacccaaccatgctggtatcctaaccttggatttccggtctccagaacagtgagaaataaatttatgttacttataagccacccagtctattgcactttgtttagaaatctgtagagactaacaagaagaggccagataatacacaaaattataacttctcttgaacccttcagagagctaaagtcacagggcaataaacttgaaatctaaggaaagacaggtgccttcaagcaaaggcaagacatgagcacaggctcacctgcatggagcagggcatggaggaagatggggctcccatactagctgttatgaagaattcagctaaaattattaacaaattgctaaagatccagtgtgagttaacatgagcgtacagaactcccggaaaccagagacaaaggaagtttgtattcactcatggtctcttctccacgaatgaaggacagatgaaaccaaactagcaagacagtagattttaattaaaccatagcagcaattacattaaatgtaaatcatctaaacacatcacttaaaaaacagagactatcaaactaggtgaagaagtgagatccaattttatgctgtccacatgtttttcaggggcaggaataaaagaaatacttaagaatacagaatatgggaaaaatatggtttcccataatttaaaatatttaaaaataggaagtttgtaattattactgttgaatattcagttaaagtcaatgattcttttgaccagtatacctactcccaatttttctgggcaaatcccaactatacacctctgtctagacctcacatgggtcttaccttgcctacttctctcatatcatcttacattattcctgctctccctcatccatggtgctgtggccattctgatttccttttagttcctcatgtaggccaagcttgtgccctttctgggggttctcatgcactcttatttctgcctgaaatgcttcccttactcttcactccttctcaacctttaggtctaggttcaaatgctgcactctcagaaagacttcgccaaacatctgaagtagcttctctagtcctcccctcatcatttttcaccattacatcctatttccttaatgaaagttatttgtacttttatgtttgtttatttactcgtgtattgtctgtcttcccaactagactggatgctcttgaggatatgtacaatatgatgtatatttttaatacttcacagtgtataccccagtatttagaataattgaagaatcaattaaaaagcatttgtcagagcttatataaaaaagaactagtccctatatacccaaagattatggcttttaatgtcaacttgtcattgctatgtttgtgagtttctattagagcagaacaatacatactactatcaaatctcaaactgctccaggaagaaactagattatttctaatgctttatttagggatcagtaattcatttgctttttctttatttgcttattctagctatctaattgcggttctaaggaagatacaagttcatctgaataaataaaaattgctaaaataataagttgtcttgtgtcctggatcttctgtctcattactaaaatgtttattgtactcactttatttctatgatcacctcactgtagctatcacaatgatttcccagtaggaacagttaatagaagctgggtgaagacaactggggattattatatcttagcctttgggaggcatttcatagccgttttccatttagaaacattctcagacccagaactgttagtagaacaaaagtttccatccccaaagtgacttgtaaggataaaaataatcttaaacttttaattttctctcatttgtcaaaatcagtattttctatttttaaatgtctaagactagaataattttctttgagttaaaacacagggccaggcatgatgcctcatgcctgtaatcccagtgctttgggaggctgaggtggaaggattgcttgaggctaggagtttgagaccagcctgggcaaaatagcaggaccctgtctctacaaaaaaatatatttttaaaaagctaggcataatggtgcacacctgtagtcccagctgctcaggaggctgagggaggaggactgcttgagcccaggagtttgaggccacagagagctatgattgcaccactgcacgccagcctgggcaacagaggtagacctcctcctctcaccaaaaacaaaacaaaacaaacaaacaaacaaacaaaacacacaagcaggtgtatctcaacatatttgcttttagagcctaacttagcttttctaatataccttaatagagttaagttatgtaatactcaattctgatttggaaaagtctaacttttcttttagctctggttaggatgagtgtaaggtgggatgagtgggggtttgtttctgcatgtgtccacactaattttaaacacacatctgaacaatagcttttcattatctaagtccaatatctattgatatctagagccatacccctgatattggacttagataatgaataactattggatatctaagttgaatatcttagatactgaatattactaaaatttactaacaatattaatactaaataataccatcttatacttatgcaaaatgttacatttgcaaagctccttctcacacgtttgaccattacaactctctaagacaggctggacaaggaaaactggctctggctttcagaggagaagaggtgtctaagtaacctgcggctttgctgctgagcagctgtacagctatgtcaccagctccttcagaagtcagctaggacaggtggttgatagtgatggccagatcccacttctcattttgtattcaacctggttattgctgtcctgagacctctaaggagacagttgatgagaaaaaggaaatagagagaggaatgagagagaaggagaaaacatgatgtctttactttttcctcgttttcaagttcagcgagcccagtgatcagaaaatgactgcgaaattggcctgattttactaagttaaacgatctgttttccctgcattactttatattattactttattgcattattatattctttccttattatattactttgtattagcatgcacagtttattactgttttcccaaattagaagagagagctgaaatgaggcatagtgtttgtcagcggattattttttatttaggttcattagggtctcaaatatcaaaagtaccagagagatcattgaacacggtactgcagtgaatcacttagcaccatgttttcaaacttgtgtgattataagaatcacctggggcccttgctgaacgttaaaggctccagtcctattccagatgctcggaatcaggaacagaatctctaggagaggagccagggaatttatgctttcaacaagcgcctcagatgatttctgttattcacatcaacttatattacttggatctgttggggaaaaaaaagctaactgaaaacacagataaagcatctataatgtcctatttatgtggagacgtaaggcaagcccaagacatggtcctgagatgatgtttctgttaataaaaacgactgaaatagttatggagcaagacaagcacacactgaagcactgcacggtaggcacggaccaaaatcatgagaaaccccattgttcattctccatccctagcaaatagactccgcgtgcctccttggcatccacagccctgcagcacctgcctgccaaagacatttctagagccacaccccacaccggttatattagaatctctgcatgcacctgggcatggctgtgttcagaagtcacatgggcggctttaacatgctgccagggctgggaaccatcaccgtattactattgagaactattatctcacataattcttaagacaatcttacaacatagttatctcttttttaaaatgagaaaatggatgcttggaaagtataagaagcttggttagggtcccacatcccgagaaaacctgaaattcccatctgggtccgcctcgctctatagctcagaatcttctatcatctcgcattgcctctcctgcaggtaatctttccttcaacacctcctagctctttgaccatacttttcttgtggaattctggataggttgtgtgatggcagttcatatacatgttcctttttttctgctgatatattatcttctcaggggttagaagcccatctaagccacagttatatgcccacagtgtctttcacatacgagacattctgcacacagtagatgcttgtgggatgtatgagttacacatgaaccagtacttccacgtagacacggtctgtgttagaacaaaattgaacaggtttttatttacatcaacctttccactacatttgtgttttaccctggaaaagaattgcattccattgcaaacagtcctttctaaaagtttaaacttcaaatgtagtttatattacatgaaatttcaaaagtagtttatgttaaagtcatacactgttctatcttaaagcctgtacaaattaggaacacactaactttttctatattggtactcaagctcatatagcattctcagttataataatcttgatcttggatgtgctctgcataggaaggagggaggagtgaagagggggaagacattttagtgagaaaagacacactggcatcagatatagacaatcattttatatcatgtacacaaaagaagcttgccctgtacactagcctccccttattcacggttttattttctgcagtttcagttatccgagaccaactgcagcctacaaatagtaattggaatatttgagaagtaaacaactcataagtgttaaattgcagctgtgctgagtagcgcgatgaagtcttactctgtcccacctgggtcatggatcatccctttgtccagcgtatccaccttgtctatgctgcactcttcacctgtaaatcacttcgaagtcttagttatcagatcggctgtcacagtattgcagtgcttgggttcaagcaacccttatttcacttaataatggccccaaagtgcaagagcgctgtgcccaagttataaattaaactttatcataggtatgcatgcatagaaacacacacacacacacacacatacacacacacacacacacacacacacgtatatatatatagggtttggtactaatgtaggttttaggcaaccattgggggtcttggaatgtgtcccctgtggatgagaggggattactatattccatattgaaatcttgtcaaagcaaacgatttgcaacttgtctgtgagagtagatctagcttctggatggtccaaaaacttagactctttagaagcttcttataaaaagaaaagatgctcacttgaagaagtgaaccttcaaattcttctgtgaaatgcttaggccagttatacacggtgtttaacaactccctcccctaaactgaacatccaaaactgaaattttatattgcacaaggtctatcacacttattgcctagaaactgctttcctaaaaattgtgtttatcacaaccagttgctaaaaatttgttttgagaatgtctggtgtttgatttaccttacttttgatttttttataatacaaagattcatctggctatttggattgtaaacaattacgggcatgagggccctgtgtcctaattttgtgaactgtaatttcaattgatggaggcagtcatatttgtcactctcctacaaactctggttggagccccattgtctagcagtattgctgtcgtctgtatttgtatagtgtgaggcggggagtgaagggtatagcttgtaggaggacaaaagctgatttaatggggactcgattaaacacatctcgtttatgggactttttgtggctttaagtgtagatattggtatttcaattctttgtatattaagaacttatttaaaactgacacatcagccaggcgtggtggctcacgactgtaatcactttgggaagctgaggtgggcggatcgcctgaggtcaggagtttgagagtagcctggccaacatggtgaaaccctatctctactaaaaaaaaaaaaaaaaaaaaaattagctgggtatggtggcgggtgcttgtagtcccagctacttggaaggctgaggcaggagaatcgcttgaacccaggaggcagaggttgcagtgaggcgagatcgcgccactgcactccagcctgggagacagagcgagactctgtctcaacaaaacaaaacaaaaacatgacaaatcaactcacaataaaacaattctcacttatctttttgtgaaatatttttgagaacacattctatacctatttataataaagtcatgtaaaaagggaacaatctagtcaatcattcataccgtgtctatatttattctacaacacatatgctctactaggcactgtgctaggccctgaatggcccccagattagaaggtttctgccttcggggaatgtgcaatctggtgggatacagatgcagtggaacatctggtacaggcatgacataaggaggggttatacaggccgaaagctacagtaatcaaccggatgagatggttgttactgaaagaaggcttggggagaggcatttgagtggtttccacaggcacagaggacagtggtgtggtgtggggaaaaatggtatcaggagcaaagacacgtcagggaaatcgtaagtagtccagagggcggtaccactgcctacgtgtggaacaaggggaggaaagggagagacaacaaagggagaggaaagaaatgaagttagcaactcaaattgggataggagatggtgaaaagtcatgaatgttgtgcaaagacacgcatttcactctctacaaacaagtgatgccgctgaaggatttttaagaatgagaaaggagcaatttggcattttccagagacggtaagaatatgctgtgtgaattggacgggggagccaaatgtctaggcgtggagctaggaaatcttgaagagggacagtagtagaaaaaatggaaagtggcagatgttgaagacagcatcaataaggccagtgatgaacaggatggcacaaaacaactctttagaaatattggaacaggtgtccattttcacatgtggccttcagaatgcaggctttggaggcacacagacctagcgtcagagcctgtcccactgcttgtgatcatcggcgggttaataaatcttttgaagcctcattctcctcatttgcaaaaggggatgtcactactgctactctcctaaagattattgtgagatttcagtgagttcgtgcacataaaaggttcccatcaatgcctggcaagcaagagagtacaataacacacttacaacctcacacactgcctttcaaaatggtgttaaaatgttaaaagcagtacaacaattcaccatttaacaatactgatagttatttttctgtaatacttttctgtaatactttttattcttttccttaacaaatttcaatattcttatcatttcagtgaaaatattctgaattaggtgttcactaaagcataaaagttcttattgaataaataaatgttcttatttattcaataagaatctactatatacctggctttggggacacttgggatacaaaaatgatttggttttacctgctgtcctagaattaattaaagagaaaagccataatcaagtgaaatcatatttggtcataaactgttattgaaccaaatgtcaaaaatgagtgatacaaattagttatgagttaggaattccagatagaattggtttccctaataataactgccattatatcaaatatatttaccaatagctattgtagtccaactctggaatgtaagtactgctttaaaataaacatttataatgtcaacaactcaaaatttcaagcatatgattaattatattgacatacgattatactataatagcaaaatatttcttttataaacaccttaaaagttttcgtgacaaaattattttggttagaatttaatataaatatgatttattctgtgttaggattcaaaagcttattcaatttaaataaaaaccatactccagaaactaaaacatttcttagtagatataacggaaactgtttttgttggtaaatctataataggaattgcttggcccaggtcactgaagcattttctgcttactttacttaggaacgtttttgggggtatgttgaacagttttcatgtttcatataaaaacacgtcagatgtgtttatatgtttttgaaaaatgtaaaacaaggcttgaaacgttccattgtatgcgtctgtaggatacacattttgacatatttttaaaaggatgttggttcccaaatctcataggcatatataaataaaacagaatttaaaaggtattaccttgttcaaaatctgtatgagcagatcaatcagattataacacatacaattataaaatatggcatgagaagaatacaagaaaataaagtataatactctgcaactaaaagtataatattctggaagtttacgcctttaggtattaaatgttttatatgtgataactgaaataatacattaattttctatgaagaaaaacattgtgttagaaaaaaaccagctagaccaaataatgctttagaattaattctacaaatttactgacaggagagaaaccctgaggttttatttttaccttgttttctcattagacagtagagaacaccaagtaaagcttgactttgacattaaagcattattttccgttttaggctgagtggtttactttgcatcaggtaaactaaactgtctgccacgttttctttgtagctagagttagaagttggtaattcctaagccaagttctcagctttggaaaacgtgctcaaaatgcctggaaactgaggagtgagcattaggaagacttcccctgtctgggctgataggagcggctccagtttggccaacgcaggtcgtgccccgcgaacagcgcgctgctgaacttttcatccggacgagaaaaacgctcagatgcgcgccagctccagggaatgccggggggtgccagtccctcgcctctcccacccgggacccatcatttgttacggaagggcgatggggtgtgttttatttctgttatcacatataaaacatttaaaacctaaaggggaggaggcactcgagcctggcagcctcgccttccctgagcccagtggctctcctcggaaagtcgctgcggacccagaggatgggacacctttagagcggactttgtcaaatctctgagccgctccgcagccacttgacggagttgccgccgcccccggagctgggcgccgaagcccgggagccagcagcgccccgtccgcccgccctcgcgcgctttctggccgccctcggccccggggcatccactgcgtccccccggacgccgccggagtccccacctcgcagcaaaagcaagaatgccgacacctaccctggtgatgaccaaaggctggttgaagtctatgccccctgagagcctgaagccccagggcgcagggcccgggaggatcaccgtctggggcatgccgccttcctcccgcccaccgggctctaagtgtccccgcgcagggcagccactccgcgccgggcggcgtcctggccccgacccgggcgggggcgctttatccccgctgggggtgacgtcaccgccccgccgtcctccccgccccctcccaccccggagagctccaactttggaagcgagagccgcgccagccccgcgggagtgcgcagcccggccggctggggcagcctcccgggccgcggcgggcgcgggggcttcgggttacagcgtccgtcgctctcttgaagtcacacctgtctccctgtttatcttctgcttggagcgcagcagtgcactttgttggaagcgaaagcagccagaccacagcctccatgctttcaattaaaacgagcatcatcgatacaataagttatttagcagtttcgagtgcgttaatatttacttacgacctctgcggctttggccaaattacttaatgtccttttaaatttttattttatttatttatttttcttagagaccgggtctccactttgttgcccaggctagtcttgaactcctgggctcaaacaatcttcccacctcagcctcccaaagtgcaggagagtctggccggggtcctgtggtagtctcagtgtggactcaagtatttctggtgttacgcgttgggatgttgtgattcccaaagggagaggggagaatgagggaagagaaataagaaatgctttaaacactcaagaataagggtcttggacttaatgccccatatgatagggtcgtattggtccaggaggacagagctgcagcagacttttaagagggcagtctgtttggaagcagttttaagactgatggaggaaagagaaaggagatgcagaaagcagtaagcagtaagcagtaagcaaagcgaaccagcctgggcaaatgtaaatcacaaaggtaggatgggcattactttgtccgctgtggtggattacataaaagtcccaggggataagcactttctagctccacacatttcccagtgccccatctatgctggaccatcgaggagctgaacattgtgtgtcctgctgactgcctgtttgggctgtggctgtatcactgcagagcacatttcttcagtcagctgctggctctgtctgcgtggtgcagacatacacgtgcacacacacagaggtccattcagaaaaaaaaaatcagacaagtcatttggtgttgtgtaattatagtaattgtttttaccttacttcacgagctggcttatataaacagctgattttttctttgcctttttgctggtcattttggcatcatttagatgtagccaatatctatacaatatccacataatatctgatgagttctttctttttgttttttttttttttttttggagacagagtcttaatctgtcacccaggcttgatgagttcctaaggctttgcagagagtgtggaaagcagggacatgagatgggcagttttcctacatcctgctcttcacggagaccagcaggaaagtgctcagaagtgactgttaaggtagaggtgagactagctgggagggagaattctaaggaagaagcactggctgcatcctaaatggtcctagaaaatcctgctttgggtttgggtactgttctaagaagaggttctttttgcatgactttgatttttttttaagtttacttatttatttattgagatggagtctcactctgtcgcccaggctggagtgcagtggcacaatctcggctcactgcaagctccgcctcccgggttcaggccattctcctgcctcagcctccagagtagctgggactacaggcgcccgccaccacgcccggctaattttttgtatttttagtagagacggggtttcaccgtgttagccaggatggtctcgatctcctgacctcgtgatccacccgcctcggcctcccaaagtgctgggattacaggcgtgagccaccgcgcccggcctcatttgtttttttctttggaaacggggacagtgttaataagaatgaagtaatcaactctccttggggtgtgtgtccaggttctagaggaaggggtgtcagaggtggaccttgaagggtaagagaatgttgcaagtggctggagttgggaggggcacaggagggaggacattcaaggcagaagaactgtataggatgtgccgtcacagggagggaagaaactgatgacccattaggaaatagcaagtaatgtggtatggatagagcctagcccattgggtagagacaggagacaaggatcacagtagtcagtggccatattagtagagaggatttcatacgttacaataaggttttgactattgagagcctttgaagaattgtaagcaacatgaataataatcaaatttgcatttacaagcatcattctgggaggtgggaggctgaagcacaattgaaggagataacccagggcgtcccatgaacaattactgcaacaatccagtggaggatatcgattggggcaatgaggatggagcagagtgggcagatatgggaatcacataggggttaattggcacaatctggggacaaatctcacatgggggattaggagtggttaggagatttggatggctcccagacttccccgttggattttacatgaatggtggaattatgaacaaggagaaaatgtgtaagaaatacaacaagctatttttgttttaattagggaatggtgggttagagcaccattttggccgtgctgattttgacacctgtagaatatctgtgccatatagtgtactggttaaaagactaaaagatttggagccagactgccagtctggatattctagatccattgtatttgctgtgtgatcttaaggcaagttatttaccatctttgttaaaatggtgatagtgatagtatttgcctcctagagttactgtgcagtttacctgagttaataacaaaatacctgaagtgtgcttggcacacgctttatacatgtaatcattggctattattattataagcaattggagatataaatctagagatctgggcttgagatgaagattttggaattatagtagaatctatggctataagttagacattttttaaaaagtggttgcaaatcctttgacactcttcaagaaatggaggctatgtcttctctccttgaacttgcatagaggtgtgactcttatattactaatgaaatgaggtgagacttctgaggctaggtcaggaaaagcaatgcagctgctgccttgctgattgtaacacttgtgtctaatgcctggttgccgtgtaagagctctgaggtgccacgctgtggggaagcccgggctgcatgaggaggtcacatattggtactattattggtaaccccagactaggcaccagacctgtgagaaaagattcttctttccagtgtgtcttagccagttcaggctgctatggcaaaataccatagattgcatggcttaaacaaaaggctttcatttctcacagttctggagccttagaggtccaagatcaaggtgcaggtagattgagaacctggtgaggcccctctccctcatttgcagatggctgccttcttgctgtgtccttgagagaaagctctatttaatcccttcttcttcttaaaaggacacagatctcatcatgggggtttcaccttcatgaccttatctaaacctaattacatcccaaaggccccactgcctaataccatcacactggggattagggtttcaacatacgaattttttggggggacacaaacattcagttcacgacacagtctccatccagtccttacatccctctcagcctctgagtcctctcagctcaggctgcagacattgtggggcagagaggagtcaccctcactgtgctctttctgatttgctgacccgtagcatctgtgagcataataaaatggttgttttcagcttctaaatttgaggatcatttgttacacggtaatagtaatagataccagatgaaatcacccaaggagattagctatgcaaggggagaagacagacattgaatgattgaaccttgaggaacagcagcatttaaggggcaggaaaataaggggaccagagaagatgatttttctcttacaaaacatttaaagaaaaccatgaaagtgacagcgtggaagacaggtgaggagaaaaattcaaagagtgaaggcaaatatcacagagaggtgcaggtaaagttgtaatgataggtgcttgttagatttgctcattctcgagttactggagtcttagggcagagtcaacagaatgatgaggacagaggcagcctgctgtggtctgaagataatgggtggagacaagaatacggaaaatctttccaaagaatttgtttataaaagggaaggagagacccaggacggtcagctgaggcagtgcacatcaagagaaatggcttttaaaaaattaggatgcaagggtttgctgaagtcagagaagatgctgagaaaacagagaggggatagggatggagcaagggccgggcattgatgagcggtggaaatgcacgtctccaggatgacacaccccttttcttctgagaatggttggagttctgtaaattgaggtgtgttagctgtacaataacagatgatctagtcctgtagttcattgaaaacctccctgcctgctttaggccttcggggacttcacctcttgttggcggcaagtgttctgagattgcttccctgccaacaatctttcctgtgctttctacctcacagacttatgccagatggagacgctgtcactcttcgggtcggggacctatgctagcacttcattgccctgggatagagcaaaaatctgctaatgaagggcttggagggcctttcatcatctgtaaacatgtgccgtggacgctcttcaggtttgtctctatgtcacacaacagtcattgcaaaggctggccgggggttctggcttctcttcccaggttttttatactttaacattttaaaactttctttttctttcttccttccttcctcgttttccttccctacctccttttctttcttcctgtctttaagggaagagtagatatctgtttatatcttgggttcccttagccagctaaatttttttgtgcattaaaagagcattggtggttattagaaatgcaaattcttgggctccatgctcaggagatttgaattcagttgccgaggacaaaatccactgtgggtggtctgtggaccacacattaagaaacagtaattccagtcaacacataggattagactttcttatactgtatctttttatgtgctgctcctcctttctggaatgttctcttttgtctatcacatctcaccctctttccccatttcctgggaagattgaccatctgtagctctatcagactttctccttgcttagttcttacatctaggcaacataacacgaaagtctgaacttggccatcctccaatttctccaatttagccagtcacttagcaatgtgaggtgctgggctaacaaaggaacgaggcatggatgtgggtttgggaggtgcacactcttacaacacatcttttccataagggctatttttctgaattcccaaccagacagtaggctcctccagggcaggggctgcctttctttggaatcaaccacaactgtcatcccagtgctgggcgctgaagaggtggtcagtgattcctgatagggagaaacaggtttcgtcctgagatttgttggatgagggaagctgactcttccttctatattttccttcaagaatagtcctaccaagaagcaccttctggccaattgccattatgtgcagtgtttacagtttcatctccctcagcttcaccttgctattggtgtatttgcatatacttgccggtctggctgtgcagatcaacttatcccagggccaggcagccggccagccagcgctcccaaaccttccacgcattgtgtatgacttcctttttgggaagagcccatgtgattttcatgttttggaggacctggcccttgtgaaatctcttatggggaattagccacactgaattccacgctttgtgtctgccctcggtgctggcaggagcctatattgtttcattcccacgtcgtcacactccttgggctgatgtgatggttcagctcgagttcatttggtattcccctctgaaatgtcactgagttttcccactgtttgttctgaatgaactaataacaattgagggaatcattagtatgctgggaacacgaactgagacattgtgggtgagcagcaaactggggcctcctttgggcatcagctcctgttgctgtgtggctgccatttcagtactagtgcttttgctgggttgtgaagaaagagggtgtgcatgagggtgtgtgtgtgtgtgtgtgtgtgagagagagagagagacagagagagtcagggtgggggaattactagtgttttgctgggttgtgaagaaagagggtgtgcatgagtgtgtgtgtgtgtgagagagagggagagagagacagagagagtcagggtgggggaattactagtgttttgctgggttgtgaagaaagagggtgtgcatgagggtgtgtgtgtgtctgtgtgtgtgtgtgtgagagagagagagagagagagagagagacagagagagagactcagggtgggggaattttcacgtcttcccatttaagcagcttgcctctgccatttccatccttactggattgccttccagttggatttcaagctgaatgagggcgtgttgcttcttgccccgtcttcccttgtggacgcatgatctggttctggttctgtgaaagtgattttgatgagaagagctgctgtgaagtgtcaggcattgtgctaggcatttgagatgttagttacttctcattcttcagacaatcttgcaaaagcacgtatgatcatcccaggatggagagagggagaagataaagggttcctggagagtggtagagcaggactcaaacctgactctgcatcttttcgctgcttctcaattcttttactgcttcacgttgcctcttaagaaggcacatttgctaaggtttgctgaccctagagcctctctcacaacctctattcaatatttgtgcaatggtttaagctcctgaaaagccagcagctctattcagactggtttcattctccctggggactaaggtgaagtcacaaaatgctgtggaagacagctgaaatttggagtccatttccctcttcgcagcctgatagtgttgttgtctggatcctagaaatccctgcctagatgtgcatcaggagaccggaaagacctggtcttcggtcaatggtattttgcttgctagggttagctggcctcagattctctctggatgcacctgcacatgtttttcatggcaccggagagcaatctgaagagccaggatgcatatttgtaatagaaacacatctgaacccattcgtcagtaacagagaccatacatttcagggcttttttttaatttggagtcagtttatcatcgctataaaagcatttcaaaggagaatggagtgcacagagaccctggggagcagtacagggagttcttggtttggacggctgaatggtttggacggctgactgcctggcctcggttgagtcactcccaaggtctggagtggagcactaatgctagtgtttaatctgtcacagacgccttggccttctccgtgagctttcccacctgttccgccgctgggacccgtggctgtctcctaacaaataaaatgtgtgtgttctgtactagacatgtcagttaagtcaagagaggactgggttccatatatagtcatgtttgtggtgttgagtttcttttttaaaaagtcctttaactagagatgaaaaattaggataataactaatgattaactactttatagggtccatatttaaatgatatggaaaatattgttcatattctaggataataggctcagatttctcttcaagaagagacagagacacattttagagtggaggaaaattaggacttctgccctgtttctttccagttttctgatgacattgggaagaaatgaacattttaggttttaagtcctggccagctggttgtggttaaagggaaggttaggctgggcgtggtggctcacgcctgtaatcccagtactttgagaggccaaggcaggtgggtcatgaggtcaggagttctagaccagcttggccaacatggtgaaaccccatctctactaaaaaaaaaaaaaaatgcaaaaattagctgggtgtggtggcaggcacctgtaatcccaactacttgggaggttgaggcagaagaatcacttgaacccaggaggcagaggttgcagtgagccaagatcacgccactgcactccatcctgggcgacagcaatactccatctcaaaaaataagaataaataaataaataaagggaacgtctctctacaggaaagccatctgcaaggaaaacacacttgctgaaactttcctggaatagagaaatcactaaattttagatataaattgaatgtttatgatccaaattaaaaccaaactcagtgaaggccttgggcctagctatggcattaagattgttcatcccttggatcctgtcttaccagaatcttctggattttctctgacatgcatcactggtgctccttatagttccttgaaaaggtcccccttctcattgctctaacatggcagtgagtcccagattcatctcacttttggaatatcactgggtggtctcattaaaacccatgcccttttctacttaaaaatgaaagccggcccctcccaattaaatctatagctccttttttactgtttgctggacctgagagtcatcttgaagtgtctattcaactttttctctcagaggaactcaaactcaacttgtccaaaattcaaatcttttgcttctttcccttcctctcccctctgttttggtgaagagcatccccacaatcgtccctcagggctcaaacctgagtgtcaccttccacgcctcccctcaaccaccacaagtacatatcaggtcagcaagtctcgtggatcacatcctccttactagcctcacatccaagtcctgtggaccacattggtatgttactctctcctgtttcttcctgcattatcacatggcagaaggagagaaggcagaagcaagcacatgagacagagagaaaaagaagtccaaacgcccaagataactaacccactctcacaatagtggcattaatccattcatgagggtagatccctcatgggtacatgaccagctcttgcatcgaaacccttgtctcaatgccgactcttttagttgctctcacggactcttcgtggggtgaccagaagcttcttctcacctctttccttgccttgggctttaccccttcccgtccaccctgcatgctgctgccactgtgatctgaaggataagtatcacggagtaccttccctgtttaaagttccttgggggctccccagaagcattcaggataaatatcagatgccttgacttagtccatagtccctgaagctctgcctcagattgggtctgtagcttcaacttccactactccctggacaggtgccctttctctagccatctaaagctcttgtccacagaactccccaaatggcctagtgttttaagaccttgaccatgattcctctttggcttggattcattcattcattcagtcagtcagtcatttattcaacaattgtttgtggagcttgtactgtgtaccagacacccttccattgattcctgctctcacgaaactcacattctagtagacgaatacagtaaacaagcacacagtgaatctcagatagttctgtaagttaggaaggcaatgcgccagggtcatgagatcgccagtactaaaaggtatatgtgatgaaattacgtgggatgtgcgtgtgctcatgcagaaaagcaactaagacctcctgagctcaagagagctgcccaaagttggggggcaccaagtggcagagacagtggttaaacatggcagtgtgggtccagcgtccacacgcacggctcttgatgtgcactttatcctgggatgcagctgaatacttggcacatagcagccaagtacatggaaggaggggaagataaaatttccacatgtgtccaggaccatttaaagctatttcccacacttttaattcactcgtttggaataatgtgtgttacaaattcacgctacacgatctatggcgttcatcatctggaaagaagggtctactcccaaaggcaggctattgagttcaaatgcaccagtggatccaatttcttcttgtgaaaatacaggtggagtagatgaatattttttaaaataaacatgaaccaatctgttaaaaaaaatggtgtatgtgaatctgcaggggctgtcttagacagcgttctgtgggaaggtcctcctgagaagggctatttttccagagatctcagctgggagggaagagccaggagctgtgaggaacagctgcataaaggccctgagttgagaataccctgagtgtttcaggggtgtttacaaggccagtgtggttgcagtttagagattgagggagagtgtggtagaagatgaagaggaagagaccgaatcatgttggaccacggaggccatgaccaagagtctaattttttatttaaacgggggagtgatgcgatcagatttatatttcaaaaagattgttctaaaataacaagtgttggcagaatgtggagaaattgagggactcatatattactggtggggatgtaaaatggcacagccactacggaaaacggtttggcagctcctcagtaagttacctcacagactcaccataagatccagcaattcactcctaggaatataaccaaagtaatcaaaaaccggtgttcaaacaaaaatgcatacatgaacgttcatagcagcactattcacaatagccaaaaggtggaagcagcataaaagtccatcagttaatgaatgagtaaacaaaatgtagtgtatccaaacattgggatgtcactccgccatagaggagaatgaaacatttatacatgccacggcatgcatgagccttgaaaacattatgctaagtgagaaaagacagacacgaaaggccacatattgtatgattccacttatatgagtatccagaataggcaagtccatagaaataggaaacagattagtagtttccaggggctggaaggtgtggggaacggggagtgactatttaatgggtacaggtgtccttttggggtgataaaaaggttctggaactaggtgttgggggtggttgtagaaattgtaagtttacttaatgccaggaattgtattctttaaaatggttcaaaaggtcaattttatgttatgtgtattagtcagcttgggctaccataacaaaatctggcaaactgaaaggtttaaatcacagcaatttgttttctcatggttctggagaccgaggagtccaaagtcaaggtgccagcagggttgatggccggaggggcctctccccttgggtggcagatggctgccttctcgctgagagctcatgtggctgtggtctaaggatgtaaaatgggttcagccagcttgctagtatgctagttcaatcctttgctttgcatttttttaatttccattctccaactagcaaactgacttgccacagattacaaatttcctgaaaattaaaccataaagggatttaaaatctattttaagatgtgtcaaacatcttgaaaaaagttaatgaactatgtattttttaagatagtgtgctgcctaaaaagataagccaaatactttgaacgttatgctagtcagcaggtgaaatacaaaaatgaattgcacattttcttgaaagcatgatttttaaaagaaaaaaaaaagaaatgaagtgaagattaaaaagagaaatttgcatctgtgggtgtcctagagaagcaactgtaatgactgcctgccattcatgtgccacggggtaatctattcagaggaggtgtgctctttattctggggtaatgctgtatggtttctctctcataggttaaatttagccctctaacttataatgtacttacttatacagggcttcattggcatcaagatgtcttttagctaaatattttttgaaggtataatagacgagatagtgattgacttgagagattggtgggaggcttcacaggcattcctagaattgcagacagtttcattttaaaaagcagtttaaaacagaagacacagaattcatctgtccaggagcttttagtattgcctggttgtggtgaagaggccaagcagtggcaaccaggatagagtccttagtataatgtttttttactggtcttttactggggccctcaaattagaaaagatatctctactgaaaaattctctacgagagtcctaagatccttacattgttatacccagttttgaaattaaaatttaattgattattgcagttttaaatgaattgtcaggaacttgggatttcttttattgatatcattatgtgtcttcaccatcttctattaagattttgatgggttatctcaagattagcacccagattttaatttatttaaagaaaattgtggtgtcacttctggggacacagacaaacaaaacaaaggaaaataaaataaccaggtaagtcaacatagattgctcatacatactgcaactcaagttttgagtttctaagtttctccaccatttggcatgaataaagataaggccatttctcattgtcttctgtatgaggtccctctttgaagcaaatactctcaatgaaagaaaatacatatttgcaacaccctggaattcaagattgtctgggcatatgtgaagtacttgtgaatccactgggtactaaattggtatttaaataaagaggatttacatgagtaaccccttctgaagaaactgatcctaaaggaagatacaataagaagttggataaatactcaaaactggtgcaagtccatggactggtttaagagggaaagggttattctaggtgtagctggtagttatcatttcagataagccatgtcaaagcatttctgagtcccaaaaaagaagttacaataaaataatgagaaagagtgatgttataaaaatatctatgggatttgagcacacatgctgccagaaaactggtagtttcggagggtacatttcttagtgagcacactctcaacatgccatgaatagttgttgggcattggtggccttggaacagaagtaggtagtagacattagcagctgtatcactgcctctgggagtgagcacagcatggacttggcttaggcttgttgcctgctctcctgggaactgttatcaggatcagtgactttagtgggtagtatggtttgaatgtccccaccaaaactgacatttaattgccattgtgacagtgttaggaagtggagcctttgggagctgattaggccatgagggatctaccctcatgaatggattaatgccactgttgtgagagtgggttagttatcttgggcgtttggacttctttttctctctgtctcatgtgcttgcttctatcttctctccttcgccatgtgataatgcaggaagaaggccctcaccaggcccagtgccatgcccttggacttcccattctccagactgtgagccaataaacttctactttttacaaattacccaatctgtgttattttgtatagcagcaggaaatgaactaacacataggcataagcaggagtgatgacagcttctctaagcaatggtggttttgactttatgatgtttaattttatgtgttaacttctctgagccattggatgcctagatagctggttaaacattacctctgggtgtgtctgagaacgttttcagatgggattagcatttgaattgatggactgagtaaaacagatggccctccccactgtgggttgtcatcatcccatccatggagggcatgaatggaggaagattgaatgaactttgcatgactgagctggaacattaattttctcctgcccttgcacttgtattctcaggccttcagacctggcccggaatctatgtctttggctctccagctctaaggccttaactataccactggctttcctgagtctccagcttgcagatgtagatcatgagacttctcagccttcataattacatcagccaatatcttatgataagtctatctatctgtctatctacctatcatctatctgtatcaacccattcttgcattgctgtaaagaaatacctgagactgtgtaatttacaaagaaaagaggtttaactgactcctggttccacaggctgtatgggaagcatggtggcatctgctcagcttctagggaggcctcaggaaatttacaatcatggcagaaggtgaagggggagccagtacttcacatgactggaagcaggaggaggagtgtgggggaggtgccacacacttttaatcaaggagatcttgtgagaactcactcactatcacaacaacagcaccaaagggaaaaatccatccccatgttccaatcatagcccaccaggtcccacctccaacattggggattaaaattggacatgagatttgggtagggacacagatccaaacttttatctatctatctatctatctatctatctatctatctatctatctatctatctatcatcaatctatcttctatcatttatcaacaatagatatattcacagatatatacttgtggattggctttggagccaccctgagtaaccctgagtaacacagatttcatctagattcattggtataagctggcactgttggtgtaaacagttgtaggcactggcccatgaaaggcggccattgtggaacacatgtgagatactcctggggaaataaaggaaaattggggaggaatccaaggagagttggagttcctatagaattatgggggcagaagcagtgttttagttttctatctttaattgcgaccctctttttatcccaggttggagcaaccagagaataatatttggttagtttggaccagttctcagcttaaatttttgatgtttggaggttttaggtgcttggagggaatcgatgaataactgagaaagtcttgcaaagcattcttttcctttctgttctttcagtctttcttctgttcaccttaaaaatgtcaaaaattccttaattccaagattttcaatgtaattttgtattaaaagagcctcttataagagtaaatgtttcattgatatttttttctactaatgtgaaaagaacataagtgaggatgagttttattgagccctacaggccagagccaactagatagatcccttaagaaaagttcatggttgttactttggaagttgggcatcattactttccatcctgtcatctgctcctcagtggctcagctctatgttgatcattagactcagacatcaccttggagtctggcaaacagctgctgcccaatttggtttaaggctagagtcttttctggcaaagaagatggatctgctctttccagaagagttggtttgaatttaaacaatgtgcatgtctgccaggtctgcagagaacagaatgaaagccagcaggatacctagcctgtgagctggcctggagggtacaggcaaggcctgtaaactcaggagcctggatgctaaaggattaaatattgagctctcaagccagcaaaacccagtcatggaacaattgcgtagtcttggatcttggtacaccacattgtatctcctgaaaatacttacatactgcaaagattaggtatagcctggtcctaaacccccctggccatatatcatacttaacgaaaatggtaatagtaatagtaatttattattactactagaaatattttgaataatattgtattaaactagctatgatggttaatattaagtgtcaacttgattggatttaagaatgcctagagagctggtaaagtattatttctgggtgtgtctgtgagggtgttgccagaggagttggacattggagtcagtggactgggagaggaagacccaccctcgatgttgagctctcaagacttttggacgtggacagatagatgcattactggcttccttcctcctcagcttacagacgagctatggtgggactataccttgtgattatgtgagtcaattctccttaataaactccctttcatgtatacatagatcctactagtttgtccctctggagaaccctgctatatactagccattacatagccattgtgaatctaccagcttctcacttatttgattgtctcataaactcccacatgtctagcattgtgaaatggcacagaaaaatgaaacaagaaatgacattttctgactttgagaagacaagatatgctttataaagtaactggagtgtaatacaagggtaaactgactgttagaggttccaaaagttaaagacaattctgacaaaaaaaaattgtatgggtgggaaatagtcagtgaggcaaaggtccctgaatgctttgcacatcatgaggaaagggtttaatcttagctggcagagaagagaggatttagctttgtaggctggtagcaaagattaattaacttaagcagaagaattcgttgcctggaatggaggcagggctgaacaatcttggagaaaatatatgttcttaatcagatggaactgatgacacaggctcatagaagcgattgtggaacaatccagacatggagaaagagtaaatgctggcacatcaactgcagtggtgccgatgaacacgaggacagcagaaatacctttaagatgcagcaaagcttatgtgtgcaggggacctagctttgatcttctggacaaaagcagtgaccacagaatagctttgcacatacaattagaaactgctgatgttaccagtagagatgagtccctggcatcattgcaagtagggacatgctcagtgggaaaggactgttggaatctcagccacattcccattctcagagacaatattcttggtcattttctttttcagtcctccattacctccagaactttttgtgcctctgaatctgtgtgtttactctacttcccctccatccctttagggcccttgttctcctggagtaatcttcctcatccttcaaaaatcacttctctaacaccccaaagaagctctcagtcttctaggttagtatttctactttgtaaatagctctactttagcacttatatttgattatatttagtcatttaaatgtggatctttcaccccagattgttcattcttcaaggacaaggggctatgtcttatttatagtaaatgcagggattgggcttagtcttggctttgaatccctgctttactactaacttgttctgtggcttttagaaacatgattaatttctctttaccgcatgcccttcatttataaaatatggcaaatagtatccacttaataaggttacaaattaaaaactaatcaagataatgtatgtaaaacacctgtcatagtgactggttcatagaaactcaacattaatttttttcttcctttctcgcttttgatatagcaaggctcagcacagtgccttatgtatagcagaaactcaataaatttcagtggaacttacaaatgttaaaatttactgagtgcttaccacattccaggcactgttcaaagctctatagatgtatagtaactcatttaatactgtgcctaacagcatggagaaagcactattaatatgcccattttatttatgaggaaaccaagacataaaaaagctaaatacttcctcagggaacatccagcaaataaatggcagaggcaagatttgaatctaggtagataggactctgaagtccatgattctataggttgattctacgtagttacataggatgttgaatcctctgaaaatttcctgttggtgaagacctagcccattcagagagtaccaagagcagggttggcaaatggcttgagcaaatccattcctagtatactactccaaggaattctgaattgcacttaaattttttatgagaaattatttcctgtgaaagaagagatccagttctgtcatggcactccttcactagggtgaacatcccttcaaatcagctgatgagttgactaaggaacatactcattggagtcctatccagaatttgcttcatccttgtcatgcagtggagggtggcccttgaagcataaccaccaccaccaccaccaccactgctgccaccaaacaccactggtggttttttccccctccaggggatgcttctattggcaatgctgtggagtgagtcctgctggagctccactttgcagctgagaaaattggagctcatggaggtaactaatgtgcacaaggtcacacagccagcgaacacctctacccagagctatctgactcagggccttctcggggacccaagagcaatgaattagagaagctgataagggttccagagtggctagtcgttggcttgcctcaagaggagagatgagaagatatgccatcagtactcttagggcagagctttcacaagctatcttggagaagaaacagaagaaaaactttcccctgatctgaggaatgagcatttctagtgaaaaaagaaaaagtgcactacagaaatgttcttttaattattcctgatttagattagtactgaattttggtttgagcaaaaaaatgatttaataacctaaaattgtatttaccctaaagtcagatttgttttctttgagaaaagttagggagagcttccaaatcacttcatcttctatttaaaggggaaaaatatttttctataataaatttcactttaaaattaagcaatgggactacaatactttcctgtttccctaactcactatgtaatttttccatttgcagggaagccaaaagatgaatttctttgtaggaagtggaacgttgtataaatattttctaagaacggtcatgcacagacaatattaattaaaagtgatgaaatagtataaccttatgacatctaattttggttgtgtgttagtgtgttgattgatggaatccaatttcctttttacttcatttgagcccatcttatggttcctcagcaaaaagcttggaactgagcaggcatgataagtaagactaatgtgcacagagcacacattccttccaagctggaaaggacatgcaccccttctttccccctacttggccagctaagcacacactgtacttgagaataagtcaagaataaaatcacaaactttgaatatgcaatgttgaaaaataattggtatatttgaattttcccttagaaaagattgcatgaggactcggtattgatgctcagcacggaaatgactgtctctcttccccagtgaagctctccttgctgccctccctttcctatgggcattactgtgctgctgggttcagctggatggagactccttcagggccatgtaattgggagataggaggcaggacatgctccaagctttctaatgtcattgttttcacaaactgtctgggtctttgttccatgggcactaattctcaatacaataagactgacctgtccaattttctgtttctgtgtctgtttccttcaatttgcaggtagccgggacacaagtgcttctgtttgactcccggttatgctgattgatatagtttggatatttgtacctatacaaatctcatgttgaaatgtaatccctatgttggaggtgggtcctggtgggaggtgtttttccccgccaggggatcattcgtttcatacagactttatttttatttttatttttccacaagtgattgagacacaggtggtatttggttacatgagtaagttctttagcggtgatttgtgagattttggtgcacccatcacccgagcagtgtacactgcaccccatttgtagttttttttatcccttgcctccttcccactcttccccgccaggtccctaaagtccattgcatcattcttatgcctttgggtccttatagcttagctcccacgtatcagcgagaaccatacgatggtttggttttccattcctgagttacctcacttagaataaatggtctccagtctcatccaggtcactgcaaatgctgttaattcattcctttttatgactaagtagtatttcatcatatatatatatatatatatatatatatatatacaccacagtttctttattcagtcattgacattgatcgatgggcattttggttggttccatgattttgcaattgtgaattgtgctgctataaacatgcgtgtgcaagtatcttttgcatataatgacttctttttgtttgggtagtaatcccactacccagcagtgggattgctggatcaaatggtagttctacttttagttctttaaggaatctccacactgttttccatagtggttgtactagattacattcccaccagcagtgtagaagtgttccctgttcactgcatccacgccaacatcaactattttttgattatggccattcttgcatgaggaaggtggtatcgcattgtggttttgatttgtatttcccttatcattagtaatgttgagcattttttcatatgtttgttggtcatttgtatgtcttcttttgagaattgtctgttcatgtccttagcccattttttgatgggattttttttttcttgctgatttgtttgaggtcattgtagattctgaatattagtcctttgtcagatgtatagactgtgaagattttcttccactctgtggattgtctgtttactctgctgactgttctttttgccatgcaaaaactctttagtttaattaggtctccactatttatctttgtttttattgcacttgcttttgggttcttggtcatgaaatccttgcctaagtcaacatctagaaggggttttccaatgttatcttatagaatttttatagtttcaggtcttaggtttaagttcttaatccatctttagttgatttttgtacaaggtgagagatgaggatccagtttcattctcctacatgtggctagctaattattccagcaccatttgttgaaaagggcgtcctttccccactttatatgtttttgttttctttgtcaaagattggttggctgtaagtatttgggtttatttctgggttctctattctgttccattggtctatgtgcctgtttttatactagtaccatgctattttggtgactatggctttatagtatagtttgaaatcaggtagtgtgatgcctccagatttgttctttttgcttagtcttgctttggaaatgtgggctcttttttggttccatataaattttaggattattttttctaattctgtgaagaatgatggtgatattttgatggggattgcgttgaatttgtagattgcttttggcagtatggtcattttcataatattaattatatccatccattagcatgggatgtgtttccatttgtttgtgtcatctatgtttctttcagcagcatttggtagttttccttgtagaggtcttttgactccttggttaggtatattcctaagaggttttggtaggttgtgtcattattgtcgttcagtttgaagatttttttttttttggaaaaggagtctcactctgctgcccaggttggagtcagtggcacgatctcagctcactgcattctccgcctcccaggttcaagtgattcttctgcttcagtctcccaagtagctgggactacaggcatgcaccaccacgcctggctaatttttgtgtgtgtgtttttttttcagtagagatggagtttcaccatattggccaggctggtcttgaactcctgaccttgtgatctgcccacctcggcctcccaaagtgctggggattacaggcatgagccactgtgcctggcctgaataattttttaatttttatcttgattttgttttttgatccagtgctcattcgggagcaggttatttaatttccatgtatttgcatggttttgaaggttctttttggagttgatttccagttttattccactgtggtctgagagagtgcttgatataatttcaattttcttaaatgtattgaggctcattttatggcctatcatatggtctatcttggtctattctgtgcgctgttgaatagaatgtgtattctgcagttgttggatgaaatgttctgtatatatctgttaagtccatttgttccaaggtgtagtttaaatccattgtttctttgttgactttctgtcttgatgacctgtctagtgctatcagtggagtattgaagttcctcactattattgtgttgctgtctatctcatttcttaggtctattcgtaattgttttataaattggggagctccagtgttaggtgcatatatgtttaggattgtgatatttttctgttggataaggccttttaccattatataatgtccctctttgtctcttttaactgctgttgctttaaagtttgttttgtctggtataagaatagctactcccacttgcttttgatgtccatttgcatgaaatgactttttctacccctttattttatgtgagtccttatgtgttaggtgagtcttctgaaggcagcagatagttgattggtgagttcttatgtattctgcagttctgtatcttttaagtggaacatttaggccatttacattcaatgttagtattgaaatgtgaggtaccattgcattaatcatgctatttgctgcctgtgtacttttggttttttgttttttgctttttaacttttatttttgttttataggtcctgtgtgatgtatgctttaaagaggttctgctttgatgtgtttccaggatttgtttcaagatttagagctccttttagcagttcttgtagtggtggcttggtagtggcgaaatctctcaacatttgcttgtctgaaaaagactgtatctttacttgatatatgatgcttagtttcgctggatacaaaattcttggctgataattgtcttgtttgaggaggctgaagatagggccccaatcctgtctagcttgtgggtttctgctgagaaatctgctgttaatctgataggttttcctttagaggttacctggtgcttctgtctcacagctcttaagattctttccttcatcttaactttggataacctgatgacaatgtgcctaggcaaagatctttttgtgatgaatttcccaggtgttctttgtgcttcttgtatttggatgtctaggtctctagcaaggctagggaagttttcttcgattattccccccaatatgttttccaaggttttagatttctcttcgtcctcaggaacaccaattattcttaggtttcgtcgtttaacataatcccagacttctaggaggctttgttcatattttcttattctttttcctttgtctttgttggattgggttaatttgaagaccttgtcttcgagctctgaatttcttctactggttcaatttatggctgagactttccagaacattttgcatttctataagtgtgtccagtgtttcctgaatttttgattgtttttttctttaagatatctatttccttgaatatttctcccttcacttcttgtattgttttttggacttccttgcactgggttttacttttctctggttcctccttgattagcttaataactaacctcctgaatcctttttcagataattcaaggatttcttcttggtttggatccattgctggtgaactaatgtgatttttgggaggtgttgaagggccttgttttatcatattactaggattggttttctgattccttctcatttgggtaggctctgtcacaggaaggtctagggctgaaggctgtccagattcttttgtcccacggagtattcccctgatgtaatactctcccccttttcctatggatgtggcttcctgtgagccgaactgcagtgattgttgtctctcttctgggtctagccacccagcgagtctacccggctcctggctggtactgggtgttgtctgcacagagtcctgtgatgtgaaccgtctatgggtctctcagccacggggagagaagaataggccagcccctattctggtggaggtggcaattggggctgggggaagggtgcaatggactccgtgagggttcttagctttggtggtttaatgctctatttttgtgctgtttgacctcctgctgggaggtggtgctttccagaaagcatcagctgtggtagtgtgtagaggaactggcagtgggcggggccctagaattcccaagattatatgccctttgtcttctgctaccagggtgggtagggagggaccctcaggtgagggcagggctaggcatgtctgagctcaggctctccttgggcagtccttgctgtggctgctgtgggggatgggggtgagattcccaggtcgctggagttgtgtacctaggaggattatgtctgcctctgctgagtcatgcaggctgtcagggaagtgggggaaagctggcagtcacaggcctcacccagctctggtgggaggtgtttggatcatgggggtgggtactcatgaatggcttgggctgtccccttggtgatgagtgagctcacactctgagtttacatgagatctggtcatttaaaagtgtgcagcacttcctcctgcccagctctctctctcgcttctacttgcaccgtgtgaaatgcctgctcctgctttgccttctgccgtgagtaaaagcttccggaggcctccccagaagccaagtgatgtcagcaccatgcttgtacagcttgcggaacaatgagccaattaaacctcttttctttataaattacccagtgtcagttatttctttatagcaatgcaagaacagcctaacacactggtactcaggtgatggcttttatgtcacagttaggccctcagagttctctcggaagatggagactgtgagcccacggcagtacttctcgtcctgaggctggaccctgcaccttcaggtctcccagtgaccagcctctctgcctccctggggtggccaaggggactgaatggactccgtactcctgatgctccctcatgctcatgttcagccaagaacatcccataataaaactccctgaggccaaagccttggtgatacagctctaggtgtcacagctcttggtgacacagctcttggtgacacagctctaggtatcacagctcttggtgtcacatctctaggtgtcacagctcttggtgacacagctcttggtgtcacagctctaggtgtcacagctcttggtgacacagctctaggtatcacagctcttggtgtcacagctcttggtgacacagctcttggtctcacagctctaggtgtcacagctcttggtgacacagctctaggtatcacagctcttggtgtcacagctcttggtgacacagctctaggtatcacagctcttggtgtcacagctcttggtatcacagctcttggtgtcacagctcttggtgacacagctcttggtgacacagctctaggtatcatagctctaggtatcacagattttggtgacacagttcttggtgtcacagatcttggtgacacagctctaggtatcacagctcttggtgacacagttcttggtgtcacagctcttggtgacacagctcttggtgacatagctctaggtatcacagctctaggtgtcacatctcttggtgtcacagctcttggtgactcagctctaggtgtcacatctcttggtgacacagctctaggtatcacagctcttggtgacacagctgttggtgtcacagctcttggtgtcacagctcttggtgacacagctctaggtatcacagctcttggtgacacagctctaggtatcacagctcttggtgacacagctgttggtgtcacagctcttggtgacacagctctaggtatcacagctcttggtgacacagctgttggtgtcacagctcttggtgacacagctcttggtgacacagctcttggtgtcacagctctcggtgacactgctctaggtgtcacagctcttggtgacacagctctaggtatcacagctctaggtgtcacagctcttggtgtcacagctcttggtgacacagctcttggtgtcacggatctaggtatcacagctcttggtgacacatcccgtccactcctatgtgtagtagccattttccttttagcacatacactgtgacagaggttggggcaatgaggtgtcagtgtcacctgcaccctgccccaggactggcaattccttcactgccaaggccctgctgctgtgtccaaatccatccttcagacctctctgccccatcattgtgatgagtgtccctattgtccttttccatccttgggtctcacatagggttatgctagttcatgagtcatattttgatatcttcggcctttcaacagaaatggtaaggtgcttagtctttcttctaggtcttctgcctctttgtaaattcatggttgcaaaatgatgcctggagtcagggcaacacccagtagcctccgtggctggaaggcagacagacaggctgatggaagggaacatctatctcctccaccagtggtgtccagggctcagactcttgccttactctccattatgagaggataacgaagggaatgactgaatgccgtatatagtaccccttacttgaaggtctctgtgtctgccctcaagaatcctctctgactagattccatgtatttctctttatgcgtgggaaacttctgcaattgccatgaggatttgtgtatcgatgaccgtgattctagagggattcgctccaaaagcaccacctctagagtgggttctgtctctctcctgaccccagggtgatgccttcatgatgaagtgacaattcttcctggaacattcactcattgtctccttactcatgaacctgctgctctgagggtaaaatttcggttctcagttcttaaaagcattttcttcaatgtttctgtcctgtgcttttgagcagaaccacctctggttctgagccttcatagggagtgccccctgcatatggagggagtgtttgtcagtgcctgctcctcaggatcggaggtgagctgctggaaaaatgacatcattccagagccagagagaagtttactcagaacgttgccaaacagctttggaaaaaaaaaataggccaggtatggtggctcacacctgtaattccaacactctgggaggccaaggtgggaggatcacttaagtccaggagtttgagaccagcctaggcaacgtagtgaaatcctgtctctacaagaaatagaaaaaaattagctgggtgtggtggtgcatgcttttagtcttagctactctggaggctgaggtgggaggattgcctgggctcaggaggtcaaggatgcagtgagctgaattgcactctagcctgggcaacagagtgagaccccgtatcaaaaaaaaaaatgaagaaaaatatttagcaaggataaaatattattagctcattggcaccagtgatagtgaaacatgtttatgagaaaaacaaactctgtacaacatgtgaagaggtttattctgagccagtatgagtgaccagaaattacgggcaaagacataaattcatatatggaaggtgcacatttgttcagcctaaagaggcaggatatcttgaagaggcggagacttataggtcataggtggattcaatgatttggcaattggcaattgattgagttggcaattggttgaattaaactttgtctaaaggttcgaagacagcagaaagaaatgcttagttatgatgaggaggttgtggaagccaaggttcttgtcagttagatgaagcctccaagtagcagccttcagagagaatagagggcaaatgtcccttttagggccttaacgtttcagactcttagttaatctcttctagatctgggaacggcctggctgcataaatggagattctttccagatgcaaatttcccccatgaaagatggctttgcaggaccatttcaaaatgtgtcaagtaaatacatgttgggagaaaatatttttattttcttcagagcctctctgctatgtggtgctataccagagtcaggttggaatttggcatcttaatgccacaaagagtcttctttcagtcttctttaagtcttatgatctgtattttaatgttaatgctggtcagttttccctaaactccaaaaggccggggagcgggtgagacggagtatgctggatgaagtatgcctagccttctttcctttcgtggccaggaaatcagtttttcaggttcctccagagttctcttggccctggaggaggtctgttcagtctgttgaggagttaggattttatttttggtttataaacataagctttctaaagattcaagtgctccttggtgtgttttgtgttagctgcttaaagaagagcatgtgagtccagaatggagcctagttagtgatggatacagaaaccaggggcattggtgatagaaatatgtcacccagtgctgtgcggcatcactgaacactgacctcggcctcctgtgatgagcaaggaatggctgcatgaaaggctgctgaaatcctttcctttgcttttgctaataaaaatcatatttaaagtgtcctagatatgtaaaaagattctatggggaattgtttcataataaaaagaatggtgatcacatgtaaacattcctaatttattaactacgattttataatcaacattattgaggtataatttacatacagtaaaaggcatccatttacattgcaccattcgatttatttaaagtgttcaattagctgagttttgtacacacccatgaagtcactgccaaaatttaagaaacacaatatttccatttacccttgaaagtttccttctgaagtttttctctttctgtccctggcctcatgcaaccactgatctgactgatctgctttttgtcactgtggacttagttgcattttctagacttttacaagtagtatcatgcagtatagactctttgagtctggcttttaaaatctatcataatgactttaagagtcacccgtgaggttgcatgtatcagctgtccacacccccgactctttcaccatgcttttttctttggttgagtactattctttcatatgactatatcacagtttgtttatccatacctattgatgagcatctggattgttttagtttttagttattttgagtaatgctgctgtgaacattcatgtacaagtctctgtgtaggcttacattttcatttatttggggtaaatacctaggagtagactgactggatcctatggaaggtatttgcttacctttttttctttttgagacagtcttactgttgtccaggctggagtgcaatgatgtgatttctgctcactgcaacctccccctcctggttcaagcgattctcctgcatcagcctcccaagtagttgggactacaggcacacaccaccatgcccagctaatttttgtatctttagtagagatggggtttcaccatgttggccaggctggtcttgaactcctgacctcaagtgatccaccctcctcagcctcacaaagtgttgaaattacaggtgtgagccactgcacccagccatgtggtttcctttttaagagactgccgtagagtttttctaaatggttgtaccattttgcatcctcactggcagtgtatgagagttctagttgctccacatccttgccaacattttgcattgtcgattttaagaaaagtgtaaattcatgcaaattgatggttcaaatgtatataattatgtatattacaaataatactggagaatttttgttttttagtgacaagtttttgaatttccccttccttttcttttcttgtgttatgttaaattgaacacttaggaaagtaaatttgaattcttaaagtcataaggaccttttaacctattatagctgtggttaacttttagtatcctggcagggaaaactttatttcttaaatatctaaattacaactagagagaaaaaagaaaaggaaaaaaaatgattaaaagttgtatagaggaggcggcttaggttggaatgtggtaatttccaccatagtcctaattatgtatggttgtgttgctgctctcaaaccatagcactgcttataggtttcacaggctggcaccaagttgagccacaccactcttgctaacctctatgatgctttctccaatttttcattctccactgttacttactctgggcattttaagagaggcttctagaagactgagggtcctgagaagttggcagtggctgtgaccaattctccagcttgcctggaggcctcgttgttgcctatgactgcctgtcctgtgacgttatcagcaaacaaagcagctggcatggggtgcagggggaaggcctgggggagaaggaaggcaaggttggggtggtcactgaagcaccatctggctctagcaaggacacggggaagtttggagttcagctccagctggactttaagaatgtatggggctccattgtaaggtgaatgaatgtgaagagtgcagagagaaggagacgcaaggaagagagtgagaaaaaaaaagaaggaaaaactttatgatcaaagaaaagagtttttttctaatacgaaaatgatatacagcagtttccttttcttttttttttttttttggttttaaggagagaaaatttattaggcaagaaagaaggaagaaaggaagaagaaaacggctccttcatacagagacagagggagggggggatttgaacagagaaaacccccagtttcccctttttatagtaagaataaaacacattcactgataacctctgcatactactgcaatagcatttttggaggtggagtcccagcaccgtcggaatgatccctggcatctggatgtgtcagcccatcagtgcatcctcacctaaagcacagcatgtgtggggtgacaactgggtgaaggggagaatgagccccggggttagaccgggagcctgcctctgaggcttcctgacctcgacttccctgggcctgtttccttatctgtcatgctgcggtgataacgccctcatcacagggcttctgtgaagatcagaatgagacaatgtgagagtctttttgttcataacacatattttcacatttgtcagtttgttcatgagagttcagttctgaacaatgtctctttatcatctatcttcaagagcgtagtgggaatataggattagaaaaaaatttttggtttgggtatcttttccttctgttgttttgactatcagcagccctgatacttgtagacaggcagtgcttgaaggagaaagatcttggctcacagaagtttaatcctttccatttaatgactgtagcttagcatattttagttatcgtcattttggatttcatactatctggcctcacagaattgcaccaaacctgtcctgacccctgatactctccacaatttttttgccagtaaaccctgtaatgagttttgttaccaggatgcatgatgtttccatgcctacaagtcctgttttccaaactggctgttctcaggctggcaagagtgagctgatttcactccagaaacattttaaacttcctgaaagattaagtggctatgagcactcccacagggcctctgcagtgttctttgttagggtcaaggttcatgctttctttaccagtttgatgatttttctgtaattctctatctgagaggtgatgtctatgtgaaggtattctgtagctgccaatctaaaggcccattttcctactgtctctccttccttctaacgcttcgatctccagacactttgtcagtgattctggcttccagaacgcctacctgttctaggggaacatgtaatctgtgaacagccttggacgagcttcccatggcgtttgacactcaaggctaaaaatagcaagatgaggcctgaagcattctccaaggaaatgaaatcgaatcacgtaactggattattcttggttatcttgcagatatccgcgtgaccagacgtctacaaatggtggtgagatcatttctcgtcgcctcttaatctgttggcagctgacttctgaaaacgtcttcagagttttttcttttttccccaaaccaagggcagccagcaattttgaaactttgcatattggattgtcattgtgacttccacaagtaattttgcaaagttcatttttctttctttcctcatttcagacttttttttttttggagggggtgggggtggttttactttttcacagtggttgctaagaaagaatcttctgtttataggctcctaacaaatagtgacagctgaaagacaaatatggtgctgtgtttgcaggacgatggaagggggccagcaacccgcagcctccaggcacacacactcacaaggaggcctttgagagtgctgcctggcattgtgggtccacagattgcttgaaatcattaaaaaaggcgtttgcctcatactttcaatgacaacttatttccaggggtccaccagcattgtacaaatcgataggattgtcaagttttttgttttttgtttttggatctcaaagcttttgcttaacaggggccgaaacacagaaagatttgaatctactttcacaacagcgttctttgacctttgggtcatacgctggagtgtcataaaccaagaagccaggggtaggttcattcatgttcacctttctttgtttgggagaatttcctccattctagtgtggtcctagagcaggatggtggcgaatgggctgcagtttagaaaaacattatgcaaagaaaagagaaagtgattgtgtctttctatctaaggccagcatataaatgggtatttgggttcttcgtttcatagtttcggtctgaaggaaatggttacctggggtaacatagaagaccctgaaattataactactgaaaaggaggcctagtggaggtgggctgagcatgtcacccttggccaaggatcacaacacaaggtcagaatagcagtgggtgatgccgtgctgatgactaggatgacacacagacagcccagtgggctccaggcactcttataagcaccctttatgcacatatcagtactcaacacagcactggcgggtaggcattgctacgaatccgatttacaaggaaacggatggcagaaataccttgtccaaaatacacagtacatggcaaagctgtggtttgaatccaggcggtttgggtcagacctggtgcttaaagctcagcactacgcttcctgtcttgggatcccagtgcttctcaaagcctgagattttgttctctatttctttctttttctttttctttttctttttttttttttgagatggagtctggctctttcacccgagcttgagtacagtggtgcggtctcggctcactgcaacctccgcctcccaggttcaagcaattctccggcctcagcctcccaaggagctgggattacaggcatgcatcaccacacccggctaatttttgtacttttagtagagatagggttttgccatgttggccagtctcatcttgaactcctgacttcaggtgatccacttgccttggcctccccgaagtgctaggattacaggcatgagccactgggcctggccttgttctctgtttatcaacagcacctctacttctggggagactgcctgaagagggtttttcactaacttagtaggagagaatgcctttcctgcctcttcttttctcctaacccttctctgaaaaatgtctttgtgtgtagaatcccggaatgactggaggaaacacatggaactttgatgtgaaaaggacattaaaagatttagtgtcaattttttcaacacaacacacagcacagaatctgaacttcccaattcattgtcaccattctgaattttctttttcatcccagaagtgttggattggtcatttggtttgggttctatgtcagaaaccatttgcagacaaatggcaaggcagggctcagacagtcctcagaggggacatttgtgagattttgattctgctggaaagctgagatatgcatttgtctgtaggaaactgatgaagcagggttgtcattgccttcaaaatgaaatttatacatggggttggccgggctcctctttccttcttatactccaacaggtgattttgcaaatgtgactctgtctgtaattccttcctgctcttcttcccctagaaaattctcgtataaattttctcttttcccaactcagagatactttatattctcattcaaaaacgaactggaagagtaaaatactaggaaaaacataaaagttcctacaaacaagagactaccctgcactgtttgaggctgagtggagatgtactgttcatcttatactcatctctgtcatatgattattttatgaaatgcccatggtgttactttaaaatagaaatctagttaattagacagaacacaacttcaactaattttaatatttattgagcgtaacatgtacatggcaaggatctgagggtggccttgggaagcccccacctgggcagtgggggagaggtgggattgataacgtaggagagatgagatgcatgcaggggctggaatagaagccaaaaaatgctccgtgtagcagcaagatgatcttcttaccagagcacagaggaagcagtaggaggaaacggtggacacattggcgaagagttcaatatttcagctgaattttgaaggattcattcacttctatgctggtggccatgacaggtgcagagcatacggtgggggaaaaaggcccaggcccacccccagagcagacacagagctgctgagaggaccatgagctggctgaggactgagctggcaagaggagactgccatgggcagtgatcttcatggctggaggcacagatgagcttggatgttggcagcaggaggagctgtcattcgccaagagtccagtcgagaccagtcgtccttgaggggcactgacccagagaccggggtcgtcaggccacaccctgcaggggccagcatagaaggcagcccacactcccaccactgccaggaggactccacgggttttctctatccccagaccatcttgggaaggaagaagggaggggagaaatcgcctgctagcgagtgtacttggagcttgatgagtgtttaccaaaattaaattgtcttaaactggaaaaatctgagataatattgatcactgaatttgagggaaagtaaaattttactgccaccatgcagcggggagttcacagggacaattgagtgggttacatagtgtatgattctatctgtatgaaatatctaaagcaggcaaatctgcagagacagaaagttgattagtggttgccaggggatgggtgaaggaggaggggagtaactgctaatgggtacagggcttttttttttttgtgataaaaatgttttagaattagataatggtgatggctgcacaactttgcaaatatactaaaaaccactcagttgtacacgtcatagggctgtggcctgtgaattatatctcagttaaaaaatgcaaaaagattagattggttaaacaaaataaggaagctaccatttttttttcacacatttgagtagcagtgtgagtaaagtctcatactgctagctgataatcattaatcattaatgataatcattaataaaacattgattttccaaatatctgaatctgataccatgttgggtaatagctatatctaactttacattatttctactaaaataataaacttcagacagaactcaattggtaatcagaattcaactcgactagcactggaagcaaaaaagtacttagacaactatggaaatacaaagccatgcacaaagtgtacgaacccaacgtgagacgacacacgtcaatcaggtgctttcagttaagtcagtactttgcctttttatttctttcatgctttgaagataagaaatgaaaaactgtattttctaactcagagtgcttgttacaaacacacacattgtacttcttactgccattaaagtttgtactcagtacaaatttttgaattttgaaaattttctttctttcctttcaggtctattaatatttttataacagtaaacttgtaagtggaaaatatattactgttattctgttttaagagcaagactaaatgcgagccatttcttttactgtttctatcattcctgcagttggcctggctggaagccttgtagtcaccaccgactctaccacttccttcaatccctaaagccaaccagtggccaagtcttgcttattttatttttgtaacgtctgtcacgtgtattcccgctcctgctgccctgatctggtcgatcacttctccccaccgggactaggatcaccgctggctctcggcttccatcttgctcctctgaaatcccccagaatcaccttctgaaagcttcctgctgcccaggtcacctcccgcatgctctcccgctgcatttcactcgattaaaccattgtttccttctgcaccaaagtttattttctttacagagctatgtcatttcccacatttctttcttttcataactctgtcttgtttttgtcaactagagaatttatgattttaaaatcctttttagaagaatcacccttttatttatttatttattttttttttttgagacggagtttcgctctgtcgcccaggctggagtgcagtggcgcgatctcgactcactgcaagctccacctcccgggttcacgccattctcctgcctcagcctccagagtagctgggactacaggcacccaccaccacacccggctaattttgtgtgtttttagtagagacgaggtttcaccgtgttagccaggatggtctcgatctcctgacctcgtgatccgcccgtctcggcctcccaaagtgctgggattacaggcgtgagccaccgcgcctggccgaatcaccctttttttgaagcttcttgaacatttactgctcactttctctgtagagcgggttatctctgttagccgcctgaaatcctttccggaacaagatggcatttggtgtcttgattattgatcttggtgtcctgtaagtttcatgcccagggcaggaagctggggtgcatcagaactgctgctctctgaagcaacttgagtacttagagaaatgtcatatattacaaataaaaatcagacattttaattcttatctctatatttttttttctatattttgcactggtttcttttaattctcttctttgtttcagcatcctccaagtcttcgttcaaagccttctccctttcctgatgtctctctgttttagttaggtatatatttaggctgcctctttttcttaaataattttataatgaagacaagctcttaagataattttatttttctttttctttcttttttttttttttttagagacagtgtcttgctctgtcgttcaggctggaggacagtggtgcaatcatagctcactgtaacctcaactcctgggctcaagcacctcagcctcctgtcagctgggactacagacacgtgccacctgcctaattttttatttttatttttttgtaggagatggggcctcgacatgttgcccagactggtctcaaactcctaggctcaaaggatcctactgcctctgcctcccaaagacgtgggattacaggcatgagccacccgcctctttattttgcttttatgagtcaaaaacatttgtctcttctcccttagcattcatctaagtatatattttataggagaaaggccaaggggaagatcagggtgatgttcagtattaatatactgtgcttcagaaaaggaatgacataagctattgtcctgagaaataatctctagaaccctctgtcaaattaatcactgagcataaggggctctattcagagaggtgtttttataaagccaaggagaccctgcatacctggctggagagggaggaagggattgaggacagagtggaagtaaggaaaggcctggccagcttctggtcctggggatggcaggaagatggaaaaggagaggaagggcacacagtaaggttccctttgacttcctgtctggaggctgtgcttcaaggtgagttactccaagagcagtctgcacctcaggcacatcacagcgagctgggcagccggggtggtcaggcagaaagagggctctggggctcagcattctggggtgccctcgacctttacaggatagggatgcagcgttgagaagccaaggatccacagcgtgcacagagtggtgaggggagctgaccgcacagcagagcctggatgcgaggctgggccagaggctggaggaagggcatggcagatattccggagtctgtagcctgcgggagctgactggctgagtcagcaggaagtgataatcctgcccagacccaaagagatcagattaccagtgacaccagcctcaggtttcagctttgaaggccaggaaacacccagggaacagggacacagccctggagaccagaagaggtagaggacatcatgcccaacagcccaggttttcccaccaccataagatgttaactgctcccactcaccggggaactatcctgggaaggaagcggaggaggggagactattcggagagaccaggcatttttatcctgatgagtgattttttcctaatagactgctgccatctttggaacggattacactaaaaaggattagacatttggttaattttatctctctctataaatttcagttatatataatatatatacacacatatgctatatatttatatttatcatatatagaagaaattgcatattttagactgatatgtgtgtaaattatttaacttcactacaagatttttgttatattaaaagaaatacatcttagttgtaaaatgtttgaaaaataaaagtatccataaatcactgaagatatgaccatagtcaacatttttgtgaataatttttacatcttattccagtgtatatggatttattaaatagaaccttaagaaatttctgagattgtactgtttctgacttataaaattagagatttcatggagtcaacctaatacatctggtctaggggcacacacacatgcacacgtacacatacatgtacatctatgttctaggtgcatatgtatagctgtaaaaatagatattcttcccttcaaaaatgagattatactgttttataactttttttaaaaatttagcaatgtgttgtgaacatctttatacatcattaaatatttttccaggaggtcctttttaagtgattacatggtatttcacagcaaaaagtgccacaatgtgtttattagataaatatatctaaatacctgttgttagatatttagatttctaataattatttgatgtcatgaataacatggtaatacataaacttacagctaaatatttgaacacattgagaattttttttagaataaatatatagaaatgacattgctagaacaatggatacacagtattttgaagttttttttttaacttttattttcggttaatgggtacatgttcaggtttgttatataggtaaactgagtgtcttgggggtttggtgtacagattattttgtcacacaggtaataagcatacaccgtaggtagtttcttgtattttaaagttgatttatcaatttacattctcttaacactatactgagacaaatcttcaattggctgccaacttgctaggtgaaaaactgtaactgattttacttttggttcctgggattgaataattattcctgtacttaatagttctatgttttctttatctttatctttgtctttttttttttttttaatgatcgtttcatggcgtttgttttgtgctgagctccatattgaacctgcctatatgtgctgagctccatattgaacctgcctatatgggaagctgagctcacagtctggcccctcatcacgatctctcaggcagatttctagcctcaaaaccttctgcttctttgaaatccatattcaatttgtcattcagtctgctgctacttttactgaactattatttcatggacagttgagaaatggaaagatcttgatgattagttgattttcttcatttcaccaacaaggatattgacatcgggccatgctagtaactttctcagtgtcacgggtcatatgagggtctagtgctggaatctgggctcctggtctggttgtgtatctgtcacctctcgtcctgggatggttcctcaggcctggtctctgtcagggagccatccaaataaatgctggctggtcgtgctttacccaagttttctgctctgttgcttttctatttgtggcttctgtgtgtgagattttttttttttttttttttttttttttagatggagtcttgctctctcgccaggctggagtgcagtggcaccatctcggctcactgcaacctccgactcgctggttcaagtaattttcctgcctcagcctcccaagtagctgggattacaagcaggtgccaccatgcccagctaatttttgtatttttagtagagatggggtttcaccatgttggccaggatggtcttgatctcctgacctcgtgatctgcctgccttggcctcccaaagtgctgggattacaggagtgagccaccgcgcctggccctaactgtgtttttatgtcacttccttcttaaaaactgatgagcttacttccttcttaaaaactgatgaacgattctaatatttgttttatataatatctgctttagaaatctctcattgattttaaacatatttataaatgccacattctgactgtcttcatcaaacatctagctgagaaaacttgggaatgcagccaagaggacctaacacaggtattcacatgcttggtgccagtgagaatcagcttaaaggggacttccgaaggccaaaaggccagggaactagccttttagagccaactacatgctggactgttggtatattttatcttatttactcctcagataaatattatgtgatattcttttattacatcatttcacaagctgaccaaagtcacgagtacaggcccacttccttaggaacctaactgagtctgagtttggaaaatacgcttttcataccatttacaggagccgcgttggcaaagcaaggcgttcactctctgatcctttttctttttgtaaactctgactgccagaacaatcttcaaataacatgtcattatcagcagccaaaaaggaagcttggacccttttgaatttgaagtttgcacagcagtccttgttattgctttccatcttttctcactgggaaaaaatggctcccgaaataagaatgttcttcgtgactccatttagaaaattggtcatctcgtctgtgcatcaccagtgtcgagaactgtgctgtggtttttagtacagctgtctagcaatttatctttgatagtgaaagaaataccatggccattaatccatgaacagatgtctgctaagctttttgtcatatcatctgacagctgaccaaagccataagtgtgtgtgtggaaggatgtcgggtgggtgggaggcctggacagcactcagctctcagagttcataaacattttgagatttctccattagcagggagaaggagacaaagagtgagggagagagagggaaaaaaatattttagagacctcattataaatacttggaacaaataatatcagtgtttttcctagggaacaggccaaagatagacttactagtttcaactcatttctgtctgccagccaccaaatttctttgctgaagggttagggtggaaaatgccggtaattctaaggggaagcctgtgctatcagcaactctgacaagctaacaactggttagtttgtataggagcagcctctgagggggacattcttattgaaaaagtgagcaagtctcatgctcccggtctggtctatggtacctatcaggttcagaatatcttgatgcttgtgtgtgacttcttttgttttaaatgaaacacactgtattaagatagagtcaccaagatgagcccagaggaattatcaaagtcatatcttgctgtgtgaacagctttgtgtcccagcccccagagggctttagttgagatgttggtggcattcggtcaggaattgtcaagtctgagcgctttgaatgccaagcttgagcggaattttgatcttgatatcctgttccttgtatcaaagctcttctgttaagaaaaaaagtggccctggttcaaatatgggctaatgtcactgaggaggggcagaaaaaagtgttactggttggcattgcattatagacctaatatgattaatatttgtaatccgacaatctaattttcagacccatttcacttggtttgattaaagaattgtcagggaatcattagaaaatgtataccagttccttgtattttgtccaaggagatttttctgggatgagtattatctataaattcttgtgcttatatttcatcatggccttaactatacttgcactctggtaaagaacactgatatctcgtaattatctaattaataacttctgatattattaactttttttctttttaaagacaggatcttactacgttgctcaggctggtctcaaactcatcagtccaagagatccttctacctcagcctttggagtagctgggactgcaggcaccaccaccacacttggcttcattttcctttaacattttaacatacaacatatatgagtatttacttactgagtggcaaacactgttgactgaatgtttcaatgtctcctctgtcccttgtggaaggaaaactcgcaggctgctgacagttcctttgaagcctcagtgtgcatttgagatggcttcttaaagccaatgattgagaacgtatgatgaaacaaggtagatcaaatagtctggtcttatggaaccaggagccagctagagagctcgagagagtctgattgcctgaggcatcctctgagagctctagatatccatttcttgtttcttttttgcctcttcagctcactttccaagttgtgcaattataacttggaaacgtgctgtgccttttattgagggtgttgcccccatggaagcagcccttgcaaggctatggaccaagtatttgtgtcccctccaattcatttgttaaatcctggtccccacagtgctgctattgggatgtggggtctttgggaggtgattgtgttatgagagcaaggccctcatgaatggggttagtgcccttatgaaagaggttccagagagttcccttctctttctaccatgtgagaacacagaaaaagaaggctcttttctttctattctttttttaaattattttttattttatgagacagggtcttgctcagtgtcacctgggctggagtgcagtggcatgatcatagctcactgcaccctagacctcctgggctcaagcaattctcctgcctcaggctcctgagtagctgggactacaggtatgtgtcattatgcctggctgatttatttttatttttattttttagtggagatggtctcactgttttgcctaggctgcttttgaactcctgagctcaagtgatcctcctgccttggcctcccaaagtgcttggattacagatgtgagctaccacatgcagccaagaagaaggctttctctgaggaagtgggttctcaccaggcatcaaatctgctcgtgccttgatcttggacttcacagcctccagaattgtgagagataaatgtctgctgtttataagccacctgcagacatgagaggcagtagggaaagttaagatcagagttagggattccttaccttgtagagggccattgctatccctctgactcagatagagcttctgcagcagggtagattaatggtagattcctagtctatccaagtgtgtgcataatgaacaatgagtgaaaagagattgctaaatatttacgccctgggaacatataattttttcctgcattactgaatataccactgactgttttggctagggtgctctctgtgtgtctgtgtgtgtgtagggaaggggtgtctttgtgaagctataagctgaactactcaacagttatcacctattatatcttgtttttatgcaaatcccaaattgagtatggagctgggggaagggggcatttcagttgtcaccctctggaacaagatagatcctctgcattgatcatccactaggaaccagggagcagagaagtgggtggaagcgagtgtccctgagagaaggcctgtactagtctgcgtgggctgccataaccaggtaccagagactggggggctcaaacgatggacatttattttcttcctgttctggaggctaggaattggagttcaaggtatcgcagggttggtgtatgggaagcctctctccttaggtatagatggctgctttctttgtgtcttcacatggttccctctgtacacttctgtgtcctaatcacttcttcttcttcttcttctgtttttttttttgagacggagtcttgctctgtcgcccaggctggagtgcagtggcacaatcttggttcattgcaagctccatctcctgggttcaagagattcccctgcctcagcctcctgaatagctaggactacaggcacccgccaccacgcccagctaatttttgtatttttagtagagacggggtttcaccgccttagccgggatggtcttgatctcctgacctcgtgatccgcccgcctcagcctcccaaagtgctggaattacaggcatgagccactgcgcctggcccaatcacttctttttataaggattccagttatattagattagagcccactcagatgacctcattttaccttaattacctttttaaatgccctattccaaatacattctgaggttctggggtttagaactcaatgtatgaacttaaggggatggggacacaattcagcccctaacaaggactgacccctggttttgtgtttaaacacatggttactattagtatggactagagatgagaatacgcccatcttttcttcactagggacatgggcatcactcacattgcagacgatgtgggtgattagagggcacaatgggattccccgagcaaagcctgatggcgcagcctcaccgaggctcccactctgagcccaggctggcctcgtcatcggtgccctgaagtctgcgtaccttctggaaagcaaaggaatctttctaccctacccacgtggcctgcgacagctcactaataactgagcttgctttgcttcacacacctggcttttgctgatgacatcatcgcctctgagatcatccgggagggaatggcctccctgctctgggctgatctgagcctcagtagagatatttttacaatgactgctttgcccagagacattctacagagatccttgtttatctctaggcactcgtctaccttgtgcttcagtccacctcagggattgtttgactccttcctaggtgcattctggctttatctccagagtttgggaggagaaactgctttctacaaagggcctagatctgacagtcatagggcagaagatgagaccattaggactgtgactctcagccttttaattccggattaaaaaaaaaatcctttacaatgatttacaagatgattctcctaagtagtatgagttaccctagggcagggcttctgacctcaacactataggcaatttgggctggataattcttagttgtgagggctggcctgtgtattgtgggtccagcagtgtctctggtctctatgcactagataccagtagcacccctgagaagtgcttgtatattgccaaatgtcccctggaggagtgacaaagtcacccacagggaagaagccctgcgctagtacattataaaaatatgttcaatctaacttttttgaactatgtctaatttcaaagtaaatgatctgttccatcaattttgattcaaaaaattgaaacaaacctccaggatggtttggatgttacatccaactgcaatccacacattcatttctcagtttaatctctctcttcctttagccatcccttcactgtacaggtgcttttaaaacctgtgatggcctatagtaggaagattataagtattattttcttttctctcttcatttcgcctttccttcctctaccaattcctcagattacaatagattttctaacctggtggtaattttgtaattcttgctttgaggttttgagttcattgtattttcatgaatcctgaggattgacttagactttttctcctttttttcatagacctcgctaatgtcaaattgacttgaaaacatgatttattcactttatttcagagtcctgctcaaaggtaagtgcagattataaaacagtatgttcaggccaggcgcagtggctcatgcctgcaatcccagcactttgggaggccaaggcggttggatcacctgacgtcaggagttcaagagcagcctggccaacatggagaaaccctgtctctactagcaatacagaaattagctgggcgcagtggcttttacctgtaatcccagctacttgggaggttgaggcaggagaatcgcttgaaccttggagtcggaggttgcagtgagccgaaatcgcacccctgcactccagcctgggtgacagagtgagacgctgaaaaaaaaaaacaaaaaactacccagtatgttcagtgtgatcccatttttccctacactgcccactgcccccaacaaatccacatgtatagagaaacactcaggagaatatgttccacactcaaatccataccctacatggaactcttagtgaacctgtttcttctttttgttcctttatagctttttaatttttcctacaataagcatctattgcttgtggaattgaaaaagaaaaaaaatgcttgaaaaaattattctcaagctccctgtgaaatcagtgcaagattcagcacgtaccccctggtgttgttaatggtaacaagagttgtattggaaatgacacttatttttggaagacacagggacaactgagtcacccatagtattttaggggaaagaatgaaacaagaaaccccaaatgaacaggtgaagatttactaggcagatttctgtcttgtactgaacgttttttgggtcaagattatatgcatgtgcatgagctcagatggaactgtcctgacctgtggaggggctgaatttagcagtgagctcaggctcaggtcacttagagtcatccagcagaaaatggctggtgtatcttggggctttgtatgcttaagagctgtccggcaagcacgcagcattcctagagcacgctgggctcgcctgtctcccattgattcaactcacagacaggcttgtgctcagtcaaaacatgtcagtcattgaaagtatattctcactggttagtgtccttttagaaaccaaactcagctttcttcagggaaacaatttgtgctgatgggtacacctctttctcttcatcctgtgcacagtaagatgctgctatgagggggtgtctgttcatgtcagccctgcttgtgagaatggtggagagggaaggaggtggatgggtgcagctgctcaaccctgagtgcacagcttcatccacaatgtgtttagcaccaagcttacatggtttggaagaaagatgacaggcttgggagatagacacgtgagattctcaatccgatttcaatcaaatattatgtataataccttacatgtctggataagttatttaacttcccagagcctcagctccctcatctctaaaatgggcacaaagcagacttcctgtcagatttcttgtgagcataaagataaggaacgcatgtgaggaacagcctggtgtacagcaggtgttcgctatttctttccctcgggtcagtttccagtttccaggtgtgttgctaccaatcggcacaggcaagcgttcacaaacgtttcctctaaagaaacagagagtaaatgctctaggttttgtgagctaggaggcaaaattaaggatattatgtacgttctttcttacataataaagagaaaacacatttccaccaattgttactgatttaggaatataataatacaaatagagcacagttttttttctaacatagatctactaatgaaaagaaaagaacccttttctggggagatagcgttttacttaactgaggttcaaagttagagttccctcttatcaaggggattgccagtgttcatctgtacaaaccattcttaatttgcaggccatgcaggagcaggccgtgagctgaattttgtccacaggccacagtttggaaatctctgctatggacagcttattaatagcaccaatctctgcttgtattctaactgtaatcattaatggtgagtaaataatctgaaatcataagtgatgaatgaactgttagagagctaccatctgcagagggggatgaaataattaattaaataaacaggcactggaagctgacaggatacttagtcttatttgatcaaataattgtgtgtggcttttttttttttttttttttttttgagacagggtctctctctgttgcccaggctggagtgcaatgacgtgatctcagctcactgcaacctctgcttcctgggttcaagcgattctcctgcctcggcctcctgagtatctggcattacaggcgcgcgccaccatgcccagctaattttcgtatttttagtagagaccaggtttcaccatattagttaggctggcctcgaactccccacctcaggtgatctgcccgcctcggcctcccaaagtgctgggattacaggcataagccactgcacccggccgtgatcagataattctttaaataatatctttctttgtggctaaaatctggaaaacagcaggaagaaatgatcaggccacacaaaccaaccacctactatgagagatcaggcagtggatgattgtgaaaagttactcaaataggttatttctgcatcgaatcaagtaagaaaaggacttgcttgtctttagtgatgatgcagctaaaggagggatgaagatctggcatgtaagtatcagagggtcccttccttccgcccttccacccacctggatggacaggtcagatggatctagttatatgacccttacacactcagatgaaaacaagaccaaaagactattatggggtatattcttcacccaaagggattacattttagcagaatgctaatatagagtgggaattatcctatggcatagaaggcaccagagtgggtgttaaggggaagcaacgtgacaagacatctttgataaccgagttggcaaaagaggaatgtccgtatttctgaatatttaagagatagatatggaaaagggtcaaaacacatagagcaagaagggactaaggtatatgagaaaagatccaagcaggcaagctggctctttcccatttgtgtggcagaaagcggggaccccaccgccacccatcatttgaaattcactgaaagcctgtggacatttgcagaagctgccgagccaatggtgctgaagctgcttagggcaaagattttaaaatttcagagtgttgaactgggaaagtgcttacaactccttgtaactaacccctccttggaaaactagctgttttgaggcagaaatattttacaatgtattgttttaactgaagggcaatttttagccaaagaacgtttagcaaatgagctttggtggtgggtttaaaaatatttcttctctgagctgatgctgacacagcttttctccatgtttgtgttaaaagaacacacaacaaaatgcattttctcttagtttaacaagttggaataaaatacacaatttttataaagataaatgtcaagaagaaaaactgaagtatacttccaagcaaaatttattagatgtctattcaagaaaaacacaatgacctttgcttgtaagaattcaaagtcaattacctggaagccaggtatgaatagttttttcttttaaaatcagatacagagagtagaaacagtaatttttcttaaatatgacaggcaacagatattgaagtcttttctcataaatggcatcaaagagaattattcatttatcagcaaagctgcatgcagttgacttaatttcaaacctgaagcctttaaaatatgaagctggttatgaacttgacagaaatcaaggtaggctactcaacgatgtttctttaccttcttcctaatgaaattcccttgtcatcagtcagtagatatgtacatttcatttggcttctacgatcttttaacttcatagatttttgcataaatgctatctgacagaatcacactatctaggggtgcttgtgatctgtgagataaggagaggctagtctgctgaaagtgttgtcgcaggataaagaccaaattaggaaacgcccctgttttctcaacaactagtctgtacaaaaaaagagcaaacatatgtacaaaattctagaggctacgtacattgtgaaaagatcaatatcactgtccatgaaagagatgccataaaaagttttatctgtaaggtgctcaagatccaaagatgaacagttcttatgcaaagtcataagaaatacaaagctagttttcggagcaggtgtaattcaggcactgtgaaccatattaaaccttccaggtcccaatatcattttttaaatttctgcttcagggcagaaaataaaacctgaatgatttaacattgcttctaaaaagtgcctaatttattcctaggaaatattttacacacaccaggaaaatcaggctcaacatattcctgtcctcaaatgtagccaggattctgagttccatagaagaaaaataattattatagtaaaaataattgtagtaatcctaatccttgctaaaaccaactttaatacttgtgatgcttctgtactctatttctataaaataatgtgtgagattctattacatttccataaaatgtacaacatatcatatggattatatgttctcatacaatctcaaatgtgtatgtgtacacacagtgaaatcttacctactagtattgcttacagatactttcaggtgtctgttagaataattctttgcacctctcactaacactgcttttacttacattttttcagataaataaaacactaagagctcattgttcatgatgctgatcattacattttaatataaaatagcgatgcaactttacaacacaatagttttcccctgtagcctagctcagcctcttgtattgtcatgattattaccgaaggcttttatttacttactgtttgcacttctaaaaaatgcaaacaaattgcagaaaaagactcctatttgaaaactcacattcaatcagcaaaatcacactcatccaaattaactcgcctcctcttgctttaaaggttgtaatcactgtgcatattacaacatgtatgtgcaggcaaacaatagctaaagtacagttacagttgtcatattgtgtaaaccaagacactaggcaaacttgtgaaaagaatacacactgccaagcgaagaatatgaaaatgcaaaccacagcattccccaataaacaattttctggtcgtcttgggggagaacatcgcctggggggagatgttgaaatggagccacgaggctggacagcctcctggagacactttttttttttttttttgcctcaaatatttgaccatttttaaatatcatgatttttttctttctgatcccacattttgacgtgtcaaagcttagagcaggaagtaggaatccacactttcacggagggggaccagcctgccatgtcgtccccaggctcacagcagcggcggctactctgctggtggtttggtggcaggtggagatggtgacggcgcattggaaaccgtaaggcatgacaacgggaggcccgcggggtgtttcaggcgcgttgacgcaggtgcatggctggcaggcggcctctacagaaggagggagcgcaattcacagcctcttgacgtagtttccggggaaagtaccaaagaatttggttcttcttgaggtccctgaaaatagaagcgagtcatgaaaggggggtgacaacgatatcagttcatacacatgggcttgaatacttcccatttacaaggcctcggaagacagcaagccccgaggggtttggaaaagaaggcaggcaactcacatgaagcccataggcagacaaaataagcagtgttagctggttgcctgacgctctcactgcccctccggcataaatgctgcgctgccatcgcggcaggctaaacagaaatgctgagcctcccaagctaaagggaaagtcagccctgctgaggaggggggcggaggagctcagtcactgaggctgccacaccagagtcgggggtgagggatcaaggcgaggctgacaggtgacagggtgagtggaaaatcctaagagcaaagcttctcagggaccagcaacccgcgcaacacaggtgcgacatgaagacatcatctgtggcaggctgtcgctgttccaacagttttatcatcttacagaagatcatggtcagtgccacatcatttatttaaaaacagcactgccagagtccttcatcgagtatacaatttttcaacaatttacaaatcattaatgaaaaaaaggattaagcactatttgtgtgtgggagttctatcagtggcatgatttttaacatggtgtgtgtttaaccacacgcacaaatggctatcataattatgttcgcctctggtttcaaataatgtaattccttggacacttcttgtaaaagttggtgcactaaattgctaaattcttctttaggcagcgcagatggaccggataagggtctctcaagcttcatctgtctcctatatcctggcacttactgccttggtttgatggctgtttttctttttccttggctaggcaagccattttacgtttctcctccctcctcctcctccctcctcctcctcctccttgtttttgagatggagtttcgctcttgtcgcccaggctggagtgcagtggcatgatctcggctcactgcaacctctgcctcttgggttcaagcaattctcctgccttagcctcctgagtggctgggattacaggcacctgccaccaagcccagctgattattgtacttttggtagatacggggtttcaccatgttgaccaggctggcctcgaactcctggcctcaggtaatccacccgcctcggcctcccaaagtgctagaattacaggcatgagccaccgcacccggcctttttttcttcttttaatggaaataaaatcagaggcttgtggccgcaccagggcctcaattctttcatgattttgccaccgatggatgtctagagtgagccctcctctcctctcacctttcctctcttccattctctgccctgcagcctgtgtttccttttcacctctttctgtggcccagtgtaaaatacttttgtctacaaatgttttcccagaagacctctcgtctttttttttaggatggtaaagatgaagttgccttttaagtgggaagaatggaacgtctctctgcttccaccacaaactaaagttaaggtgagtcactgaatgttcgggcatctacgtcagacctaggaaacgggagagctgttcacttaatctcactccctctgaaattagattctcactgtggacaactaacattttccacagcacagagcgttgatatttctcttctggggaccatttgttgttgttgttcttagatctcaatctttcctggtttttgctatttaaagaaattgtcttctctcagttgagttggaaataaagctcgcagaaaatcacacatagctgaagcagtgaatactaaactatattaaaaatgcaatagccttgggattacattgtgcatatgaatgtctgaaagatcaaaggcattacgaattcaaaggaagctcggccatcacagcaaaccacgggagtgagcaaactcaagcaaattacaaaatagccgaaggtgcctgaggaagaagcgcacatacccacaaaccagccgtcatcacacttttccatgacatcaatgacatcactttctctgagctccagctcatcttcattcctgggagtatagttatacagagcctgaaaccttaaacaggacaagggaatgtgtttaaaaacatcttgacaccttcatgaaatatagaagatagaacaatattcattcttcctttaacattcctattcttaacaacattctgttgggtggtacaagcctggtaagcatgtaaatagcattctattggatggtacaagcctggtaagcaggtacatagcaatatgtagatcttcacaggcattagaacactctaacaacattttgaaactcacgaggaatatccatgaaaattgtaacattcataaattggattaaaatatgtcaacatgtataagtcagacccgcatttcagttgtccagccatctaacgtctatcatttagacattaaataatagtacaaaatataaaataagtgatatttgtattatttaactgtttaaaaacaagaaggaatcacaattttagctagccataatcagaagcaaataatgggggcttgagaattgaattttcaaaggttctaaatggagatagacaaaatgtgtcagacatgtctttttaatcactctgtgtgaattactatacaaaggaaaattattttttttactaagaggaattctttagatcagtttaatgttatggtttggatcagtgttttctgaggatgtagaattggaagatttgatgtaattagcctatgaagttgagtagatgtattctatgtgcagttattactgattccatttcaagcagactatggacataagtctctttttaaaatgagtcccagaaaaattgtatttgattttaaaactctctcttgaaataattttatataaaaaagaattattgatagaatgctatcactttcctttcccggcctgaattctttgacagcatatactgtggtggaaattgatcaataatgaattcagacactgaatttgtggtaagaaaacaccatacattataataaatagtaacatgggctggtgtttttggaaaatgaaggcgaaattactgtagctgagaaggtcaagaagaatttgataggcagttaacatgaaaacttcttcataatagtactaaaatattaccagtactgtgagggggtttttaaaaattgggaatttgtttctgctgctttctgtaacagtcatgtcattctgctaatgtgagaaaataattaccactttctagggtattttagattttttcatgccaacttaaaaaagttgataatcttgactaccgctccggaacaagaatgatttatttttaattactttatgagtcagaaaataatattttggtagaacaaaactattctatcatttaaactcaaatcttatgtcattaataagcaacagtgacctactggcttccccccgttcatccagcatttggactgggggagctggatagagttggcttcagagaatgcctaacaacatcccctagaaaatattgttttccctggcctggcaccaaagcctgaaatttcaacattagaggcttcttctcctgttaaaacttcatccttccagtagaccttacagccacttatatccttttgagcatgggcttctgaggccttttcttgagagaggggtttgtgattatggggaagggcagagaaaggcagctagcatcccagagtagtggccaaaaagacaggcaggtgtggaatacagaaacgtcacctgatttggatgtttgcatgtggccagctttgctaggggtagtccatttattttgttgcttgtgtaaagaatttgatttggaggctgctcaggtgaaggggtggtatcttttgtgtatctgtggggaaagttcacggtcccttttccagtttcacatttgagagagatggtggttcctgggctgctgttttgatggatacacacggcatttctcactttgggaaaactgattcttttattgagcttctcaggcttgaaccctgcccaggctcatctccacccactcatggagaccggttacctaaggctgcaaacctcagctgctggaaagaatctcaaggtctcagagctaacgcaacaaaattggcacagactcctgcttcatttttgtctgatgaaagccagcatgtttgtccaaatttatttaccattctggtttaattagaccacagaaacaaaaacaaaacaaaagaaaacccacggagttttatggaaacgtaaacacaccttcaggaaatcctcctgcctctcctggctttcaaagccagtgttgcacaatgggaaatgaagacaaatccaatgttaaaaaatgctgttgtgaaagatgtgttggtgaggtgagtgatggtggtggggtaaggatgcctcaaaaagaaaggtgtcttttaaacaggaaatgctgagccagactggaagccctctcgataacttgcaactttttctagaacatatttcactaaaactctgaattgtagtgacataacattatgttcctactttggctcaaaacttatttttaaatgaaagcaactaagcaacaccctaaaatcccactaattcaggctataatcaaatataaatttaataaacaatgttttctaatatacaaatcaggactttgaaaatgtaacatatctttcattcataaacactttgaaagctgtttaatataacatgttggtaatgcaataaacctaaacagccctggaatttattttttatcatgtgatcttatcatcgtttgggtaaataagagaacaaacaaaagctttagaatgacaagtcgtatttagtgttttccagttaagcgatctttttgtttgtttgtttgtttgagacagggtcttgctctgttgcccaggctggagtgcagggccatcatcatggcttattgtagccttgatctccctggcccaagtgatcttcccacctcagcctactaagcagctgggactacaggcgcatgccatcacacctgactaattttttatttttatttttgtagagatggtgttttgctatgttgtccaggctggtcttgaactcctgggttttggccttccaaagtgctgggatttcaggcatagtgactgcacctaaccttcagtgagatttcaaatgattatcactgctaacctgttctttccaaaatacagactttcccgcaacaagaacacttttctgcctgtgctctgtgagagccagtctcatccggagctgctttttgctaagtttcaggtctgtgaggagcaaggaaggacttgatggtgataaaggcaccaggtcatatgccaggacctgccgcaaggaggaggctattgttagcctgttctgctccaggtgagcagagtgtgggcagtgggtcaggatccccagtgtgtgctcagatatgggggacaaggggttaggtccatgaataagccttcccaggggtctcactctcgactcacagtgtgggcagaggccaacaggaagctgataactcctgaacgtctctcagggacaaaatgggcccgaaaaagaaacacacagagagaatcttcaagacaacgtgtgacaccttcaggctgatttaactcatgtatcagaaaggagaaggaatttgaaaggaaagtttgaaaaggcattttcctggtgctgtggaagtaatcgcatgtaactgaataacagtgagtgttttaatactgcccttttcaaatgacccttctaagcatgtaactttggaatgatggaatgatcgctttaggtcttttttacactgaggtccacttttaccgtctcccagtgggtgtaaaagtaaggttagaacatgttctgtatgtctttgaagctcgcagttactcgttacacagccagcagagcagagagggagacagagttatccatcttaggaatcactgaagcattgggaagttttcctagtgtgtcaattaaaatcttctcagagaactatgggttcttttaaaaattagtttctggtcactgtcataaaagatggagagactattacaatttctcgtaatttaagaggcctcatgttagtttgatctttcacgtgcaaagccatacatcttacattttggtacagttgtccattttgtgggtcaaggttagtctcaaatttagaagataagaagaatacttacggttcccccccaccttgaatattttcatgagtaaacacaggacgctgtggctgaaatgaaatgattttcaatgtaatcaatgtttaaactggtactaattaaaagataatttggataatggcatggtacttttcttgacatttaatatttcctgttgtaaaaaaccaagaggaagaaaaaaaccaaataaaagctttctgcaggattaataattaaaatatttaaagggagctttaaattaaagcaaaataagcaaggtcaaatgttttgaacatgtctacaatctagtctgctcaagctttaaggaaaagtcagggtttggtcccattgatttttcaaaggccaggaataaggcaagaacatagacggcaaaccactagaataggaaatatagacaccttcatacaaccttattctccagcgttttctcaaacaagcagaaaataaaccacatttagtttaacagcaaagtatccacactcattctttcaatctttccttcacagacaacattttcacatacagcacagaggaaaatatcaataggcagacatcccatgctacatttgaattaacattttctgttctcaatgtggagagaaaacatgcatttttaaaaagagaaaacagaactttggaatgcaacgaacaatatccgggtaacatgtaacattttaccttagaagagaaacattggtagaaatttccagtgcactgaactctcaaaagagtttcttttctttttaaactaagcatcaagaccagtatctgtaatagatacttataatattggaaatgacaagccttagcatcccatatacccacattaatattttcagtgaatgaaagttaacatgtttgttgaatatataaactcagtgtaatttatattgactacctaaactttaccttttaggggagaaatgcaaacaaatcattcataatccatttcaaaagcatttgcttctaaatgatagctacagggtaaaatcagaatttgcatggcaattatataagtgactgtttgatgactactgaaatagctattagatccatgtccttagactttgggaccagttcttagatttccatagttatgagtggattactgataggctgaaatctcttgctgccaattgtccatagaaaccccactgatccaagcttggatggataattctgaggttcctttcagtctacgagtcaatgattcacccacttcctaaattctttatccaccccctttctatcctacttgtctatctagcataagactaggtactcacagtactaaaactgtaagctctgactcggttaactggaaacctttattaacagtgttcttagaaatttcactcaacagtctgtggatagaatatttaaaactagagtgcgtaagaattactgcacacaattatgacttaagagtgaaatagtttactcctgtaaatcaatatgactactaatgatgtatctattattaaaattggaagatattcatattttaagaaaaattatgactaaccagttttccaaccatcttaaaggtcatttaattcaagatattattaaatcaatttaaatatataagatggtaattgtaagtcattgataagcctgtatcatattacctatttcaagttctcttccagtccaataaaactttatatatgtataaaactttcatgcagaagtaagatttgtatacatcaattgccattaatattattttgtaataactttccagtctttttttctcagtcttctttcttatttcaaatgtctgcagaataatgttctcccacgtgtgtctacatatcatagttttcttaaccattcctctcttttttttttagttttgaagttagaattggtctagtctttttttttttgctatcataaacagcaatgctatacacattttttatgcaaagagctattttcttcttttgaactattctttagaatatattcccaggagtaaaacttctggccaaagagtatgcattaaagccatatgattttgagaatgtacatgttagtcactgaaaaatactgtactcaaaagtaacttgaaaatgtctaatatgccagactgcatatcatataccaagatagctactactctttccccaaaacaatcatagcaccatttgcagtgcataataaagttatgaataagaaaatattatttattcttgtcttaagagaaaatgttgtgtaaaatatatttcattatgctctaaaattggcatccctgttttcacacatttaaaccattttaatattttaaaattgagtaaaagtttcaacttctacatcatggcatccaatgctttgtaaaactggttagtttcatttcattgctcttttgttaaaatgtgaataccactttaaaaatcaaattgttcattaatgtaaaacaatcaacttttaaagtccgtatatccctttttagttatcatcattataattctactagtttaattcctttaactcaacccacctcatcaatcatttaactgaactgtcccattgaccattatgaaaatttggtgattgctgcaaacctgcagcttcctggatcccacgtccatggctggagaacgtatgttcctgtgtggggcagccagcaccgtccttgctttttttttttttttttttttttgagatggagtctcactctgccaccaggctagaggtcagtggtgtgatcttggctcactgcaacctctgcctcccgggttcaagcgattctcctgcctcagcctcccgagtagctgggactacaggcacgcaccaccgtgcccagctaatttttgtatttttagtagagacagggtttcaccatgttagccaggatggtctcgatctcctgaccttgtgatcttcccgccttggcctcctaaagtgctgggattacaggcgtgagtcactgcgcccggcccccgtccttgcttttacctgtttcccaatttctcttttcccttccttcatatctttcaaaccctgcccctctttttacacacaaatcatcagttttctatactgttcacatcctgaggccagaatcaatcaagacttttcgtagcagagaagttgtgtgtgtcttataatggcgagttttagaacttttcaaagcttacctttaacaagaatcacctccatgttaatgtggataactaggagacagttttgaggaaagctgactaattacagtacttgaaatagtttattttaaaggcatttgactagtagggaatgagtagcaagaacagttatctaagacggctcatctgcgtctttctgttttgggcgttaagcaccatataaccttggggatgcctcagcttccctatctctgaaatcaatgagttggacaagatgagggttaatcgggtcccctcagggattccatgaaggatacacatttccacagatgtatttcctctgctgtgtaaaggtgtccgtcatcagttttacacagagagctgggacactgacattgattggttaattctcatgtgtctcggtcacgtaaaaaaaaataatggttacaattcaactccattttgcagaatggtaaaccaaaacccaaagatactggataatttcttaatacgacaaataggtaaaaaacaaacagaaaaagaaacaaaatggtaatttcgatgtgcacgctattgcatgaaagattactatgatggactacttggcctaccttggctaaaatcagcatcttaattttgacgctgaggtaggtgcaaatgtcctataaggtgatgtaaatagattatctggggagactgtctttcgccctttccccttggtgatgtaactcaaatggcaagtcgcttaagcagagatttgtaatgcagctgcactctgtcgccacctagtggtgagcaatggcagcaacaagctgagagttgtttctgctttatctgcccctttttatccaagttcccaaggctggaaaaattttaaaagcctattttaaaggccgcagagtgatgtggaatagacagtcatctgttttcctaaccatgttcttccctccccacgttttaaatttttgagaaagcatcccttgtaaagccaccagcatttttggtccgtgtccatttctattttgactatctgtgcaggcatttccatttcccctaacttcttagcagttttaagataaatatagaacaatatacacttgtgacattcagagaggcttacatgagctgaacctagaaagatggctttcaactgacacattacaatcactgtgctgggcattttgaacaagaattatattatgcttatatttccttgatgaatcttaagagtagaacaagagaaaaatccagtgaagcatgctgcggttttcatcgtatcctaaatatgtatttttttctgtagccctgactatgtaagtatttttctgtagctattttttaatgttgtcaaaaacggatacaaaagagacaagttttaaacacatgctaatttccaaagccagaaccaatcacaagttgctgttcataaggaagctggtttgaaacatcatggagtctgtaacatcagtaaaatatatactttccgatcttagtgagctacagtctgttgaaaagccgtctaatttatcaaagcttctgcagttatctctggaggattagctatatttagtatcaaataattcttaaagaaggattgactgttactttaaacactaatgcaaaaaaatctctgaaagcaatataagcagtgctaaagtgtttttatctttttttataaaatattagttgtcatatttgcccaccagaattcgatgaaattctcctaataataccacgtttatgtttctagaggcttatttttccttcttaaattatgaaggtaaaacacaactttgcataaatctaaaaaaatagaatatttatggttcacacaaacacacgtgtaatctgacatacaaatacataatgtaaaaatcaggcaaaaaataaaaaaaaaaccttaaggggaacacaagcataccatctcgtggacccacaggagggttatagatgggtccttttcactgcaaaagaagcttatgttttgctttggctctggaaggccattcgggggagtctaagagtctctacaaattggcatttctgtctctatggcaacacaaagctctgcctcagcaacaaaatgaggtcttcctatgcaatgcaaaaagcacaaagtggcatgaatgcagaataatatcgacttttctttagaaataaaaaatgaagacttctgtgaaatcaagcccttgagaacttcttgaaatgcagaagcacggccatgcgataggccagtcaaggttgaatccgggtccattaaaacagaaatgaggaaaggaatcctgacttatgtccagatgaaaatttccaaactccttggctgcattccttagaattgatagtaagtaccatttagagtccatgtattttaaagtactgtagatactatggaacgaagtagctaagggaaagtaatttgacctttaagttcaatcagagctggcaagaaataggaagtggatagaatccagacagcagtatggggacaaaaggcagactgagaggatgtagtgcacatcaccagagaaacagaagatgttagacaagaatcatggatttaaaaaaaatccaaattgaatgacacagaagcaaacatgaccggaagtgtgtgagttcggcactgtagatgcttggcaacagttttttctttgcaggagaaacggtgactagaaagcagtgatttagtgtagaaccatgagacagatgtagaccacaaaacacacgacactcttatttgtagagtagagaatctgaccatgtctttgtggagtttggaaacctcacacacacctaaaagggaagcacatcaccaggtggtcgcttcatcttcagggtgtctccagcctcactttaaggccagttcacagcaaagacaactaaggaagagccagccctgggggcgggggaggtggccaggatgcctgccacaaagtgggggcatgctgaccctaccctgtgggaaccgctgagccctctgacaggtgagccgcagaatctcctagacatcactgggctacgaggaggcttacccaggacacatatctcgctttttacgtcagcctggaaaatgtacaagaagttagttagctctcatcttcgtcacacagacttcaggaggagctttcctggctggctttttccatgcacacacagcatgccaaactcctgcacaacagcagggcagggagggtccacagcttctccagctgcttatacagtttccacaccacaggcaccagctgccatcttaacatggcacccacaggcacagcagaaaaaggttcacagaggaaagctggcatagggaagaggccaagaacatataagaaatgttatatctttttttgtcttttatttttttgagacggagtctggctctgtcgcccaggctggagtgcaatggcacagtctcggctcactgcaacctccatctcccgggttcgagcgattctcttgtctcagcctcccgagtagctgggatcacaggcacccgccaccaggcccagctaatttttgtatttttagtagagacaggatttcaccatgttggtcaggctggtcttgaactcctgacctcaagtgatctgcctgcctcgggctcccaaagtgctgggattacaggtgtcagccactgcgcccggccaagaaatgttatgtctttcatagaatgcttagcaattgggttcaagatgctctcaaacctgccctgctttttcatcttattgaagggatgcaaggtgagatagaggagaatttggcttaatgcctgtcaaatttcatggactgtatcagacatttgttggaggcaaaattttctaacacataagaagaaaataaggcctttttggggggaaacatggtgaaatttgatgaactactgaagtgccaacctgtgggctggactgttttggtgttttttttttattttcagagtaagatctttcatatgacagtgagtaagctgaccttcttttgtgtaggttttattttccttccaatagcggacaggatctggcagtgtactgcctggtatttgatctggcttaagagaacttccggaggaataaaacacgcttaaataaaagcatgtggttttctcaactctcatttagaaaagttttcctaattctcagtaatgattgacctcaaatccccagcctctcgggatgaaatgtgtttggcaccgttgcttaagtgtcgtggcagacgatgcttgatgctctccacatccattctcttcttggtcctcagtaatggggccaggctgttgggtaggcacatggccattctggataaagaccacatttcctgacttgtagctggatgtactcatgtcataagctgagaccgaggggatatatgcaattctgggacttggccttcaagggagaaggtgtaatctcccatcttttctccttcctgctggttcgtgtgagaagggaactactcgagctgccacctgggacccatagcggaagcttctctctgaggatggcgatgagcccacatcagatggaaactcctgggttctctgatgactgcggggccaccataccagtcccggacacccttcatttatgtgtaagagcaatatatttctacgttgtttaagctataattattttgagttttctgggactgtgcttatcccagtcttgactaatacaggggttcaatgcatatcagagctcttagagaaaaaaaataaccccatttagcttttagaatgatgtggatcataacagctggaaagagcacgtgaacatattaggaaaaatcagggcctgatttcatgttgaaaaccgtgcgccggggatccccttctgatgggactgctttagggtgacgagacttcctggtgggaccacaaccactgagttacttggaagaaacctaaaaaagagcctctcactctcctcacagagcttccgctgcaacttgagaccacatgcggcaagtctcttgcaaaatagtctctcggatggaaatggaggctcagcttatagaggagctgagatttatactattttttttgagatggagtctcgctctgttgccaggctggagtgcagtggcacggtctcggctcactgcaacctctgcctcccgggttcaagcaattctctgcctcacccttccgagtagctgggattacaggcacctgtcaccacgtccggctaatttttgtatttttggtagagacggggtttcaccatcttggccaggctggtcttgaactcctgaccttgtgatccacccaccttggcctctcaaagtgctgggattacaggcatgagccaccgtgcccagccaatttatactattttttgttatgaaaaaatcattattttaaaagcagatgctcagaagactgggggaaatattggattcagatttatacattaaacataatttatgtatctttcagtcatctgtaatctataaagtggtaggaacttttacgtttatggaagattctggattgcatttacttttatggagattgtcattgtcttagaaaacactttaaagaatgaaattgcactgacttaacatgagttaactaaacaatggttgatggggttgataaaaatgttattacaatgatttcatgcgtgctatactatgtcattaaaacattactaagagtttattttctctttgctttcagtgctgggttatttcttttctttacaatgagcatcagcattcttgaaatggaagaaataaaaaggcttcggactcagattggcagagtttgtaactgggtcagatgcagaattaaactataatggcctaaaattacgagttgattcaatttgtacttaaatttacaagcacaaataacttcagtgaatatattctttcaatgactacaaaatagatttataaggtttaaaaaaactcagtgggagattcaaaaattgagatttcctcctaaataggagataaaacagagaaaatcactttgatttgctggagttagtcagaagtatctcatgtggtcattaaaatattcttttaaaacatagttattgtgaatacctccattctctcatgtcattctgcaaacaacggaaacttaaagaatatacgagaagaattttgttcttgcagaagagtaaacctttttaaatcctggctttgtcctgatgctacgatggtgcgtcctccgtctttccaaattagagaactcagattctaaggctactttccctcttattgactaagcttaaaaaccgaagaacaagttaaaaaaaaagacaagaaataaataccttggccttaaaaataaaaccacagacagaagagaaaaaaagagaaattcttagccttaggcatcatataaagtggcattatttaaaacatttcctaattattttctgccagctaagaaaaaaaacctcaaagagcaaaagcaattaaagtgtttcattttttacaaagttcctttcacgcctaacaggagcacatagatagactatgtcagcgaatgggtttggtggtagtggttttgagattgtataaatggcacttcctaatacagaaccttagctgtattagagccctaaatttttacttatgtgcagaggctctcatttcacattcaaaagactgaatgtgagggtgagctattgtttgaagtctgtcaccttttttccaaaggaaaatgttttaggatcattctgaacatagaaggaaaacatttcagtgatggactaatttcatgctgtggttgtcattaaatctctttccaaggccagtcattaattttgttaaaataattttttaaaaatagtatctttaggttaaataccagcggaactgtcagcctgcaagtctcagagatggatgctttgtgaagtgctacaaaaggatgatccttcccacatcctcatgaatttacgtcacttttgtggaagaacaaggctcaagacagtcaatgccaaagatcatcctgtctccaggctctgctgaacctgccgatcggtgggaaatgacgggagacaatgagtccactgagaggtgatggagaatggcaggcactgagctaagataccttaaatgtgatgcttctcatgctgacggccaactgaaaacaatctcatcattacttcttattatgatatacattttaatttgtttttctcctcaatctgggtatagctgctatgcaaatatgtcttttaaatgtttggatagaggccacgcccatgatgttaaaagttagcaatcagtatttatgtaacttcgtaggtcttgtgagagggcgcaaatctgaatgcatacatcttactaattaagctcattgaagacatgcaataaaccacactcaagatgcagttacctttaattttggtggattgatctcctgttgataagaatatttagggaggagaggaggtgagcagggctgagaaagtgtagagtccaggtcagaaacagaggcgaagagagaatgaaatggaggggaggaaagcaggtggctgggaaagggtgtgggtgcttgctctcccgaagaaaatgacggaggcttaaatatcgaggaaagacgagaggtgattatgcttgtctcagaatgaggttacatgctctttacggaatttcctctcaacttccaacattttaaagttactaataaccttgggaagttatatttatgacaaattttttgctttgaaaccactaacttcctcttttgaatttgattcaaaatccccaatggtatgatcagtttaatttttcgcatgggggtggctggagataggaacacctatattctatcattttctcatatatttatatgatggctccttctaaaagtgaaggaaaaaagtatttaaaaccctgcaatgactgtaacttgcgtgtaaagtaggttgccaactatagtcagcgtgtcacaaagctggggaagccgtggccccgcgtgcagggtgtgagctggtgctgggatgagccggcctagggtactgtctgtgtcagcaaagccacacatctaatcacaccttcagattgattgaattgaaaggaatattagttactgaaataattgatgtagagacacgtttggctccttgcaatgaattatctatctgttattaaataaggtgtttgttttacacaaatgcaggcctggccgggttattttgaaatacaggaactatgaaagaatttgacttggatagtagcgtaataggaaccatcctttctgttatttcataatttctataattgccagtaattatacttgcttcttaattcacagggtacatttgtgggatcaagtttctttttatttttgaaatggagttttgctctttttgcccagaacggagtgcagtggcacaacttcagttcactgcaacctccgcctcccggtttgaagcagttctcctgcctcagcctcccgagtagctgggattacaggcacccaacaccatgtctgactaatttttgtatttttagtggagatgggggttttaccatgttggacaggttggtttcgaactcctgacctcagatgatccaccagccttgggctcccaaagtgctggattacaggcgtaagccaccgcagctggccttaagtttctctttttttttgagatggagtctcgctctgtcacccaggctggagtgcactggcacgatctcagctcattacaacctcctcctcccgggttcaagtgattctcctgcctcagcctcccgagtagctgggattgtaggcacccaccaccacgcctggctagtttttgtatttttggtagtgacggggtttcaccatgttggccaggctgatctcaaattcctgacctcaggtgatctgcctgcctcggcctctggaagtgctggcgttgcaggctcgttttttgttttaagagagaggtttgcaagctaaagtttctggatattttctgcctttgttgattaaaaccactgttcaagattcttcataacatgaagatacagtacccagttcttaagtagtcaatgtgaagtcaacacaaagagaacgacctctttagaaaatcgaaaggggacagaagtgctgtttttcttttctgttgtctttgtttattattagcattattatttttgcaaagtgccgttatgtcaaaggtatggtgtacagtttctcatcctggaataggacaaatttctgggcatcaacttcctcttctctaaagtggggatgataatgtcacacacctcactgggttttgacgattaaagatgtggagtttttagaatagtgtctgatactcagtaagagctccactattagctatcattgttaatattggaagattacaaagactatatcaattacaaagacttttacaatataagtttatggtcctgaagaaaaatgggataatggaattatatcacatatttacatcatttaattaaatatggtgtgttttcatatacccactccacccccatcttatatagtatttgtgttttttgtttaaaaaaatctgttagtcaaaataggtatttattaatatgattaactctaatagctaatcatggtaaggccggttagttcttccataatcagacaaaattaaaatacctcattactgggttttgctgcattgctgtcctccttgggggtcctaggatctgtgggggtggctatggggtgttttaggcagttgggtttctcctcctcctcctcctcttcaatgtgcaggtgtggggtgccctctgacccatcgtggccacaccaccaggcgtctccttcctgaggttctggcggccctctctggatgcctgacacaatcccctcatagatgccctcatcttcctctccaatgaccggaaggggtacaggcaaggaacccacgctggtgcacgcagaggccacaaaattatcccctaggacttctggtgcctttttagggtctgagaagccccttctcatttttctcaactctgcaaagttgctttgagttgtcgttctgggatcctgaagaggctctgcatggtaaggctgggctgcagccgaggccacacccgcgtgagtggaaggtgattcggcaggtgcagtcgctggggacaatgggaggaggacagcaggttcctccttaatttccaggatggcgtcctctaggatggttggtttggcttggtcagctgacaaggttaaagcaccaagcttctccaattcacccaagaagttgtccaggaaacgaggtggtgttggggccaaagggtttgctggtagacatgaggctgtcagggacaaccagccctggccagttccctggagagctcctttatctgagccaggtgagactttgtgggtgggaggaggggctggttcactggaagccaacttggaaatgagcacggattatgaagttaagaaaaaataaactaagaaaataataataatgcatcaaaacatagcgatggagaaatgcagaaaagatgcggtggtgaatatgaaaataattttatgtttaacatagatttgaagacatttagaagatatctagatttgaaggtattttgctgaaatttaaatacataaaatcatttatgttaattagaaaagttacttcacaaatgaaactctactagttttggaaggggtcttaaatgtcaaacaagataaagatgatatagagattaccaggacagtaaaaccttgagagatttatttttatttatttttaattttttaaaaaattttttagagatggagtctcgctgtggcacccaggctggagtgcagtggtgtgatctcggctcactgcaacctctgcctcccaggttcaaacgattttcctgcttcatcctcccgagtagctgggactacaggcgcatgtcaccagtacagctaatttttatatttttagtagagacgggtttcaccatgttggccaggctggtcttgaactcctgacctcgtgacccacccacctcagcctcccaaagtgctggggttacaggtgtgagccaccgcgcctggcccttaagagatttaatgcttacttactttaaactatgttgaaaagatattacaggtttccagatactgacttagtagagtataaatgactccagagaaatgttaatgtagaatgaaaactaatagtgaagtcattttatttcctgaatgtgtgtagtgttctcttgtcctgcaggatagcccaatcttttaaacgctgacaattttctcacttatgtttgcaaggtgattacaacatatgaataaagtattttagatcattatatgttaacaaatttctaagtgaataagttctgaaaactatgtctcaaagacaggaacccatgatcagaatgaagctgagcttacataactacggcttcaaagttttaaaaaatccaaagtaaatatttacatagaaagctcatttgatgctaacgggagggaggacttctgcttcagctcccgttctctttcaaagcttgacatttatgtaaatcagaggaggtatgagttatgaagcttaatcttctgaagtaaaatatacttacttctacatacgtagtattactgatgtattttggatatagtaaatgaaacaatacatttgaaattttatgcaaaggtattaaaagtagttctgataaatatatacaccccatatgtacccataaaaattagaaattaaaaaatgtagttccagaagtgccacttactaacattggaatacgtttatctacccttaccggactagagaaaatgctacctgctatgtgcctaaaagccttgagaagggacctttcactttaggtctctccaggtagatgtctttgatttggaaagaaaaacatctccaaaaagattctggagatacactttccagctgattgtttaggataacactttacacagggaagcagccctcttgctcctggggacttagtgtgtgtgagtgggtgatgcatttcctacttaacttttgactcctgtgtcctatagtaggagtggggtattaattagatttatttagctttttttttttaagtcatcttatcgtgggatgacataaatatcacaaaactcatgtgagcatcttaatacaggattcaggacctgggctgcttagctgctgacacacagtgagactgcacgtgtggtttgcgcctaggtagacagccactcctgttaagtcctgtagatgctgagttttcaatgatataaaccactcaagtctcattcagcagtctacagaagttcccttactagctagagttctagtttataccccttgttacataacacagaagttttcatagttagatttggaaagtctgtgaaatatataataatttcagaccatcaggtttccactttcactttctgttatgccaggaatattatgtagatgagaaagaaagatcttgaattcccttgtcattactgccaccatcaccattgctatctgatgctgcgactacgctgtgccgtcaccaccacagtcaccgaaatacatgtcagcaggttaaactgcttagctttatgatggacttgcttataccgaaagccaaatgaagcatcctggtataactagatcacaaacctatacctataatacaaaacccatacaattattttgttttccaaaagcatcagaattggattctaatgcactaaaagcagaaatatcagaaataaaatcaacatacattttagtctcccctaagacaaagacagtatgtcaagaaatgtgatttaaatgtgtcaccagagtgatttataaattattaatgagttctctgtttgtaaatatcagttagaaaataggttctgtagcgtttagtatattttggatgttatcatttagaaatacattatatttatctttctaaaaatggttgtcacttccgggaagttttcttcattaagcctgtgacatcacagcatggattaccagttgggataaaaccattaagtatttcttcctaattatggacataagcttctcaacatattttttccccagcagtgagcaataaaaaactggttattagtgaaatttgtacatgcctctgtttaaaatctggtattactttaaaaacttgaaaatatattcaattacagttaaattgtattcacatcaaagatgaaaacattgggatcaaaaatattatattgccattaaatattatattaggacatatggaagaatttgttagatgtttaatgagcttttgtacatacatgcttttcttccttacaacattttatttgaaggtacagttgctttgaaatttctgtgatagttatttaaagatgactgaatggtggataagacaaatatatgcatgaagattcttatcttttctctttatcaatagaaaatactgaaggaaggatgctgatctgtaaatgctaaggtctggtaatgaagtaaatatacttaagaagattctggaaaactataaccaatcaagcaaacaaaattggatagtaccaaactcttccatatattatccatgaatacagggttgagggtaattatttgcaactgaaactcagtcttcaaagaggatcacaataaataaaatgccaagacttcagccttctaaaaaaaaatgcctctcttaagatggcagattcttagatcatttcctcatataaaatccttctcaggctcattttcaagaagtagtttaggtcactgggatgctatcttgaaacagttttttcatcggaacatgaagtgacttcacactttagtaacatctgatatgttgattttattttaccagctctcgatggtttagcttttcatgtcctagccttgatctcaattaaaataattaataaattaggcaacttaatacattttttgaatgttgagaagtacttaaaacattttggaagtcattggcaatttaaagttttattcctagaagttaatgagaaaaaagacccttacatgcctttcataaaaagaatataattcatcagaaaaataagaaaaaatttcacattgtgagtacagacaaatagcctttttacattcaccaattaaagaagcaaagcctcttttaaattacgtattgagaaagataatcatctttagcccgctcaagtgaaacagtagaactggcatataactgtcctaaaactgataaaacaaacttgaggacttataataaccgacaacattttcatttaaactaataaacatcttgacttatagactctaattaaaaatttttgctctagctcattttccatataaaaaacttgtatagatttgtcaacctaataacccggtgttcttgtgatatactattttgagatatacatagtattttgtgttgtgtatatttatatttcaaattataaatcacaattgtatatacatgtatgaatatatgattatatttatttatatgtaaagattatattatatacataaaatttacatatataaaaatgaagctttaggaaaaaattatttcagaaaacatttatgtacacaggagtacagatatatatcatacgagacttcatgatactctcgttttctctttctctttcgatattttaacttgaaaatgaaatgagcaaaattaatcattaaatctttatgccagcacctatttgagaaacactgacttatatttactgatgtggcactcacacatgtagaaacataatatgtaaatctctttctctgcaatagatatgatattctaatctaatatcctaaagtcacacaccgattatcttacttggagcttccaatattacattaacatgatagagtatgttcttaccttatttgagctcaagctgtgaatcctatcactagaatagctgtggggtattggagggtcagggtagtcctcagcaccttttgtgttcttcttgacgacctccacataggaaacagggaagatgccttgtctgttggttcctgggattttaccttcataccagttttgatcaactcttttaagaagaataactctatctccctgttatgaatatgagaaaaatgcattagaaacagagatagaataacatgaaaatataattgtcaatgttttctatgaaaaaataggtttccatttgggcaggttttataccttcagtttttgtttaatcaggggagggcaagtaaggtactagtgcttactagaaaaatacacatgatcaacatatatgtaattgaaatgtccattcaggccatcagaatcttccctaaggatgcctgattaatgtgaacgggtttatacttgtttatgctggtattgtgtgaaattatttgtctaagttatttcaaaaagcagaatagtgtaaaaggtaatgtctcaatgacaataggattattttatctctggcaggttcagtgcattggccttctgtaggaagagcttcagaaagtgcaccatagcttgctgtgagggtctgtctgaaatgggttacagaaaacacctctagaagggagaacatcgaatggtacaccgttttctttttttatttctattttttttttttttttgagagggaatctcactctgtcacccgggctggagtgcagtggtgtgatcatggctcactgcaacccgcacctcctgggtttaagaattctcttgcctcagcctaccaagtagctgggattacaggcgcccgccaccaggcccggctaattttttgtattttagcagagataggggtttcaccatgttggtcaggctgatctccaactcctgacctcaagtgatctgaccgcctcggcctcccaaagtgctgggattgcaggcatgagccactgtgcccggccccttttcttctttaatctacatgcgctaagtagtgacagagtgaactaaagggatgggggaaagagagcgccctagaatatcaatagctgtgacaagactggcattcccctggtcttcaccctgacaatggaaacccagcatccatctgagtagttggtgaccattccatacttgtcattaaagatttgaatagaacccttggctttcacaatgatagaactttctagaatcacttccacctgccatgaccgagccagtgctgcagaactcagtttaaactttaactcaaaactacacgtagcctagaagtaggcaggcaagttgatgctaccgggcaaaaactgcagctgcattcagcaggtgatacagaagctcgggcagcggcacctgatggtgtgatggagctgaaacagtcattaatctcagcccaacagggcacccttcttcaggtgctacccaagaagaacttcgaccttgagtagcacttggaagttctctttgtgttgaaacgctggatggttgattttgtgtgcttcaccaccgctgagcagaacatactcaagaaaagtcagtctcaggctggatgcaatcgctcacgcctgtaatcccagcactttgggaggccaaggcgggcggatcatgaggtcaggagttcgagaccagcctggccaacatagtgaaaccccatctctactaaaaatacaaaaattagccgggtgtggtggcgggcacctgtagtcccagctaatcgggaggctgaggtgggagaatcgcttgaacctgggaggcagaggttgcagtgagctgagagcacacattgcactccagcctgggtgacagagtgacactccatctcaaaaaaaaaaaaaaaaaaaaaaagtcagtctccccaaatctgaaaattgcaccgattttctagtataccaagaacaggtagttgctaggctgttgtgtgagctgtaagaggcattggtgaagcctttctgtagaacatggaacaggagacagagttcatgtaatgctctgtggttctcatgctaggtggggcagcccagaggataggaaagaaggaatcggctgatgatgcagaattaagactgatgggagagaatgagacaaggttctgccaggaccagaacaaaccaggactgtggtattgctcttcatcgcacctggctaaggatttcactagtaggtgtgggaggtcctagagccactctaaatattactacctcgcctgtgttgtgtgcagaggcagttacctcaaacaaatatatgtcatatttagaaagcaataagaataattcatttatcattctcaattatgtaaactagcaggttaaaagaggtttttgattgtttttttgtgtttttttttttttttttttttttgagatggaatctcgctcacctgccttggcctcccaaagtgctgggattacaggcgtgagccaccatgcccggcctcgaggcttttgatattattaagaagagatactaggattggatgggctgctagagaaatttgggtcaattatgaggcccaaagaaggatgatccagggaagagcactgcagagatggctcttaaagcggctcccccaagaggaaggatcttctttacctaggaccattcctagattccaagatagaggaagataaggattggaatatcttgtttttaaaagactgaaaaataaggcagcaaaacaacatattttgaagtgtatcaaactgctttttccttttgtgctcccgaatgtataagtccttgattttcagccccatgcccggcttcccagactaagccacagagggagaagcctggtatcccacggggaactcctctaaaaggacacagggaccagcagggaaccgtgactctgggctgccttaaagagtcctttgtagaaaatagggtaaacataaaaatgtctaaagaaaaagataacctattttagttttgaaaatatacagccttttcaaacccactgaagaacaaacaaacaaaaacaaacaaacaaaaaaccagctgggctacctttctcagtgacagctccacatttgtgtctgcgttgaagttgtatttggctatagcttctccgatttctccgggctgggctggcggaggtggtcttgcaggctgtgctttctcaggaggtgtgagtttctatgaaggaaatagtcatttattctcaaatctgcggtgacctttgaaaccaccgccatccaagagagaaagggagaggacctacctctacgtatgagatcgggaagatgcccactctcccgtggtgttctccctcataccaattttgatcaattttcctgaggatgtagacagtatctcctttcttaaatgacaactccctggaagagacacgttgacatggtctttttgtgatgtacagcaataattctcaagatcaacaccctcgctagatctgcatttgtttggcaaatatacttacaatattaaaaaatccaattgatattgagtccgattagataagaatgatccttgcaaattcttagaatgcacttaaaacattataactttagaaatgatttcaaacagagtaagtataaacattccattggatataaatcacagacagattaataagaagtttaaaggaggggacagactcttgctactttaccattagttcagagaagaggcattttgaagcttggaaaaatgatggaatagttctgcactgattttttttttttttgtcctgaagctagttggctagttagttactagccccccagccccttttgatgtactgaagcttacatgaaggaaaacaaatatcatgtagcctcagaatagaagtgccaacaccagaacaaattttatttgtggatctttgaagttggttgacaggtattttaatagaatatcttgataaggaatttattttgtgtaacagaaaagatcttacacttttaattttcagtggggcaagaagaatgtgttttaagtgcaaagacatatgccaatgcttgcctttctatcttttatttacaaaaaataaaaatatttttaagacactatatttttcaattttggctgtttctaagaaaattgtaggtatatttgatttgggtatttataattttaagttataatgacattatgcattttgaataattcacacctaaacttatcaccttcactacatcaatttttcctggcttaatcacccaggtgattaggttggttcattattttgcctccgcaattattcttggatggagggcgattaatttgtatcttctcccaagagcctcattttgcaatacatctgccctcccactctggaatcttctgcattgttttgttcagaattttcattttttaatctttttttaaaaaattttggttcagaattttcagttggatcatttattagtataggccgtttgatggagagagatttatacctgatggagaacacttctcattgattaaaagaattaatcgaaaaaatggtggtatattaaaagaatgatcacacatttagaagtgctaaaatcttcacaattgaaaatgtgttaaattttcagtaaccctaaaaacaaagaagattcatggagctttacattcaaatacagtgcttccttcttttgtgcaaatgcctaatgtaaaaaacagaaaacaaagcaaagcaagatatttaatgttcacaacacaacagtttcatttgtactaggtatgttttgtttctggaaatgagactagctttttaaaatataatatgaacatatgaatcagaggcaaccaatttttcaaagctatgaaaaagactcttttgtatttgtataggttgcatttaaaattttgaagtccttaagacacaggaaagtcttactcttaagttttcaaaactgtgtccctctcatctcagacctagaattttaaagtcccatttgcttttttcccctcacttttatttttatttgtttttgagatggagtcttgctctgtcacccaggctggagtgcagtggtgtgatcttggctcactgcaaccttcacctcccaggttcaagtgattctcccacctcagcctcctgagtagctgggattacaggcacccaccaccacccctggctaatttttgtattttcagtagagacggggtttcaccatgttggccaggctggtctcgaacttctgacctcgagtgatccatctgccttggcctcccaaagtgctgggattacaggcatgagccaccgtgcccagctgctttttaaaattaagacttctcagaagacctcgtgagccttgggtggacacccttcctacttcacatcccctgccattcctcaggtttttatatatttaagaaagctatggattgatttttacaaagaagaaatgaaacgtgtgctccgtaacattattttataaaactgatatgcattgtacaaattgtcacaccatatccacagaacagtagttaggaccggagtacagtagaaacaaagcatcttatttctctaatttgaaaaaaaaagatgtaagcttttcttcaggccagatttaagccatgttcaacatcttaatttctaaacaggatttttcttatctagttcatttcctatctcagcagcattaccaaattctgagtgatttatttatatatgtcttctgccagagacagtttctagagctattaactcatattatatgcatttttatgagtaaattattttggttattatatatatatatattcagtgtaaacaacatataataatttaatgacaatttacaatgaattcaatatctgtcttgaattctactggagaacaaagtttcttaaaggtctgtgcacataggccacaaaaaatctgggcaacaccctcttatatataagtctgcttatgtgcttccgcaaccacatgcctatctgctgagcaaagaataaaggcaaaagaaatattgcaattcaggatggtgaaaacaccgacaccaaaagaccaaaggagaaaactttgctcagaatctctgagctttgcaggctgaggatggagacttcaatacaggaatctttgtactaagttctagtcatcaaccccacaaactatgcttggaatatttggataaataaatgttatcaaattcccccagctagtgttaattactccccaatactttatttatttacttattcattcttttttttgagacagggtcctgctctgttgcccaggctagagtgcagtggcgcaacctcagcttatggcagcgtctacctcccggtgaagcgatccttttgcctcagcctcctgagtagctgggactatacaggtgtatgcccccatgcctagctaatttttgtattttttgtagagacatggttttgccatgttgcccaggctggttttgaactcctgggctcaagccatctgcctgccttggcctcccaaagtgctgggattacaggcatgagccactgtgcctggcccccaatacttcattaattcattattgacacaaaattctaaaaacaaatattcctaaattctttttgtttttcctatcctttagaattcattgtgttctacctaacatgtttaatgtaatttaaaactcagtaattctcaactaaacttaaaataaaaggtaattctgaaggaaccatttaattagagtagattgctgcattgggaattagacctcatttgtaacagatcctactgcaatgcttatctcttaaagcattactaacatttaaaaccaccttaaatcatatgatgagtatttatcttacttacttagatgtctgagccttaaaatcataaacagcttttgcaggcaatttctgaaaaggaagataaacaattagcactaatttaaaatttgaattttctacaagaaagtagtttaatgtgccttaaagaaaaaggaaacctcagggaatcatcaaacatatgtaatgttaatcctgtaagcaatttataaataagtccattcattcttcatttagatatttaagctataataggaatataatagaaggcttattcaccatcatatttaatcttaggaactaaggtagattaatgttataatgagagaataaaatgcctgcagaggtttgcatcctaggcatcattttggctgttacaaaggctcttcctaggataaatgtggagggtcaatggctctatgttctatggagattgacacagctccctctgaatcataataaaaggaccagatgtcataaaagaagtaatcattcccttcattagacacttattaacatattagcaaaaaatattagctcaattatcactgggaggctggttagtgggcaaaagtataggtgtgatcatcttgcattccctagagggctcaggaatccttcaacactctgtccaccagccactcgtcttttagttgtgatgtgatgtgacacgtgcccatcctcaaactctgggggccacagatctccctgaggtaccctgtaccctatagctagctaggccagctcttccttcctcaccaaccaacaatcccttcactccattcttttcccccatgactctggtgaactttaggaatcctggaccatttctaacttctttggggatcccacaggctctggactacatcagacgcctataagatcctctggagcggctaccagtccaagtccagcttttagtttccatccagccgtcatggctccaaggcagtttgagcaagaactctagccccggctcagggccctggacagagttcagttggtgggtggttcccaggggcagtatcccgagaactgggctggttaaaagctctttttagggatcctctccaataaaaggaagccagcaaaaatgatttctgtaggctctgtattgatttacaacacagttgacatcaggctttctcctggaccagcgggccaagaaattgtagaggaaacctattgcctccacgaggtgccctaactcaggacacttttaggtcataatggttaagttcatgggcatcaggtcaagactcggagaagcctcatggccaaaactgggccaccactagggaagacccacagctagggtcagggtgtggactgcttctagggtcagagttgctatgctcaggccccaaggaaaattgtttctagtttctcagtattttcacatttcctgtccgagttcgttactggtttgggataatttttggctggtaagtgctgtatcaagtgtgttgctgtgaaagactccaatgctattaaattaactacctctttttctggagttcctcttctttcccttggtgcacttctccccatgtcagtcaaagtggatgagtaacttctaggggactcacggtctattggaaagaacagggccagtcatggtgagtatccacttaattacaagccaacctgttccgccattttccctggtggccactacttttttccccaaatttggagagacaccgttatcgaacacatgggcataaaactcatagttcattacaaagttgtgaaataagacacaaaacaagagcatttcaaaaggaaaaatatctgaggttgcagaattataattgtctatataaatatgattactacattgctgattaattatattgccacacccagtaagacaatttatagttagagggatttttcatataaattttttccaaagctttctgtttctatgcctttgcttcttatttataattactattataagatttacagaggatggagaatttgaaaatagcaacaatttgtagaaaaagaaacattttgtggagtaatttaagactgtagtaatgaaaaagaaagagataaaaccaaagaaagtatgaggatgacaggagggtggtgatgaacattctccttctgccttactctcccctcttcgctcttcctctgtttttaaatacttattgaatctcaagatgccatgctgtttatctacgaccttcctttgtgcccagatgataaacaccttatcagaaagcaaagaaacaaagagatattgtttcttcttactccaagcaaaaaagggataaacagaaagcatcatgtcagttgccaaattgcttatgaaatattgaattatttttgttcatcttaaagcaaagcataaataatcacattacaaaattttgattgcatgtagttcttaatagtatcttataccttttgcacttacgtgacttacatatggagatgtaactagacattaaatgtattccagtagtctatgttatagaattttatcagtacaactgggtcaatatttgtcaattctttcttttatcccttaaatatatctagttatccagactaacaagaagcattaaaaataaaatttattttatccatctatgaaagaatttaaagtgctgattcataataagaaaacattgttttaggattttgactactttgatgatgtaaattctaagttaatatacttttatgatcatagggcctcataatgatcataaattttaaattactttttctaacccagggaatataagctatttttcacttgggtgaaacacaattggaaagtaaatattttactaaaaaacaaaatacttttaaatgcatttcaaagcccttccaagttacgtttcaaaaatgtactcctatctgcacataaaattgagagatggttatattaggatattaaaagcctggagaaggtagctaatttattaaaaaatgagattctgacacatttcaattagtgaaaattttgaattgtagaaattgattttttaaattctaatttattattttgaagcatgttgcttcagcctaagggtaggcaaagataaacgtaagtgtatagtgtagcaaaagtgaaagcaaacataaagactaagtagatttgtgcaagttaattaacaatcgagccatatttgacactagtatgaactgtgaattatgtctttttttttgtctgagattatattttatactataaattctgaattattaggggtttgaatctcttttctgttatctactctctgtgtgaccttggacgaatttcctttcctctctgggcccaacttccaaaattgaaaatggcttttgaaataacacccatttcataggcctatgccagttttattagataatgtatgtaaagcactctgtagtgtctggtgcatagaagtttctctgttgaccaactttcagcccggaatgttcattccagcctcttaaaatttacgtagtgaacagatgtgctgtaagaattaatgaaaataattggtcacaaatattaaaacaccctgggctgtaagttatataaatctcaaaaatagtcctctgcctttcaattgctatttattcttgtgttgccacttcaaagttatctatgaaaatagagtttagagtcactgttagcctgaatagtgtaattcaaatttcaatacaggactgttttagcagaaagagaaagtgaatgaattaagtaatggaaaagagaaaatgaatacactaaatggtggaaatgggacttttatatatatagcttaaagatacattcacaaaaattttatcaccattgtgtccttgaaatggagaaagctattaaacaaaccctaatttctttgtgtccatcaattactaatcacatatttcagttttgcttcttgaatgttttgatatagtatcttctatatagaatgtgacaaattatttattaactgaatgaatataaagttttaacgttaatataaacatttttaaaaggctatttgtggaactataggttttgattcatgtcacaacgtaatttattgtctcaatgtgagtagtggttgtttcaaccctaatgctgagctacaaaatggccttccctctcgttttcgaaagagtaaatttttgtgaattgatgatcactttaagccacacatcaagtccaaatatcacatgggcaaatgagaaatattcagtaagacatatttgcacaacaagtttttgcttcacaacacataacgacgccaaatggtctcccagctcgggagtgatgagatgttggaatggaaaatgaaagagctggagggtgggtctctgaaccacaaggaaaaagaaagaaaagctcatccaccttggagtgcaccgccacggtcttggtggtggcagctgctgttggctgtgtccacgtcttggaaagaggcactgcggggcattctcccgcagtcattctggtagggtggacaatgaatagcaccatcgggaggcagtgggtggagaggctggtgcagggggctcctcctcagcgctctcagggatgagttcctctcgggaacatctggcagcagctcactgatgaggcggtgcaggatgctgttgtccggcaagctcccccttttcttttcagctttaatttggtcacagatgtctttaagggcagagtccagagcctcaaacacagatgctttacattttgccttttcagtctgtttcttaggagccgaattttttttcctccggaaaggcacaggactgactagaaaagcaagtttagaaaggccagggtccatttcttgccttctgggctcctcggtgttttcgtgtctggctctttcgtgttttaacattgtggtaaatcgagtgtaggaggccgggcacctgcctttgcaggagctgatgaggtggcggtggtggtggtggtggtgatggtggtggtggtggctggatccgtaaaagctttcggaggatgtgaaggaaaagtgatcaaagtcactttcactgcagaaggatgacccctctaggtgaatgtagtcactgtggtcggacacaaccccgtcctggtcgctgtcggaaaactccacgtgtgctcggggctgctcatcgctggtgacttcaatgtgaatgggcaccagggcgttagactggcagcctcgccggccccgagcgggggggccgctttgattttcttcctccagcaaatactcaatggaaaaccgcctcttgggacataggccattttgcggtggttctagggttacgggagacagcatgtcatcccctaaatttggcatggatttggacttctggatcagcttttcgaattcggagatgcgtgtgggcaccatgtcccggggcacctcctccgtggagcactggctccaggcgcgcagcaggtccttgtgctgctgctcgctctcgtactgcagaatcctggacttcacggagcagatcacctcggagttcatcaggtccttgcggttgatgcggtgcattttcttgtacatcttcaggaaccccggggcgttgcgggctgacctgtgtctgatccttgatctgccgttactgcgaacctccgggacgtagggggacccccacgccatggggcagctctccttggagtcctcctcacataacagggagcccatgctttccgacttgactttcgggtccgggaagctatcgcagtcgtcgtttaggagatcgtcacagctccgggatttgattttgggagagacggtttcttccgtgctgctccagatttctgcgttttgccgggccatttgccagccgttcttgaaactaatggctcttggtgagtcccgagggacatccaagtgctgtctgtaagtgctacagtaatctaactcactggaggggttgccgttgagccctgagtaactgcaaagggatggacatattttgctatcatccccaccttttaatccagagcagcgtggtagaagagagacatttggagaagttaaaaggttcacaaagagaggagagcatgtcagtaaagcatcagacagcatagcaaggagaaagcagttagtgtgttttaatctaggtgctgattgttcacacatggagcttcaactctagagaagaaggtctaattctaaagcgagctaatactttttcagtgaatgtagctttgcagagagagttgacaaaactgtgtataagaagcaaccgacgtaagcaaatacacctactcctactgcataattcatacacctttctgacaatattgtttgccaaaacacaatagtgctgcttcagctgatagcatgatctggtagtgaaggtttaacaattagtgtcaaaagtgttatacccttacgcaatttaatagggccggaatttgagcctcatttgattcgtaatgatacataggtgaagaagggtttatacatttacatcgaattaatactctcatgactatatcaaataattttttgtgggttttagattttaaaagctataaggcaaagtattctccaaaattgcaaaatcaaaatgctgtgaactattgctgctaacatttttctagaaaaaaatagctaaagctctttaaacaaacgaatttacctcttaaattgctctacctttaaccttttattaggtacaaaattctcataggaaaactgaatataatgcaaaactttcatcagaggtgcatataccatgctttttttctcggaagagttctttgaaaaatcatttgcaatttgataatagagatctacatttggcctcaattttgaatagctatggaaatgttcttttgctttgctgagtcaactaataaatgaggagccaaattatatctaataggacattttcttcctagaaataaaatctaatggaggaaaatatctctattcaatacttataccttacaatgttctctaaattctttaaaagtagataagcacattaggtagatctgtactgtctgggaaaggaagttgatttaacattccctgtgatgaaacaaatatctacatttatcagaacccttttaacttttggctagtatccaagaataataggtcaatggcatttcatgacctacttgttaccttaagatattcatttgaataagtgagttgaatctgataaggcatctctgctcctcagaggaaagatgtgatggatggggctcacacgccctgaaccatcagctgatatcacagctttacaaggccttaaaagggctaggcatccacctactcagagtccaatcatcacgaccagaataccttttgcacacaaatcagctaccacttttaactaccatgtggcaatggttttagtgactatagttgataggtgtagctgaattggtctggttttatagaaacttacattagagctcaatttctttacacatttcaaaatctctttctcttctctttcaatcccaagatattagaggagattgtggggtcccacatttggtagagccctagctccctgtaggggctggttcaatcctcactctccatctcagaaatattcctgtcctcaaggaataccactaaatggtcttccagaaaccagaaggagtgacttctttcaacagtgagctccctacacttgcagagaggagacgggccatccagaaaaaaaggcttggtgattcctcagtgatatcattatggtttgggaccaattagtcctgactgtgagctgctgtgaattgaccactgtgttacatggcaggaggtggatgctccactgttcatgtgaaggtggcccaaaatatacagcaaatggctaaagaaattaataggtcggatttttttaaaatctagaattgaataattttttaaaaccctccaaaccaatgtatattttagccaacaatttgctctgttgctgcttgtaatttttatcctataaatttgactaatttgctagttgtagaaacattagaaaattttgactatatgtcaatgtttacaaaatacatcttttagtagcctgatgatacattatttgatactttcaatttgtttagaaagggatctatttgggggaaaaaagcattagcagatgctagtcagagttctttaagcaacctaagtggctcgccagcttgagtcagtctgggtgggaagaaggctattgttctaaaactatattttattccagacactgtaggtgagagctggcacatgccactatcactgggccagctttcacacagtgctctaggctaaaacgtaaactagtaaattgttgtgttttcatttactatgctcaccttttgctcttgatggggaagaaggagaagagctagtgaaagactttgtaagagtggtgcttgatcctgggaggtccactcggcctgggctagtcctgctcgcactttgatctcccaagccccgtggtggacccactgcaggctcgctcttcctccgcttcctgaagtcactggccatgcttgcagaactgaaagaaggaatcagatctgtttgattggcactggaggaggttcgggtgtgcaccagaaaaaccggtggaacgtgctagtgacaatggcgtaactcctaaacctctatccccaaaactgcattgctaggaactcatcccttgatgttcaacatgatttctctagaaggatcttttaaaaaatgaatagaccttattatttattttgagatggcttctggctctgtcacccaggctggaagcgcagtggtgcaatcacagctcactgcagccccaaactcctgggctcaagggatactcccgcctcaacctcctgagtagctgggaccacaggtgggtgccacctcacctggctaatttttttaaatttgttatttatgtagagacagagtctcactatgttgcccaggctggtctcaaacccctgagctcaagtaatcctcaagcctcagtctcctgaagtgttgggattacaggcgtgaaccactgtgcccggacaactaaatttttttagggcagttttaggcttacagaaataatgactggaaagtgtagagagtttccttatagtccctttcctcttgcacagtttcccttatcatttacatattcttttggtgggtacattgtcacaattgatgaatctttcctgatgcgtcgtcaccccaagtccatagtttacatttgagttcatgttttgtcttaaacattttaggggttttgagaaatgtataatgatgtgtgtccatcattaatgtgtcaatcatataaaatagtcttcccgccataaaaagcttctgtcctccagcttttcatccctcccttcctcccgctcatcctggcacccactgatctttccacacggcctccacagtttcgccttttcaccatgcccagttgatatcatgcagaatgtggcctctcaggttggcttcctgcactcggtgatacacttttaaggctcctccatgtgttttttgtcacttgatagctcatttctttgtattgctgagtcacattctattattacatggatgcgccacagtttatgtatccattcacctattgaaggacatcttggttgcttccaacttctagcaattataaataatgctcctaagaaaaccacctgctggtttttgtgtgaacctaagtttttaaacatctttgaacgtcaaaattctcctatagtgtaatatgttgattgagaattcagtgctataatttgtatcttgtatcttttctctataaagcggagttctaacaacatgaatatatccagaggggcataccaaatacaggaaataactgaaaaaaaaaaaagacatcaagagaggaaaatctctctcacctcaagggttgcctgcagcttgtcctatcatctctatcatcttagctttagaagatgttatattggaattccaacattttttatttaaataatgaatgaaggctgagtatgatggctcacgtctgtaatcaagtactttgggaggccaaggctggaggatggctcaaggtcaggagtttgagaccagcctggacaacctagtgagactctgtctctacagaaaataaaaaagttagccagttgtgtcatgtgcctgtagtcccagctattcaggaggctgaggtgggaggatagcttgagcacaggagtttgaggctgcagtgagccatgattgcaccactgcactccagcttgggcaacagagcaagaccctgtctcatcagtcagtcaatcaatcagtaccagtaatctggtcagcaaattaactattaaagattccttcccctcagttgcataaaatactgtcaatagtctagaacagcagggagtttctgtcatggttttgagtttgagtacagtatcatttaagaccaatgttaatgaatgaagccacatatggcacagcacactgtgcatgaaatcactggattcttagacaagacttgtgtagacaacagtgataatagcaacagcagcaaccccagctcctatggagcccagcagaatgctatgtgctttctttatgtttttgtcttatttagcccacacagcaaaccgatgaggtatatgctgttatctcagttttacaaatggtaaagtgaatacatgtgtctgggatgtacggaagcaagcggagaggcagacctcagaactggtttgtcctcttctgaagaggatgcatctcctagacctgtttttgctgggactgtcctgtcatgtgagggtctgtgtgtctttacggcaatctgtagattagattaaaactctaaaattcaaatattttaggtgcatagatagaggcagaagataaaaaggaggggttccagagttcctttctcagggatgttattgcagttggatggcactcagaaacccaatttatgattgacccaattcacaaagaaatctacatagaagggtaaattaatgctactagataaatatttgttattgatgttacaatatggctgggagtttgtattattcaatattactattgaactatgtctgaatatgtctgaattttgtgatttgtttttttttttttttttagactgagtcttgctgtgttgccaggctggagtgcagtggtgcaatctcgactcactgcaacctccaccctcccaggctcaagcgattcttctgcctcagcctcctgaatagctgtgactagaggggcatgccaccatgtctagctaatttttgtagttttagtagtgatggggtttcaccatgatggccaggatggtctcaatctcttgacctcatgatcttcccccctcagcctcccaactgctgggattacaggcatgagccaccgtgcctggccatgaattttgtaatattttttaaaaagtgtgatatttaaagctaatggaacttacttcaggcgaactctgagggaagttaggcctagcggtgacaagctatcttgcctcaatttcttttttttctctctccttgccaactgtgtaaacttggtaagttactaagcctaggtgtcactttcctcagagataaagtggggacaatagtatttaaccatagtgttttcttaggattgaatatgttttgtacttatgcctcatttattggtagtattaataacagtatttctgatttgtgtggtcaaagtatgattaacaaatacgtgtataacactttttaatctataatttttttcaaatatattattataagggccatttaacaacattgaaaattagttacttataattcccatctaaagaaaagaaaactgggtataggggactaagggaagagaaggatttctcagtctgtgaaggaatttataattagttcactaattttttagaaattcttgaaatgatcatataaaatgatgctgaaacaaaataaaacaacttcatgaggcatggtacttcaaataaaaatgagtgatacatgatactcattactacttcactgaataattttattgttgaaaaagaaaccactggtatagaatattctgctacaacataataagattcttacctcatgggtctttccaggcttctgtctatagaggactgatacaaggaggcctgttaagataggataatagtaccatgaaaaattttaccgtggcaaaattttgttcacttgtcaacattaaattaggtatcctaaaaagaatattataaaaattgaggttgaaagtaccattcattatgactataaaaatgtcttcccaaagagagatcatgcgacctgatttctacttgggacctatctgctttcccttctgatataatgcattgcagttctctgtgtagctcaaattatccacaacccaagcattgcatggggggaaattaataatattttctcagggacactgaaataagagctaaagttatcctacagcctgaactgcagaatcttacctgttgactgtaaatagaaatttcctacagaaaggaatggtttgatgttttaaaaaatttgtagtcatcattcaatccttataaaacatcacattttaaagtttttgttattgttgttaccaagtattgtcttcagaatgtaacacataagcagaacttaagacaccattcatctgtcaacatagacatgacgtttaaataaaacccacagagtttgacttgaagaaactaaataaagtacctggtacttcaatcaggtaaatagttatacttttacaattaggtgagttcagggctagtttaaaataaatgagctaatgaagcaaaatataacttttttaaagtgcgcttttaaatttttccttcattctgaataatacactgaaatagatagtaagcaaaaatgataatatgaattttttattttccatggcatctgctgggataattgctaaaatatctaaaaggcaagagaggacactgagctatcaagtgtttgaggtgacactgtggtatgatgtccagaaagcacagggagatggctgggtgcagtggctcatgcctgtaatcccagcactttgggaggccaacgcgggtggatcacctgtggtcaggagttcaagatcagcctgaccaacgtggtgaaaccctgtctctactaaatatgaaaaacgagccaggcatggtgacacattcctgttatcccagccacgcaggaggctgaggcaggagaattgcttgaatctgggaggcagaggttgcagcgagtcgagatggcgccactgcactccagcctgggccatgagagtgaaaccccatctcaaaaaaacaaaaacaaaaaacaacaaaaaaacaaaacaaaacaaaacaaaacaaaagtataaagaaagtatagggagatgtataccaagtatagatagttttgcctttggtcatatttgatgatcaattcatcacagataaaatttggtttgatgaagaactggaattctagtttaaaaacatttgtctgtatgaaagcttaaaaatgtcagccagaaaggcaaggtttgacaaatgttgtcttaagttgccatcatctagaaacattttatcagagtattaaacatctacttagtggaaatcaaatctcactttacaaactatttctataactcagttttctattaattggtaaattagcaccaattaatcaattaaaacaatacaattttgcaattctgtatgtatatcagtcttacaaggtcccttttgcataacttacgcttctattaactaatattttaatttaattctatcttactaaatgaaaatggaatcttgtctagaaacaaaagcatctctgcatgagaatattcccatcctccttttagacagaaaaagtggattgtaatatttttagttcctagaaaatatttagatttctaggttctcaacaaatataaaatcaggagaaaagtttggtttgctagtctgatatgtgtacatggttattttaatttgctgagctctgaatcagacactgggaaggtagaaaaatagatactaaatatgaaagaaagcaaacaagtaaaataaaatcagatcgttatattacaattaagaaatattaattctactcgtttgcagaagagcgacactgaagagcctgagagcatcggcgtctgtgcagatcacggctttcgtgggacaccctcacacacagctgatcaccaaaaagtgtgaagttcacaacactcttagaacaaccctacagtgatcagaaaatttgaattgtcaacttataatgagcctaaacaatattgtaatgtgaaataaaacatagtgtaagaactgattgtgttttagggttaggctaagaaactactatttctccttgtactggtttctacattcaaaataaatgaaaaccagttttgcggtttcatgtacactcagagaaagttcagtattaaattgtaagataagagtaaaaaatctagattgatgactgagagaaaaacttgtacaataattgtaagaagtgtactcatcccaaaatgaaaattatctccagaaaagaggttacaaattttaccagttatgatctactatttacatattaccattattttaacacacttagaaggtcaatttagtgaagtacagatactgaatcactctttctgttaagtagctatgagattaaattttgcttaaatatccgtaactgttcttcattaatgccagttttccagttatggattaaaatctatgttattcatggtatataccaggcagttgataaacggtagctaaggtaatgtctaatcaattacatttgtttttaccagaaatgtttaataacaaaaggttattaaagacaaaatccagaaccttaagagaatatattttcttacattctgaaaaactataatgtgaaattaataacatagttaacatatgctattagaatcatacagcaccccctctcaatcccagagataactggcaaatagatcaactactggcaaagtgctttttatgtgttgtttttttttttttgccactaccatcacataatagaatgcatagagttaagtttctactatttttatgcccaagaattattgtgtaatattaattaacagaactcttttcacaggaattcaatagttaacaagaaataatattaagtaagtaatttgtttttaaaagatttatcctctaaatatatatcttggaagtgctgaaaagtgtgatataaaggaaatagcacagaaatgaaggttaagagagatatatttttttttctgccactatcttaccatgtgattttggacttatttcttaaaattattgcactctacttttttttttaactgaaaaatgagtgaattggacatgatgcactctaaattccatttcagttatctatgaaccaactaccttaaaaacaccctagaaatatctgagaaaaatatctgaccacattgaatttcaaaataaattcttgggttgttcatatgttgaaataagactctttctgcagatattaaggtaacataacatacagaatataaccccttgttttatttgattttcttcagattacatgcctgcctgcctggctataaaatgtaagcctttagaaataactgaattcaataacccagaatgttcctgattactctattttaccttttatttaatatataaatattttgatcacttctcagttttaacacacactctgatgtttaccacagggtaaataatttgaaattgcaagttgagacgctagaaatttgcatattttcttgagactctatacctgcaattccagtggtcaccactatgtgtcagtagtacctcctacaacacaacggttctactggttgtgtttcccagttgcacatatttaagacttttaatgaaaataagatatttattgtgttatagtattcacttaagaccacagagcaactaatgtgcaaaaaacagtttatttacttcgttcccatgctagttgcttctaagagttccttgcaaggaggcttttatatagctgatggctagcaaaacagtgccatttctgcttgtgtcttctaatgagtcatttatccactttctaaagtaattttctgcttttctttgcagagagcaggttaacaagcttttgactctgaatcatttctgcctgtatcattctctctttcaaataaaactctgattcaaataaaaatatacattggctgccataaatttttcacctagttgattattataggctcttaagtagagattgcaaacgcatttcattttatatgccaatgataatttgttatagtggctgcctggattacagtgttgaaaaggagtagtcatgtctgtcatgggtatgaaactgggaagttgtgatacacaatttccaggtatttgccagccctattcttgactgataatacaatccgtaagttgtatttaggaaaatgaaagaacaaaaataaattttagaaatatatgggacataggcatctgattatccacactccaagcattataatagaatggttctaagaagccttcttgtagtattttactctgtctcataaaaagaggtggttaatatatgcactaagactaatacttttgatttttaattttcacgctgctgaataccagaactacatagaatagtataactagcagttgtggttggaatgattcttcacccagagtccagagatagccaacaactctggtataattaatgtccaggcaatgatactggatgcaacataatgatgcaaagatagatattttttcaaaaatagcttagacattacagagaattgtaaaacacagatgtgcagaatcacagtcacagcctctaagggagatatctgaaaaagagagaataacgtgtttttacctcattgaaaacaccagaagaatgatcttgaacatagtccagaggctttttaggaggctgggtgtagacgcaccacagaagcagaagtgtagggatggaatggaggagagtcaatggcagcaaggaatgaacatgtggaaaaggtgacaacagttagaaattgagtgttgacagcaccagctacacaaacagaatgacatgaatggagcaaaatgggggcagctgggaggaagtgtgcaacgtctgcaaatattctcaagcactgggaaaattggctagtgttcaattagtatatttataaattcattttgtcaaatttcattagcactcctagtctctggccacagaggaatgcaaggtaaattaaagaaacattaaaggagcaagtggatagcatgctggtgagtttccatgtgtgactgaaaatgattatggaaaatgctgataacttaggctcagtacagaatagtccctataagctttctttttgaattattttattttattttattttatttttttgagacagggtttcactctgtcacccaggctggagtgtagtgacaccgtctcagctcactgcaatctctgccaccagggttcaagtgattctcccacctcagccccctgagtagctgggattacaggcgtacgccaccatgcccagctaatttttgtatttttagtagagaaggggtttcaccatgttggccaggctggtctcgaacccctgacctcaagtgttccgtctgcctcagcctcccaaaatgctgggattacaggtgtgagtcaccacgcctggccgtccctataaactttctaaccaacagcaacaatacatataaaataaagctagagaatgtttttccttgaaataaaatacatttacattcacactaagatacaaatgagaaaaaatgagagaaaacattcctcctatgagataataaccctaagaaaaatcctttggtttatattcgtttacagtcacttttgattcagttcaataagctaccttgagtctaaccaagtctcctttgcagtttaatggacaaaagagactaccatcaccaatcagtaaaccatatatggtccatatgcaagtatataaatcagcatatggtatagaaatggttatatcctgatttctaaaaaaactatcagtgtaattggtaggttatttaagagtctaaaacgcataaaaacgtgtgtaactgacacacatcaaatgcactgctgttggtggatacagttcctaatcagggaagttgttaactgaacctccagttgactattttttttttttttttttgagatggagtctcactctgtcgcccaggctggagtgcagtggcgtgatcccagctcactgcaatctccgcctcccaggttcaagcgattctcctgcctcggtctcccaagtagctgggactacaggcacccgccaccatgcccaactaatgtttgtatttttagcagagacggggtttcaccatgttggccagaatggtctcaatctgttgatttcgtgatccgcctgcctcggcctcccaaagtgctgggattacaggtgtgagccaccgtgctcggcctcaagttgactctttatcccaaacaggctaagcaataaggcccaacctctgggcttcctctggcgggagtctggggattagagaagctgtgatggctttcactagcaagtctggaaattaagatccacaggacttcctgatttttttctttccttatatccctaatggtaaactaggtacagtcatgtgttgcataatgacgtttccgtcaacgatgcacctatatatgatggtggtcctatgggattataagactgtatttttaccatgccttttctatgtttagatatgtttaggtacacaaatacctaccattgcattacagttgcctacagtatggagtgcaggaacctgctgtacaggtttgtagcccaggagcaacgggccatagcacacagcctaggcgtgtagcaggctctagcatctgggtttgtgtaagtactctgcgatgtttgcacaatggcaagtccacctgatgacacatttctcagaacccgtccacatccttaagcaacacgtgactgtattttgtagtgggattactctggcagtatattatagtgagaactgcccagagattttcatttttctttaacaggctctgcgtttaacttcttactctgccatttactattttgtgcacattacttaacccctccagtccccattttcttcttcttggcgggacatcaggaggcctcgaggagataatgaagacagaagcccgcactctccaggtgcctgatgtttgctcagcaaacaggactcaatgtcaaggtgctcttctgcttgaactagaccaaatagactgtaaacaaatacaaatcttctatacagctgtaataattgtctgaatattccatcacagaaactacctcaagattttgaacttgtaatgaattagatgtaaagaaatcttaatgaatgacctacaaaccacataggaaatgtctgagcacatttgaccatttggtacagaaatgaatctggactacgctgtaccaagtgtgtgtatacattatgcattcggcctttgttctctgaatgacacccacgtctactgataattgtattttagaaatcaaacagtatactcctagttttcttatattaatagtctagcctcacttaccgggcgtccaaactccagttctgaaaagaatttataccagggctcattttctaaatctatgtcatctggatttatgcgatcagtctagagcagatgtgaaggaaaagggaaggaaaaggcacactgagcaaagtgagggaaacgctgtgtggcatgaaaaactcacgcgcgcattgacacgcaaacatgcatcaactctcaccccacgaacctcagcaggagagaacggaggaagtaaagtaaaacgagtagcatgaggatgtgaaggcgagctccatggcagggggtccctagctgtttcctgcgtccatcgtttctgattggcataagttgtgggcaactcttgcttgagttgatccacttacgcttgaggcatgaactatggaccactctctgcggcagcgagactgggtctggctggcacgcctgatgtttggaataggctcaacccagtcaccaaatagctcttttgggcgagtcacttcatcgtccctgccctcattggtggctagcagtcccagcatgggagcccgcagtctgcagacaattcactcgggtgcaggcaggtggtaagcctgggatggggaagggtgcgggaggggtgggaagacaggcgagctggggggagggggacagggcattggggggctctcaggggcctgtggatgagaagattctggggcctggatgggtgcgagcgggacccgggggagtgggagtcgccaggctctgagcaagcaagggctgcacctgcacctctgccgggcatgaagaaaggtaaggaaggaaggagctcacccgggtgggagacagagccggggcgcgcgagcttggtgtgggggcgccactccggggcggaggggaggggctaccagtgacttctccgagtcgggagctagaaagaggcttccggccaggttcccttggaacaggtgtcggagttgttgggagagggggctgcaagaaagaggggtgcagaaactggttcattagatggaggctctgggcggaaccgcgaggacaccctggcagcgcgctgtgcctgcgttaggccgggaggggagaggcctccggacggcgaagtgtccctagggacccagacgcctcgggagcgatccgggccgctgcgaagccctgcccaccaggagtggatccccaggattcacctcccggctgcctgctctgagctgagaaggggatctggttcttcacaataccgtggatggcggggaaggggagggagcctggggtaaaatcccatcttggtttcctcgatgttctaatttagagaaaaagccagttttataattgacctgcttccctgcagaggtttctgaatgttgtttttaagatgaaaaaactagcagtgttaatataaacagttggagaaaatacatacaattattctagtaatagaaaacagatgtagagtgtttaccttacccagcagtgtccttaatattttcaaataatacatggctgactagattgatttaggctgctgattttgtagtaaatctaagagcttaaagtactatatacaagttattacttctttgataattactatatgacactaattaaatgtggtacaattgaagagtacagtatcttaagtcagaaaaaaaattctaagaaaaattatatggttccctaaaagccattcactctggctaggagaggagctgtgactcccaagacatattctaggaggactattaagtgctcactgcttcagaacaattcaatatcatttgcttacaattcttaaagaaactcagggacttaaactgaatagcgacatcttggttgtgaaaaaaatgctatgtaaccttcgcagtgctgggagcttgaaatgttccatattccaacaaaagccatgattttgacattgttctactgttttattgactcgttgcatttacaagttttgctaatgatacacagtctacacttactaataaattatactcacagtgtttttagtgatgtgactttgtttcaatattttataataaaagattataggagtaattacagacaatgatagaaaagtttgaggcatcgtgacaaaatagtgcaaaagcctaagttatccaaaagatgtagtgatcataattataaagactgtgtagtgtccctgggaaatgcttacaatgagataccaagcagtcaaaacggaatctaaccacgcacctgtacagtagttacaaaggtattacaaagcttgtctctgcatgaacacagtaaagaagtcacacatacacaaacgactacaatggtgttctggtattgcgactgtttgttttttctttcttttaaatattattttgctttattgttgtaatgttatttttgtaataaataaattcagagagaacatcctactattagacataggaaaatgcctagaaatcttgagatatttttccttctttatgccagtattatatttggtttacacctcagaagtaatagtgaaattggtagagacaaaatattctagtaaccaatttgctattttctgttgaatttaaaaatttaattcaatttatatttgattcaatagttgcaatagtattaattgagattttaatgtccataaaatactatttttctccaattattatttagatcattatagatgcataattgttcgtgaaatggctttgctggagctggtttttagggtaactgacaggagagagaatttccagtaatttctcttctgtttagagagacatactatttcttctacaggaaaactaacctctgactcttttaaacttcatagtttctaatgttacacactgaatgatatcattaattattataacttctgttttcaagaatagtattttgttttgccaaggggagatagaaacttctcttagaggaaacgaatctgtttaagaaacattatgaacagcagagggcagccaacttactaaatgaataagacttgttagctatgtagcttcactttgactcccacattaagaaaatatgtaacaaatggatataccaagtcctgatttatagtaatgcatctctatgatagaatatggaaaaggaagcagaatatctaccatcttgcatcataccttagaatggcagttttccatgaattatgcttttgtttatttaaatagtcaatttatagttacaatgggcaactatctagaatgcatgccaatagaaattagcagagaaaacacccaaaacaatgatagctggtaattatcgataactttggaatgcaatgaaaggcacatgtttgagcagagttgtgttaaaggaagtgttagtggcagaactagaattttctctttgctgtggttgccgtattgaatcttttaagtcatgcaataattaaatgtcctatggtgacctggaggcactgctaaggaacacagaagcctcgcaacagtcagtgacacacatacagatggtcagtcaacagatggatatacacacaaatcactaatctcagtaatttaacactttccatgtggaacatggacattcctttgagtacagcactaatattaacactcagaaactcatttaggaggtatgattatggtttactctaattgctcataaaaggcaaaagagcaaagatactgatatgcatctttctagccttggtgtgatttttttgttgttgtttcttttcattaaaaaaaaaaaaaaacccaccagcaaacctccgtttaaaactaactttgttagtcatcagtgcaagaggacgtgttcaagaaaagctacaactataaatcacaagtgatccttacttaaaagctaccaagggtgaacaactttaaaaattttagtgttttctataatttaaaagcatttaattgcttttgtggttatcgagattccactaagtattctcagtgaggcatgtgctttctatacgttgttctaaacaaaaagaagtgccagggctattttgtttttcaaattacgctcattccattttaagttttaatgacattgactaccgtgttttatatttattgtggtttcacaataaatgctatatacattattagttgggataattcttaatggtcatcagatgaaactccttaaatttttatagttaagtattgactgacaatctttattgataaagaagcttaagttcattaagggtttaagttgcatttcaactctgctacagtgttttcaatgactattttcttctgcttttatcattatgttcaagtttagttattgtaggttagggtaacattttcatatattttttttttactttatcaagcatacagaggtcctaaacaaatgctttattaatttttttttttaaatttaacattactcacctacaaacatatccaatgcaatgggatataaaggttttagtaatataatcccagcagagtttttatgattgtctcatggaaaaattaaattgtggaaatacggttctgatttgtggttcgagtcagttcaaggcaaattcctggtgactgctaagtacttttccagatcaaacattaggcccaattaattaacatttctaaatttacagtcacatgagtatttatgagcttcaaaaaagtgcgctcacttttactttccctgttaaagaacataaacgcatatgccactgattcctaaggaagatctctttgccagggtcttgggaagatttttgttcaaacagtactacccccctgccttctctgtatcccagggaatcgtggaattatgagtcactactaatagcagtgtgtcaaacccctccaagaatgttttgagacccactgggccttttgcactagaaatatataggcttcatggataaacaacagaacaaggattcagtccctcaccaactttttccactgactgcaagggtgaaacctgtgttccttcattcacttagaaattccacgaatgcatattcactgaacacctgctacaggccaggcatcgtcccaggtgttgggatacaactggtggaccagtcacagccctcgccttcaagaagctcaagatctcatgaggaacacagtgtgccatgggcacacagcagggagagcctccaacctaatgcagaggagtcaggcacattccctgggggaggtgggactgtgctgggacctggaggatgggatagaattctccatgtgaaggaagaggtggtggggagagcttttcctggtggggaggtgcagcctttacagaggcccagcaatgcgggaattgaaagttctctgtgcagctggaacctagcgaggcagggagggtgggaggagagatgaggctggagaggtcagctggagcccagtcacaggtcttctataaattatgctcagggtttcagattttgctcgaaggacagtgaagagccagagaaaattttgagctggaggttttataaagattttctaaagattgccttcgctgtggtgtggagactagactggagaggtagggaaatgaatcaggtggctgtcactgtagcccaggcacggacaattgtgggccagaagagaggagcagcagtggcacttctcctggcaggcgacactgagtccactgcaggagaggggaaaacccaagatgaccctttggaaaagtgggcagatggagaggccatgtagagattcaaaagagcaacacagaattgcccaggtgttgtgtatatttttcaaaaattgaaaatgaaaagagcaaaggaatgcttccaaggcatcttggagtcaaaagacatgagaatgcatgaataagaccttgatacccctcagcgctggccatcgctgcgacgccactctcattcagcacgcctgctcttcaacctctagcctgtattttcaacacttcagaatcttatgtaaactatatcagtacgcggccagtctctacatcaccacggcccacttggctctttttgttttctaatttatagaggcaattgaaacgaagtcaggactaatttttttaaaaagatgatgagctggtcctacactggaaaggctggccaacatgtcccatatggccagctcaaaccattctgcttaaggctggtcctctccaaaattgtttaggagggttaacatttttggttctttctatttctccataagatagccattctcacttccttccaagtttctaagttccttctacttatcttctcctgtggctgcagagacctatccacactcgaatctctgtcacactcatggctccagagtttcctgtcttacaaccagtcacatctactggtcctgtgtggtaactacttagggcctaagtttctgataaagtaaatcaagtatactttattgtaaattagccaataaataaattaatttatactgcaaaatcatcaaataagggaatcaaataactgctacttcaatgtgtttcctgctcagccacacctggagtggctgtacagcagcgaccaagtgcaccaggcatcagtatgcctgggctcaactcctagttctggctcccaccatgtgtccctggggcaaggcgagctaatgtgtgtttcagtctcttcatctgtaacatggaaatgccatgtgtctgcttaatagggctgctggaaactttacatgagataaggcataaattactaattacagcgcctggcatatagtgagtgctcaataaagatttacaatgattgctattgctattattattgctattgtaaaacgaggagtctttaaagtcttttttaacccaaagacaagagtaatgtgacaatttcaataacaatgatagggtcaatgtataaaccctaaagggagcaaagggagggttttttaggtgtgcgtctgttttaaccatataagaggctgtttactttgcacaaactcagatctagtcttgcatagatattaaatgatagacttgaagttcctcaaggtagagagtgtgtcctgttccccgctgtgcacctcacataaagcctggcatgtagctggtgctcagtcagttttactgaatgactaaataatagaaacatcgtggtgggagagcgtctaaaaccaatcctgtttcctgacaccacggctaccaaagcattccaataccattaccatgttcgttatcctaagagtctcataaattactagaaagatcattaaaattttgttatttaatttaaatctgagatatattatttcactgttttcaattttctgcaatgatgacattgtgtttcactcaattctcattctggaaatttcagagtagcatgatactcaatcacagaaactagtaaatgggttacaagtttgcaatggtgcctgcaaatcagtgattttttttttctttcagtttttcttttgtagtcctgttactctaaaagatatgagttatttaaagaaagggtaagaaggcttagacaaatatcatgtatgaattatctgatgataaggttttgaacatgcttctccagaacacaaccgcaaacacagggtttcaaagactcaatcaaggacactcatgttgggtgtggcaaggctagagtttccaattaaaccacagggctggccttggattatatatgagtgtgatttcttggagactcttgaaggagctccacaaagaaaactctctttttcctgttcactgacacctaaaattcttttaaagcaaaaatgagagtaaattgcaattgattgcaaatgttttcctagaagtaggcttggaaggagatgcagaggaactgtggagtttcaaagaaaatcctgaggacactgatttctgaggggaagcaaaggacatgcaagggagtattggggaatcaaaaccaaagaaggccaagggaagacctatgtgtgaacctgcgcttcgaggaggcaagtggttcttcttaagtgtatagatatttttgtttgcatataattaaataattggaaaaaatcctgcaaagtgaaatataatcttgatccattagaatgacaatcaatcaggaagcttgaggcttggtaacctgaggagggatttaataagaagcaattaaaacaacttgttatgaaaagggcatttggaaaattctcccttcatccaaagaaatattaaaaagccaatatggaaaacaagggatggaactgcctgggtccatgtatattggggagattaattaatgatttttctcattagcaagctatgatagcaattaagtattgcacttatgaacttttttaaaagttaaactctgattaatgattaggcacagttagagttacatgcaaatgaatcttgcatataaatatatatatgtgtgtgcatacacatgtgtatatatgtgtatgtatatacacctgcatgtgtgtgtgtatatatatatatataaatacacacacatacacacacacatacacttgtatttggtcagtaaagacaatatattagaacatgtatctttcaattctgagatgagatgtacaaatcattatacaaaataaacatgatttctaagtgattacctttgtgacaaaaattgctaatgggtctgaaattcaggtttattggggagccctgggagcccagcgagctggcatattctgtttaatgacaagtgcttactggtctttcatgctgaagaattgatgacttgccaggttcatattcaaaaatactccttggctcagaccgaaattttcttgtgtccacttttctgtctggaggatcccagtcatgcctagaaataaacaataaatcacacattaaaataatcctttttgcttaaagcaattgtgtaaaaccagttatctgttttcaacattacttttagcatagttttaaaaaaaatctctcaggataaaaagttaacctgtgaaaaataccacattcccccgccactggctccaaaagtcacatgaggggtttgtagacgcgcagagagtgagtccctgggttcctaatggcagctgtgtatatttgtgcttaaaataggtggcagtatgctctgctgaactatgagcatttaacccaccactttgtgacctttgggatccttgatccaaagtgacaaggagtaatgcacacaccatgtttgatcttatttcttgaagtgggatcatcgcttgggaagagcacagaagtgtcatgtgggttggcgtgcaccagagcaggcagtgtggaacaggaggtcgtcttttggtgtgagccttgaaaaaccagagtcaaacatctcattcatgggaaccagcacttttcccccaaggaatatcttccaagaggctgtcagaagacttacgaaggaaagcttcaaaaaagggtttcacaaaattaagcttttctaggctactgagctaaagaagaaggcttctttttttttttttttttcgagacagagtcttcctctgttgcccaggctggagtgcagtggtgtgatcacagctcgctgccatctcactcaaactcctgggctcaagccatcctctctcctcagcctcccaggggccatgatttttaggaggaaggattttctgactgtagataggggtaattctgcttccatggaatggaatgaaattcttgctccatggcccgttggaaatagaaatactctaagagacagaattagggacaagccctagctttctactaaattcatgactgatatggagcaagaccccttaaactttctcagtcttcatttttttccatttgtgtaaaacacagacagcaataatgtgttgttcttccttgcagaggagttttgagcattacatgagataatacatatgaaagccatatggaattttttaggaggttatcatatgttttaatgagatatttaattttaacaaaacatatcagatgggtaatacctttaaatcaaaacgttaattttggttattttttgatgacaaagataacaatttgtgtctagaaaactgtttctcaattttaaggcctcacataattcatcctgaggagattggtattaaaatgagacccctttcacacacgatgtgtgtgttttggtgggatgctgtgccctatatgatcatcaattactctattataaaatttttatttgttttttttttttagtgaagatgggatttcgccatgttggccaggccagtcttgaacctctggcctcaggcaatccacacaccatggcttcccaaaatgctgggactggctgggtgcagtgactcacgcctgtaatcctagcactttgggaagccaaggtgggtggatcacgaggtcaggagttaagaccatcctggccaaggtggtgaaacaccatacaaaaattagccgggcgtggtggctggtgcctgtaatcccagctacttggtaattgcttgaacccgggagtcggaggttgcagtgagacaagatcacaccattgcactccagcctgggtaacagagtgagactccatttaaaaaaaaaaaaagtgctgggactacaggcatgagccaccacgcctggcctgatcatcaattactcttaatggtacaatagggtgttgaatacaatttttctggaatgggtatgataacacttaataaccagtattaataagaaataatttttatattcttatttattaattgctaggatagcataggccttgggtttaatcagagctgagcttggaccctggcttggacataacgagctgcatgagctgagtaagttcctaccattttctaaactgcagtttcttcctctttaaaatagaaagtatctcactgggttgttctcggaatcaaatgatatgacacagaaaaagcacttagcctagtgcttggcttgtaatgagcgctcaatgaaggttacctataagtagaagtattagtcataatcccagtaaaaataacacaataaaaaagtgtttataaatttttattttcatgtagatagtttgtataaaaatatttcagtggagaaaggaaaactcgtattagcttgaaaaactggtagaaacaagtcacagacacttattaactaatgcctcattatgatttttgaataactttccctgctttcaaaaatgtctcttattaatagacctggggaaacagaaaatgaactgcatagcctgtaacctggtatgccaaaggaagtacatgtccattatttctatttacttgtctcttatatgtatgtattgatcaaaaagcagaaaatgtgtccatattacttcaagtctaatttagggcactccagtatcatgaaagaagacagggaaaacatttgctacaatcccagcagaggaggtcaatatggtatatgtatagactagcaagattacacatccgctctctctgtggcaggtgcactgattcttctactgaatgccatgtagacttatttttatcctaagcgaaacataggccaccctggggggaaatgccttacttttctgttgaagaccgatctcttggtcgaagcggcgggactggaggtggaacatgtgggggaggcactggggaggacgcatccttaaaggcattggggctgttgtcggagtggcttttggaaagaggtctgtaggtttgggtctttgcagcagggtgtgactgagcactgtagggtgggttgtacagacctatcatgacaaaaaacaaaagcagacaaaaaacagaagcaaatcacctcttaaaaatgaattaaattatttgtccccctcaaaatagccaatgattgcatagaaattattatcaataagcatattcataatgcatacattagaaggtagtttcttaatttattaatattaatgtactaatttccattaatttattaattacaaatttattctgtacctaagccctgattacagtaaatctttgtcaattatttcagaactagtaataattcagactggtactaggaatagacttataagcactcagcaaattttctcttcaattgtatacactaagaaaatagttcagttttcagagcaagattaaaaacggaactgtttccaaatatcttctaatactttaaaaaccctgatttacatatgaaaattgacatgctaattgtagtcaaacaaaatattgcacacagttgtgtttataaagtgctgtgcaaggtacaaggaaacatgagtcctcaatatgcttagagtgcacctgggaaaatcagacacaaatagaattatgatggaaaataattggtaaaagataataaagaccaaatgaagaaaacacatagtaagaattaaaggatgctagtaggtggtagattgctcagagaaggtattatggaacccacgagtccagagtcagccctgaatgagtttcggtgagcagggcaagaggggagcagggatggtatagaaaaaaaggcagaaaagtgcaaggtgtgaagccatggcttgcacggttagtagagagcaaagagactagctgcagttgactcgtccactgatcaaatgatcagcttgtagggctgtacaaagtaatatatcactgctgttccattcactaatcactaatgtgacacaaacctcaatattaaaacagttataaaaattctaaattttcctgcacccaatcattggagctaattctatttgtacccgttcgcttctcctgaaagtccatgcacatttccacagcaaatgaaaagagacaacatctacacttacagttttgcttggattcaacagtcggacttcaacttttgagctaaataaaggaggtgagtttggtgggcgtgggagcagggatgaaattaagggaaacatctttgtgggcctgaagctatcagtggggcgagccaagacttaaacccagagggcttgctgagtttgttctactgattttccctctatcaatttgtctttggagataggagcacaatcccaaatagttaaagggcctgaatgtggtctccaggggtgcagaacaggaggatcatgcgaccccaggctgcccagaggaccccaagtgaggttgcagctgctgaaggggaggggagcagtgccagcctccgagcctggtctaaagaaagaagaaaaaaaatagttgtgcacctgtcctgagcctgtgactgggcagggagaggagccctgggcagaatcccgaggcaacactcaggagaaagtgatgaagggaaaaacatttgtcaggggtccctccttccagcctgcagacccctgcacgagataccaaggctcgccaatccaagtggcagtgcctggaactgaagccattctattgtgaccactggcaattctgagtcagaaaagtggccccgccaagggggatttttaaactctttcaatgaatggttgcattttggagcaaaaggcagggacaaggtcacagaatactttgtttgacttgtttttggtgaagtgtatctgaaagatcttacacaattgtaatcattctctctgctgataaaagatctttatcttattttgtaccctgggttacagtgtgtcctttcagcctatccttcacactttggttaaacattcctgaagctgagaataaaccaacagtgggaatgaatgagataaaccagtattagttctcatttccatgagaaaagtcaatccttttgttatgcacgctctgagaaaagaaaagaaatcctcctcctaatatatgaactgaaaacatgtgctcaaacagaaggggaaaaaaggtgaccgtgtcgttcttccaaacattgctgagcataaaatagtcattgcgagcaaggaaacccatcctacctgcattgtatgtataaggagtattatacatgtctgtgtcatcatctagaaaatgaaacataaatattatggtaatatagattgtcaccaaaggacaacgagacagcagaacttcagacaaacaacagaaatttgttagaaaagcaacgtatttttcctagttcataatgccattttctttctttttttctttttttttaagagacagggttttaccctgtcgtccagtctggagtgcagtggtgatcattgcttactgcagcctccaaacctccaacccctgggctcaaatcattctcccacattagccttctgagtagctgggattacaggtgtgtgccaccacaggcctctgcaaactgcccttttttatctgtaacatattcgtcttgctgccctcttcgtagcatgcaaagtcaggcccttgtcctcgcttccccagaaacctctctgctctggatcgcaaatttcctttactaagtgctttagtggtctcctgtctacagagcaggctcaggcagacccgcgcaggctcactctcctgatgagagcagacaggggtggacagaggaacaatgtgtttttcacccaggcaacacaccaatttagactgtggacaggggaggatggagggctgaggccagagtgcctggttgtcctccatggggaggcttcttggcagctcaggtgggaggcagaggcacagggatctgtcaccggaggggtgacagaaggagaacaggaggcatgctgaaaagaaaggggacacggagtttgctggggtcttgacattgtgtgtgaatcaaaccgatgcaaaagacgaatgtagtcccttcaacccacaaggacctcatcagaaagcagagcagcagacatacccggcttgtgcaccatgtgaatttgcttaaacatcgtcttgtaccagtccttgggccggtcgactgtctgtaatgaagagagcgtccaatggttacaaactggcttccaatcaacatcgcttctcagtgttttcatttctctattttatgttcttaataacagagtcccattctgtgataaaatgttctgactctttgctatggcttcatgacagtttcagcaatttacttagttatgtgtgcagtttgtaaacatatggccttgtgtttgaatttaggctgagttggaacattagatgctatggttttattttttcaagttatagctgtaccctgcactagagagttgatatttgcacaaatatataaagttcacttaatgtaagttattgttgtactaatttgtttaactccttttggtagataatgatcattatccttagatgctttttattgaatgttctgtaagacagtgttttcagaattaactggggaatatttttgactcaaattgtattctgatcagtgtggctctagagaaataaatttgctatttactagtctaagctactaaaatactgaatgtagtaggcatcccagagtcctacggaaaatttaagaatgtagatattgcttcaaaaatgctaatatgataacagagtgtatacaacatttgctcggctaaaattgtaggttccttgagagtagaagtccttacggatccaggcgtcggacatgaggggagcagtaggctgtagtggaaagatgaaattaatgtagagtcttgaactaagattcaaatcttggttccttaaattgctgcttaatacaccctagcaatacgaatctgggcaagtcatgtcaccttcttgagcctcagttttctcctctctaaagtgacataattatatctaaatcataggattgttatggaaatcgaatgagacaatgtatacacaagacctagaacaatgcctagaatataacaactactcaataaataataacactagggaactgcaaatatttgtagaatgaaataatgaatgaacgtagcctattggatagagctctgcctttctggatacctgtaaaagtagacacatgcttttataatcgtactcacagattttgcttggcaagatcttaccccaactctctgagagctacctgggcaacaggcttgatgattctgcttatagtaactaaacacaccagacgttccaagacagatctcgatttaaaaacttctgttaggactgatacgaaagcattcttatacttactagactgagctttgggttagattttattgcctgatctttttttccccagaaatgtggtcactgcatttttcctctggacattaagggttttgtgctatatctaaatttattttgacctctgagaatatattattctgaaaaatcaccccaaatacaggttaacatgaagggccacttgacttcgttatgagtcagctcttcattctcggctctttctccatggaagagttgaggttattgattgactattcagtcaaaggacgggacatggtggaagggattgcagtggtgaagcaaaggtctattatttgctggttcaaagttgctaaacatgtatctttcaagaaagtttatttttataaaggactgatttctctttcattaaacctcatttcttttactgtaccaaagcaacagaaaatacaacatagtgttgtgcaaaaatgttttcctggacgtgctgatggcaacaaggaagcctactaagtaagtcctatcactgtatatggcaatacatgttgacagacaggtttttttttcttcacttgctggagggcctatatcaggtaggatctcacagtgatgccatctgctagctttatatggtgagcacaaagatgccagaaaatgccctgctggcaaagggaaatatgaagctggaaaaataaaatacgaaaactctatgtccctttctaaaagaagtactctaagcatttaaagttccttttgtaaatgccatcatggagatcgctatgcctaaggctgagaataagaaaatagtctactcaaatttcaggaagtttacttttgtacgtaaaatcattttgcatgaaaaatagctactagcaattcactatgccgttttttctacaaccttgactaaatagacctgaatttttacattcctacagttttcaaaacatcagaactctacactgatttaacacgcagagatttcaaaaaagataaaaaaggacatattttctacatagcagtatacagtgactctgttctatttttttctccttttcagttttgaaaatactcaaacaagtgttatattggaagtagaagaaaagaatcttgtatttcacttaactagctggccttaatgacacaatctcatgggagctgagccctggcgatttttgttgttttgaagaacagcactgaaaggttcacatagatgtcccaggtcacatgagagagggcaatctggagagctgattccctgcattaaaatagctcaaaagtactgtttgttgactcttggctttctagagtttctggatgactttacaaaattctgtttcctcggcataggctggctgtctaaaacgatactgcagcatggtacattgtgacagtaccgcctttggcaaatacactgaatctgatcatcattactttctacacatgagaaagaaaaacaaccttggagagtcttggcctgctgtggctcagagacagcctgacttgacatttataaccacagctatacatggggatgtactctggagggctgtatagtcagtgtaagaggagagtcctcatagacctggaccttctttgtcaagttttaaaggtccaagtaagacaacaattgtgcataaaaattacagttccttataaggaacttctgcattggttatattgtgttttctattttatagaagggaaactggcattaaatgtttagtgtgtttgcttatgcatacccaaacgtgcttttgatttggcagttgataaacattttaaaaattttaagatgatttaattttcatcaaccatctctagcatctcagtttttccttttgaaactaaccaggcaaagtctggttagttaaggaaattatgtcttataaaggaagaaaacatggaccaggcttgcatgtccattatatatcatttattgacctaaaaacatacccagatatctttgataaaatcctctcagacagaatctataactacatagaatcagggctttcttaattttgtctatactatgcctcaagtgccagttacacaaaaccaatgacaccatttctgtctgactgtctatccctatataattagaagaaagtttcaaatttaaccattttgagtcagaaatcttagaagggaaatgaacaagaaaacatcatcaccagaaacatgtaatcatcataaaatgaagaatattggtcataatccctgaacttttctttggcacataaatatggcaatcgtcagtttcaagacagattgttagaatgtcatatcacattcaacgtttcctcaatctaaagagtctaaaaccccagtaactgctgtacagatttactttttggctttcaattgtaatatagatgctgagaataatccattttaaactcttctgtctgtatataaaacacataatccccatataagaatgtaaagtcaaggagagaagaaaatccccacactttatcgttagttctttttgactgtttccaatcttaccacggctttttttttttttttcctgctctctttcccattctttgcctctatcccttattgtcttggctgcccaggtctgcattccaggggagcagctcttggccacaccccagctttacatgggtcttgctgcaaagtatatgcagctgcagtccctccccgcatggcccccaacttcacctgcaaaggtgttgttgctttcatcctgtccccggcttccttctcccggctggcacaagccttctcttccagtggacttggtcagccagctgctgcctgcccaggctctcagaagctgcctctgctactgctgcgttttgccggaaggggctgcccagatacactgagcaatgctttggcagagttttaaaacttaaaaaaaaatccaaacactttcacttatcatcccaggagagctctcagcaggcacggctgaagagggacattaaaatgtgtatttttcttcagacagcttttcctttccatgacattaactctcttcactccaatcatctcacctcccaactcccaaatcacagcttccaatctcccggtgttaacacacatctatttcaaaaaacgaacacatcactgctttattcgcaatgcatgtgggaattcaatgcagccaaagaatttccattgtcttgttccttctcttttctctctattgccctaagcctccttggtaaaaggtaaaagaaaaacaaacaaacaaacaaactaaaccacacaacacagttttaccatttaacaaaatcgcaatgttcatgatgtttcattcaaatggaaaaacagattgtgtaattctctcccatcaacagctttctttctctgccacacacagcataacattcatgagaagtcggatggcacggagggcaatcctccttatataagaccctaggaatgcacaaagccgtggacaatccgtcctttgtggagtctgtgcacagccccagacagacgcacacgctggcatttcctaccgttctaattgctgtggggattccggattcatccacgggcccgatccctgggtaatgcggggctttgatgactgtcactctcttctcttcctctgaggatcggtacagggggatagagctgctggtggtgccatccagagactgcgcatgctggggatatgtgtctgtggaatctgcacagaaaatttggtaacatggaacgtattcgttgcacagggaatcataaattcatgtgtcttgttgtatatttatgccaactgtaacacagagaccatattgccatcactgtcccttttaactcatttactttccatctgagctggtggaaactgtgtaggtgtgcggggaacagacctataccaacaagggcctcaccattttatgaagaaggctgagggaagaatggcatttgttaaatgactgtgtggaggcctctgagttaggaagtgctctaaatgcattatctcttcttatccttccagtaatctttgagggagggcaggatagggggagcaagaaccagtgttatagataaggggcaggagctgagacaagttcagtaatttccctcaggtcatcatttacatcaatattattcttgtgatactgctactactattatttataggttttgaaatgtatttccagacaaagacatgactgttgagtcagtaacagtgatttcataaaaatgaagcaaaaccaaaaatcacttaaaaaaatcttcacatccaagcctttggacatgaaagcttctgaataaataaatgctgtaaaattattagtacgatttcctatgtgcatttttaccttaaaatatcaaaaactatgactttttactctttgatgacaaaaactgccctaaggatataatttagatgaggcttatcgagttcttcatgttttttagtaacttctagaatactttcagaagcaacagagtacagacatgcagtatatagtccatttacttctaatacacaggaattttaaaaaaatcatcattattaccgttcctctggtatgattaataatatgcctttatatttttctgcaattaatttgaaaatgttggtgacaaagaatgacactttgtatatactctttatatcatggtttgtcaggactgccactcagaaagtcctttaaggtggaaatgaaaaaaattctcatgtttcagggtgggactcattgatatcattatgtgtatatgatatatatcatgtataaatgtatttttcatgaaaaatttgtataaaataagtaagctttttttttttttttttgagatggagtctcgctctgtcacccagctggagtgcagtggtgtggtctcaacctcagcctcctgggttcaagcgattctcctgcctcagcctccagagtagctgggactacaggtgcgtgccaccatgcctgtacaaaaaatttttgtacaaaatacaaacaattttttgtatttttagtagagacggggtttcaccatgctagctaggatggtcctgatctcctgacctcatgatccgcccgcctcggcctcccaaagtgctgggattacaggcgtgagccaccgtggccggccataaggaagctttttaagaaattttaactcatcaatataagggtaattaaaattcagatctctctgaggtaaaatccattgtaacatttgtaactgctattactatgattatgactattttcaatttagtttgcatcagaaagtcatttttaatacattttttgatgaagaatggataaggctagttataaaactgctttatgtgcagtttatgtgctggatggtgacataaaatgtccctgaataaacgaacagcatcatagcctttcaacactgaatcagtgctggggaaggaggtgtgctggctgctgtcaaagaagacatggtggttgaagtcccgggttgtagtttctttccccctgctactggccccttgaatgtgaaaataacattcaagctagtccttatttttacttctttattttttttgagacggagtcttgctcagtcacccaggctggagtgcagtggcgcgatctcggctcactgcaagctccacctcctgggttcacgccgttctcctgcctcagcctcccgagtagctgggactacaggtgcccgccatcacgcccagctaatttttttttttgtatttttagtagagacggggtttcaccatgttggccagactggcctcgatctcctgacctcgtgatccacccgcctcggccttccaaagtgctgggattacaggcgtgagccaccgcgcccggctaagctagtccttattaagacacggtgagatatttgacactaattgactttctatttaattccaaaaaggacttgagtgggcctccatgatactagtatttttattagcgacgaatgttttttgaacaccagcatgtgcaaagtcctactctaagcaaggagaatcaactctgccttcacatctgatccattacattctatgaacccataccttatgcaatataagttaaccctttattttattattctcatatatggtccactagctgtcatcttagcaatcttttgtcctaaactaagtgtaaaattcatctagggcaaggtagatgtacatattcctccgaaaccttatcacagcactggccagctggaatttgttcagtgtttacattgggaatttcttcccatgcagaatattttatatgtaaaatctacttatcaatatattctaaaatcaaagcctatctacattcaagtatttttgttgttgttgttgggtggggatagggacaaaactgcattcactaagacaggcaatgagacagagtcaggctttgttaataattatttgggaaaaagctgtggctagaataatttgtcgagttttactttatatgtgtgtaaatgcatagttccattttaaacaatctagatataatggacttccattataacaccacactatgggctgattgttaaagggcaaaatttcggcataaaccagttttactttcttaactctaaaaggacatcattgtaggattcacagatgatcctcaggcatagcatcagcgaaggcacagatatatttagactttaataagtcccgcggctacctttaaagttttatagttatagagctttggttgacctcagaagctgagttccaccatgcacatgctggatggtgacataaaacatccctgaataaacgaacagcatcatagcctctcaatactgaatcagtgctggggaaggaggtgcactgtctgtgtcaaagaagacatggtggttcaagtcctgggttttagtttctttccccctgttgctggcccctgtggccagaggaccaggcctctccttttctgggaggtgcaggatggtgctgctgtcctgagaattcccctctgctccctgctgtcctagaagcttcctagtgagtcgacatcatggaaacttgtacagcctgaattcctatgatagttcaatttcgtattttttttgatattttaggtttttaagttacatttttacaaactaagaaatatttatgggccgggcacggtggctcatgcctgtaatcccagcacttagggaggtcgaggcaggtggatcacctgaggtcaggagttcgagaccaacctggccaacatggtgaaaccccctgtctgtactaaaaatacaaaattagctgggtgcggtggcgggcacctgtaatcccagctactcaggaggctgaggcaggagcatcactggaacccaggaggcagaggttgcagtgagccgagatcgccccattgcactccagcctgggcgacagagtgagactccatcttgaaaaaaaaaaaaaaagtatttatcacattattttctgaactatctgaacatacttgaccatgtaagagcatttctatcactgtacagcaaagcttctttcacaggaggccacaaaaagtccatgagccccaggaaattatctgcttacaattttttatgaacgtccgtatgtccatttgttttctggaggagagctctatctttcactgaattcctagtcctcagagggttgagaacgattgctctatacaatgacagaaccttcatttaagggaacacttaagtttctcttgtgtggcttcctgctaccatatccctgactgcaggtcttccagccttggtttgaatggtggttttctccttgtgtgagccagtagatgactgcgtccctgctatgtgggacagcctgtcctcctgttacactgttttaactgtcaaacgattctcccttatatagaccccaggaaatagtccatggtggaagctcttccaagtccgaacaagctgccctagtggaaaacctgcattcatgtcctccagtggcacaaacccccttgccctaagtagccattttctttttctttctactccaccacctcagacatctaagtgcccacaccaggctcagacacaggtggagacatggtcttggaatagcatggtgcccatttcctcccatgttgggtcctctgccccagtttctccctggggatagggtcatgagtgctgagcgctcccgcctcaccttgatgccgcatatctttctcctgtggttgtacttgccgcattgaggttgccatggaaatcacggtgagtaaattacttaccgagggatgtgccgtgctgcatgacaatgctggagttgagtgaggctgggagagaatatgccgagggggaaaacggcctctgatagtaactcatgggactcacggcacctcctgagtttccattcactgttatctggctctgagaaaagcgcaaaggcatcgagttaaattagcacatagttccctgtaaacatcattccattaggtgataataaaagacttccaatcacatgagagtaatcagctgccaagctcttatttattttgaaaactgatgtcagagggcatgctacattctttgccttctctctattcccttatttctgaaaatcactctcttgtgtatctgagggtccagggagtggttaggaagaatgaaagtggctgactagtgggcatgccactctgccaacagaggtgccaaatggtatcagtaggagtcagtaccaagtaaatgtggaggacgactttgctctgacagtcgtaacatcagcaatcagaacacggtggtgctgttccgcatgcagcattgacgtggatgtcctttgacatgaggcaagggattggttctcagacttagtcagggatatcttctagtgaatgaatgtttccagagctggtgaataacataaggaacctagttgtttggatgtatatatcatgaagcaacctattctagaaggatcaaatacctggtaaaggatcagagagacatgttcaaccactggcttctccctacttcagcctcattgagcacttcatgaatctctgtttgatttcttaattattcattgtttcgattgttccgtatctgactattttatatccccaatggtatctcaagcttcttgttgaagatggtcatatatatgcttctttaatattttgtataacatgcagcctagtgctgatgacagagtagatgttcaataggtatctattctgatggaactgaatcggcttagttcacagatatcgagctcaggactattaagcatgcctgtctacccacagcacagtactgatcattacagggcgcacacaatgcatgcaaataagatcaaacattagtaagaacgtttagttaaaattatagctaaatacacacaacacacataggcacacagataaagaagcataatttgtgaaacttttctacttattttaaaacaaaacaaacttctattccacaggcttgaaacatagatatagtaactgtgtatttctatgatttcactttaaagcaaatgggttttcaaatgacctagaataagtctaatttcattactgtataaccataccacttatgtccccaaatcaataaacatttcattacaagccttgtgcttattgattaaataattctctaagctgttagaaaaattacactcatatcataaccagccacatcttgaggacctgctccctggagagagctggacgttcaaataactgtgaggcacaggcctgcccaaatcttcagagcttttatgtacctctgatggatgatttgagaacactttcacctccttgcccaagttaagtttggtggatctttgtcaatatcattgtaatactattataacatgttataattaatgttaaaagctgaagaatccttcttattaaaaaccatcaggttaactatattgctaaacctacaaacttgctctgaatcctattttgatggtttcaataatattgactaggggttaaaaaagtaaacactgagagtagatttattcttttttttttttttttttttttttgagatggagtctcgctctgtcgcccaggctggagtgcagtggcgcagtctcggctcactgcaagctccgcctcccgggttcatgtcattctcctgcctcagcctcccgagtagttgggactacaggcgcccaccaccacgcccggctaattttttgtatttttagtagagacggggtttcaccatgttagccaggatggtctcgatctcctgacctcgtgatccacccacctcggcctcccaaagtgctgggattacaggcgtgagccaccgcgcccggcctagatttattcttttattgtgttcaaccaatcaggattttatgactaaaatactatcattagcattttagaaaatactgtattgttatagtgaattcattattaggaaaaacatgtcatgaataatctatttgcaattttaaactgataattgcaattaatttcccttacaagtagctctgctcgtgcccacaagactgtatataagacagttagtctcctgtaaagtcttaaaaacagaaaattgaacaggttagttggtagattgataccctctcactgccttctttttttggttaaaggtcctggtaaagttttaaaagctaagaaccattgaagcacagtagggcatgggaggaacccacacctgctgtgctcctggtgcccgtagttgggctggtcctctgtggcagggagggactcgctatggggttaggcctggaaaatgaggctccttctgtagccagtctctgaatggagcatttgaatgcaaagtgttagacacagccattgggggaataccaaatcccattaccaaaaaaagcatcttttactttatgtaaattgtagtgtcttaaaaaacatatggcttattataacatttctctgcgcataaaatttgcagacttatcagcttgatagaacataaaacaatgtagcacaaataaaattttgtctatgacagtgcttattcggaacttcattataatatcaatttaaaaaaaaaatctgatttttttgcctgaagctatgtgtctcttaaatggaagccattacttagacattatatgcaatatagaatctgtgccataaaattttgaaacattttagccattcacagatcatttattagggattgcttatcacatagatatatttaaataatatatgtatggaaaagatgtatatattgctataaatgaaagacaaattattgataaacaaaataaaaaatgtattcataaatttctgtcctgaaatggctcaggaagaataatttttaaaaatcgtacagctaaatttctgaaaggtagataggattatcgacatcattcactcctggacaatagatgagttcaaaagttgtagctgttagagaaggaggaacaagaaaaattagcctcatgcagtcagtaatcatttatgtgagaaaaaggatatagaaaagagtcacacaggacacattaatgtgagtctgtgagaaaaactgctaacatgtattaatactgggttaaaattttttgaaaaattttagactttatgatcacaacatattgtgatgtatacttagctaataaggcaaatcactgtagaacttaccagctacagtaacacgggaaaccgtaagtaactattttagagtaactataagtaattctaaaatgaatgaagagaatgaagtgactttttcagccttaagcaagcttataggatgactaatgatttccctgacagatggcatagaattggtttgggaatcaacacctatgtaaataaaaatgtcagccgaaaaatgagatggcacaacaaatcagtcctttcaaggaaacggtggaggcaaagaaaggcagaataattacatgagtggccgcaggggtggttaaggtggtgccatctgtcacagcagacctctgaccccaggtgggggagggtgtctcagaacggccagtggtgtcagagtcaccaatctgcagctcctccagcatggctgtggaggactcactctccgagcgggaggagtgctcggccagggaggagtctgttgtcagagagcctgtgtcgtggctgtggatgaggctttctggagctgggagcaggtgtttgtataagcaatgggaaaggctctggggattatgcaggcgtgaagaccccacaccatcggggggcggaaggctgagtgatgctgagctggtgccactgcctggtgagaaagtggctcggttcaaaggtaccacggaaggagggcacggaggagaagcttctggtgtggtttgtctgtgtgtctgtgaagcatttacctccaacacactggcaggtaagttctgatttccaagctgagtatgaggaaaaaataataagagataaattatccaattaacaaaagtacctctttttgcgatgtggcagagaaggcaaagcatcggttttatttgcaagcactttaaggagttacattcagatgggttaggtgccaaccacacagtgcagaaaaagtgtgaaaacaggaagaaagtgaatccagtcggtgtgttttgaaacaaggccggttttcacacagcactgcaatgtaattctggttaggggcttgagagtgttggcataacgaaactgtttcctcaggagttttagtttttgtatttgtgacaatgataagatatcagactatcggtcagcagaattggtttgtccttcactagaaaaatctaatagcataattgcctcccccttgccaaaatgtccccaaaacataaatctgtttgtcttattttttcctggtttatgaatctaaacactgataatactaaacacaactaagcagaaaagataaatggaaaagatgttttatttcctttccactaattaaatctgttctttgatttcactacaaaatacgaaaagaattggactttaaaatatcctagcaatgcaaatagaggtaccatgtgtgaaaatgaaaaccagccactgataatagttagaatgtaccctagttagttagaactatggttggcactaaatcttaggtaaaggagaaagaaactgaaggaaaaataaaagatttaacagctccaaggctatatatagcccaagaggctaaacatagcgaagggatgctctgtaggaggaagagagaagatgaccatttgaaattttacaaccacctgtggtagcctggatgacgtttgaccacacgtgacaaataggatgataagtactcaattcaacgtaagtgaataaaactccgaagcaacttttcttacttattttttctacctttcagaacagacactttttggaggggatgtttgggagaggaaatggttttaagatagatggccagaggtattgtgagatattagtacaaagatgggaatgaatgaaggagaactgtttacacttagaaatactgcctagtaaatgtttaagttaaacaatttggtgttctttggcagccataattttcataatgactgatgtcatgcacgttgttagcataataaaaaggttgcaataatttttttctcagacttttacttgaatacttttaaaaaatccatcatataaaaaggtctctctgaatcatagatcccttagaaatctgataaatgtgactgatccttcttttggggaaatgcacaaattcatacatacagaaagttctgcataaacttcagggggacagagacactctaaagcataaccttaatctaatgggttaagaaaccccaaccttggataaaaagacagattttcttgtcctaatcttacttaatatgattttttttcttgtttaaacatagtcattttaaatgtgatatatatatatatatatacgtatatatataatatatattttactgttcatggttgtttaaatctctagaaataactgacagaaatcttagttacccagaacttaaaatgttttggtggggatgcatccttattattactgagtgtttacaataattgcaatcttattggaggtgaaactttaatattatgaaattatcataattctaacttaatgtattaaaatgttgctataagtctgaatgtaattcagtataaagcagtctttggatagcgtcaatgaaatttcccctaataattcagctttactaaggatgtttccatgtaatacgaatctctttttagttttatttatgctaaatgaaaactatgaaataatacaaatcatacaaaaggatttgagttatctgctcatgagacttttccctttcaaattaaaagaaaaaaatctaatgactttaacccccattggactgacttgtccatatcctatgacttgaaacatgtcaaaagctaaagcgtattctaaaatcaccattgtcacgggtaatatgatcattagtttgcatagcactgtgtctggggatggtccttacccattcaattgttcttccaaatagaatgtccacagaaaacaaaattattccacctttcgaatttctttcaccacctcctgacatgctcctggttttgagtcttttaatgcacgtgtgtgtatgggtgtgtatgtgcgtgtgtgtgtttgtgagtgtaaggcatgaaatgcctcgtggtgagtcacatcacacttaaatttctacagataaaactcaataattcaacagttatactggtcacccacaaaaaagctttgacaagaccccaatcttcacatgaatggaatataccctgtagacccaaggggaaagaaagaccatgttacacgtgtttctcctgaggaaaatcagaagagcagcaggaaaggtatgaaaggggaagaaggcagtattttcccaatctggactacctcaaaaatagggaaaactggctttaaacaagtgtatttttttcttacttcatgagtggcaagtagatgactgcaggtaatcatcctaattgttttaggtctccttcttttcaagaccatggaaggctaaggtgtttgaatagggatcaagggtcaccaactttttgtgagtataaattgttttttctttccccaacccttgagctagcaggaagagggtaatgagaaacaccagctagcagccaggggctgcctggtcttctgcaaaggacagggacggtgcttaaaccttaatatgcttcatataccaagagagagcacctgcttactcaaactagcactgagcttcttcgtccaaatgactccaacccagaatgctaaagagagcctgtggatgagagtgctcaccaatcaacactggagctcctgaggaatgaaggggcacagagattcaagggagggtgagcttcagcagtggaaaaagtgtattgagttggatgaaggcattgcaaactcaagtgcccatcatgggtcaggaaagtatccaggatgtgcaaatcaagcccgtgttggatgacagggaatgatgggaccgatggcagaatgcggaagtcatgttccccctcaaggcgggcgtcattgacccatatcctttgccttgaaacacgatgaaaattaaagcttactgtctctaagaccaccatagtcatgggtaatatgacctttagttcgctcataagctcagtgacaacacatctatagtcataagcccctaagctgtcacttgctgacacagcagatgtggaagctggaggtggaagagggtagctgtggagcggggatgtgaagaaggagtgcatggccaggcctcaggagaggaggggaaagtgctcgttggggtgcaaaacttaaagagtgacaaaaaactcagtaattgagataaattctgtttcaatgcaatctttgaaagaaaatcaacatcaatgcaaaaaagcaaaaataccccatactgaacaaaaatgtcgaaaatataaatgaagaccagcgcatgccaagccataggaaaagagagtctgggtctggcgtttttaatgcaagaaaactcatcaataatattttcaaaatctacatttttgcttatttcagttttagttgagagaatagacatgtttgacaatttccaattaactgatggccatcttaaataatttgtaattaatttaaggtgaagtaaacatgtaatagggcaagcgcagtggctcacacctgtaatcccagcactttgggaggctgaggcgggcagatcacctgaggtcaggagttctagaccagcctggacaacatggtgaaaccccgtctctactaaaaatacaaaaattagccaggcgtgatggcaggtgcctgtaatcccagctactctggaggctgaggcaggagaattgcttgaacctgggaggtggaggttgcagtgggccgagatcacaccactgcactccagcctgggtgacagagcaagactctgtctcaaatttaaaaaaaaaaggtttattttgctttaaataaaatatttaagcttaaaataatgtgtgagtgttaataacgtgcgtttcaacttttcaaaaaaattctaatgacttaaacattctaggaaaaagctcattcccaatatatgaaaacaggtataaggaagcacagaatttccttccacctcaggttccagttggcttgacatggccctgaggtcaaggatcctaacatctctctcttaacacctttagtcattgagcttctaggcctcatttctcaaggaacataaggaatatatattaaatgtcaagcaaagaaatctgacaggcttttgttctcttttttccaatgatagtaatttacttgaaaagaaaatatctaggaaggggtttttttttttttggagtcttgctctcgacctccaaaagtgctgggattacaggcatgagccactgtgcccggctggaaggggttttaaaaaaaccaatctttacctcccatccacacatcctttagggaaaatgtgccccctcttttcatggcctgtcctggtggtatgaggagacctgcctggcagctgtgtctgttgccggatcatcattttgctggccacagctgattaggaagggggagtaactggactatgctgggccagtggggccctgcctccctcctgggaatttgaattacgtgacactgaatgcccctcaggtagctgtcgggtacccaaatgcaaggagtcagagagtatcatggaaacccatgggcaacttgaagtaacgacagagcagaaactaagagacagacagggaactatgcagttcctacgactgagaaggatggagggtagctgcctggccattgccccgtttccctaaggcctggctgtattgcctgcattgtaatgatgtgagattgtctgacagcctcataataaaaattattttaaccatatactccccacccaagagctgggtgacaagtgatctaaaattgtcacacagattgggcacactgacagcatgtggcatctgaatcaggggagtaaatatttctactgtactctgtggtattcagatcgggaatatggttttgcatctgggaaagtgtcatattttaagaacattatcaaaatatgggatttaaaaatcagcttgtgtgagagcatagaggtagcagaggctagtggctgagctgtggatcttgagtcagacagacttgggcaacttgtttaatttccttggcctcagttccttcatgtgtaaaatataggcatggataaaacccatctcttaaagcctgtaaaaattaagtagggcaatgtaaagtgcttagcacagtgcctggtgtgctgtaatagctctcaaaaaaaggagaatcatgttttacaaaattaaaatgctgggaaggaacaggaatgctctgcacaaagccagtagcagggtagggaagagaaggatcacgtgaacactgtcagatagaggcggaagaacattctgtctcttttgctctgtggataaccatgcagaagttaaggaaggcagatcatgacgtggtattagaaattctttccaataattcgatctcagaaatggccaagcactggactgctgccttggaatgtaactgagctcttcattaagtgtattcagaaaaggctggatgcccatctattgggagatgttgaagaggacgttttatttgtaaactcatgttggactcccaagtattctctaatgttcaattatttaaatacatgcatatgcatgcgcatgcacagacatcaaatggagaaattgccaaagacctgatcaactaatagcattacgagcccacagaaaggaagccatactaatggaagacatcaatgattggggccggtcttgatagcaatgttccagaaagtgcgttctgcagttctgcacctattatcccacactgctgacatgtctgcattactctgtcctccttagtatctacatactgatcccatggagcaaaagaaatgagtttcctctcccttctacatgacagtcgggcaagttcccctgtgagtccccagcatatgtgcagtggcagctgtgaaggtgaggctttggcaaatgattgattatgttatttcataacggacaggacaagcttatcttcctgaagcaaggaacatagcacagatgccatagaaactgtttgggggtgtagctttttgctggctttccaaagtgtctggcttataccttcacttacttgacattgagaacaatgtgacatttttagcaacaggatatctgatcacacagtgccataaggataacatgcctcatttctggtctgtttgtaggaggtcaattaaagcacatgccgtttagaaaacactatgaaaaattgtcaaatatgaagagaatttctaacagtgacctgtagttttcttcttaaattaatgagcagacattaataataacaaaactatgtaaataaaacttctgaaacactgaaatgtacttttcacatcttggtgtacttttatcgcttggacctgctaattcctgggagcctaattctttataatggagcacatatttggctgactcacagggtatagcttacagtgcttggcattggctgagacttgccagaatgcggagtgcaagtgtttaaaatggaaaggtcaccattgtgaaaggtcattacatggaaaatgagacttaaaaatgaagcatatcacaatcatcaagatgtagaaacaaaccaaatgtccattgatggacaaatagataaagacaacgtggtgtatacgcatactaggatactattcagccttaaaaaagatggatgtcctgccacatgctgtaacatggagcaatctggaggaccttataccaagtgaaggcctgtctcagaaggacaaatatctgagcagagagtagactggtggttgccaggcgcttggggaagggggatatgagttgctattcggtgggcataaagttttagttatgcaagatgaataaatcctagagatctgctgcactgcatggtgcctacagttaacaatactgcattgcacacttacaaatttgttaagaaggcagatctcatgttaaatgttcttaccaaaattttaaacagagaataaaaactgcaacagcttcatgctaccttttttaaaaagccttagaaaagaggacacgctatcttggaacaaactgaaagtctgttgaaataaacttttacctaccagtaaaaaaaatgaagtattgttgaaaataatatatttctttttcccaatcagatgcataatttggaaaaatattatttaatgatgatgacagctactgtatgttgaagaattaccatgaagcaggcaccatgccaagatccttatatgccttactcaaacctcccagcagttctatgaatggttgctatcattgtccctgttttatagatgagaaaactgctgctcggggagggtgaataactagatgaatggttttatgttaataagatcttgaaacagctgactgcccaaccactttcttcccagtctctctcatacccactccaagaaagcctccttccccactatggaatcaatggtaagttttcagatttcatttcaaacctgtctcatcaacagcatttgtgcggtgaaccatccctttctttccacacattttcctcacatggcttttaggatgccacattttcccagatttcctcctcccttagaggacactgctttcagtctcctccactgcttcttcctcttaatgttgagattcactcaggctcaactcttggtcctccccttttctctgtccttcccctgctgatctcactctgtctcatggccacaaaacccatcgactagccaatggctgatacctccaaccaggacctttcccctgaagtacaggctcttacatccaaatgctcacttgaccacttaatgtgggtgtctaagaaatgcctcaaacttcctgtttcccaaatggaacctctgaagtttccaccaacctgttccacccacagctgtccagtctcagctgatggcgatgctatcttccagttggagtcaaccttgacttttctcttcctcacatcccacatgcaatctgccaggaagtcctgtttgcttgactttcaaaatacattctcacagtctgatttctcaccacctcctctgctgccccctgctttgagccccatcatttcttacctaaaggactgcagtagttacctaactggtttgcctgatctcctccttgccccactatggtacgtttttcactgagctgccagaatgattttgttaaaatataagggaaataataatggtggtagcctcaacatcctccagtgacctccatttttattgagagtaaatgtcaaaatccttgcaatggcttataaggcctcctgtcatctggtctttgttacctctgacttcacttcctatcactctcacctcacttacttcctctccctccctcaggcttccttctggtcctcccacagccccagcatgatcaacctcaaagcctttacataagacattccctctgcctagaatattcttcctccttcaaagctgttctcttttcagtgaggtctattgatattgagttaccatacttgacatgatatctggtctccacatctctactttgcatggcataactcaatttccataatcttctaatatatgtaatttactccagttcttattaatgcttgctcctcctgccacacacagacaaattttaagcaggaatggtttcaaatccaactctgttactagaacagacttgacataggttaggcacccaataaatatttcttgaataaatagcagtgacaggatctcaaatcttaacttttagatggtgccgataccctggggataatataatcaaactaaccgtctctgcgcagcctggataaaaccatgcaaaacgaaaggtatcagcttgttttcaaacatcacaaaaccattctgaagaagcaaaccaggttggatgagtccaatgactgatatgtgttcctatgacttctcctacacctgcttcctggcgtgcccatcctgggacactggcgagtctgctcactgacactggcacgggcctgtctgtacagtcacagacggattttgctccctccgaccttcctggactcctgaacccgatcaagatgcatctgcctcagctcccaccatcatggcaccgtgtctcgtcactgctgagtaacgacttcacaacgagaagtagcactctttcagagtggtggccctgcagccagcctgccagggtgtgtattctgtttctgccttttgccagctgcatgaccctgggggagcaacttacttctgtgcctcagtttccttagccataaaataaggacagtagtaatacctactccatgagattgtggcaattattaataaacataaacaagctgcaacagtgcctgcatagagtaaggccttaatatttgttagctcctattaatgttattattattattatcatctgatttcataggtgctttcagaagatattaccttaattagaagaaattgctctactgaacgaattttgcacatcttgattggctgatggagaagatattttagtagaggtatgataataccagcttgtcctttaatcatttctgtttaaggctcgtctgctttatgagtgggtggggggatcttggtgtcaattagttatcttttggagattttctgtacagtttaaaagtatatctcctcgaggatatgttttggatgatctttattaacacagatacaaaaaggagtattatacaaattatttacttaggcaccactgttttcaatattaacactagcgctgttgctgctactattatatcttttattaacagctgtcattgagtgcttgctctagcctagtctatggtaattccctagtcttaccataacctataaattaagggttaattagtattctcatttctttgttcggactcacagaaaagtttagatgaatgtctcatcacatagtaaatgatgcctggattaaaatctacagcttatccttaaagtttgtgcttttagcactacattgttctatggagaagtcaaaaagagaagcacatttctcctgttaacagactaatacatgtaaacagaaggatgctatgagagaattctacacacatggaaagttttacttcctgaaagtctggataataaaagttggctaatacactttctgaaatgataaattaagttttagtgaaaatgaatattgagttgcaaagaaatagacattgcttaaaattaagataactattccctgccaaagcaaattataattgacaattatctgaagaggttttacacatgtaaataaagtaaatctaagtgcaaaaagatctaatatgaaaaatatttctttgaaacctaaacatgctttaagtcctgaagtagtctgcaatgtcttaaatgataactgacccctcaatgatttcccataaacatctagaagaaaaaaaaaaatttagaacatgatttctggatgaaagatctgtatatgcatatttacatttaaaaatacctagacatttgctgatgaatttagtagggttttaaattggaaaatggtttctttctcctttcccttcctgcttggaaactaagaaagcattaggtcatataagaagcccaaaccaaaggagttagggtctctacgatacgcatgtattaatacgaagagactgagaagcttaaggtaccactctgcagtctgaggactgagaggccgctgcaactgcagatttttgtctctcttgctgaagaggtatctttgcagtctctggagaaagctcaggtagctgtttgtggctttcaagatcctgtcctgaaaggggagctatctgaatggaaagagatgctgtgtgtgtctcaggcactggattaggggtcagtgagcggggccttttgagaaatgacggtacttcgacagatttggagaactgtggagtactaatggggctgctacttcctagatcctggttatgggttagtttcaaggtagaaatcctccgagtttgagaatcttgcctgtagtcctcttgtagaactggggtgttgatgttagcgaatggtgcaggatccgtgctggaagctgctggtagtggattagtgattttttgtgtatatgacatggttgtgttagattcttcagaatatacaattgtctgtctcgaatcttcattggaatacatagttccctgaagaggttttttgttagcaaagtactctgtactggagggaatttgtgtgttagttactaactggtctaaaatgacaccctttgtgtgactggttatcaaagagctatgaaagctctcttttctttctggtggagggggtgcctggattgacaatgggatccagagaaagaaataaagttgaaagaaaaacagagaaagtccaagttagtcatgaaagaaaccagtgtcaaccttgcctttacagaagtaaagcaatgccacaccttctgattatgctatccattttgttagctagattgagtgatcattttcattccatttagaatgcacttatgtttattatcaatgtttgcccttggggaaaaaagtgttgccagagaatacattataacatttgctccatctacattcagggaaattatgttaaaagtgaacatatgttctcttggcatattttattagactttgacatatatatatatagtttatttaatagcattgttttataacaattttcatgcttgtggcacaattttactaatatctccaacacagagcccttttagttaatataatagttgcatactcatagttattgaatacataatgtattgctgacctcatcagtttaaatccaaagcatcagctgtcagcttttaaagaattagaatatatcctagagattatgttaaaaaccgacatactttgataagcttaatcagaaacaaaaccaaaccaaacccttgtttgttaaaatttgttctccatgttgtaaatacaaacctggcaagcaaactaaatacaaaagcaaaaacatattaaaaataaaacgtattgaaatacgcacattaggaaagaggctgtaagcagtggtctaataatcatgccttaaaataatgcagtagccaagagtgtgcagggttacctgagttggtgatcttttatcttgtaggtttggtcgaacgcttctaaaaccttttgctgcaagagaggaatatgtagcatctccgttcagtgtctcctgattgccatcattgtaagatctccaagctttcattaagggaaaacaattggatacaaaaatatctacgttcacttaaacattttttataaaatttatttttatttccaaaatcatttttatttccaaaattgtagtgttcttactagaggtttaatttaatatgcataacagtacatgaaatttaaatttaacatgaagtcagcgatgtggctatgaatatgttttctaaaagtcacaaataatataataattattcagaatattttttctgtacctgagtctggtgactgagaatcacgccctgaaagaaaaaaaaatgttgaaattaagactaaggtgaaataaatgaacaacccagtaaaaataacatggcaaagaactatatgcattgtttttgcaaacattatttcagttttaaaatctgggtatgtcaaacatgccaaagggaggcttgtacatttatttttacttcaattagaatgtcattcattaaatatctataatatataaatatctatatagtaaacactcatttttcccctcaataatgttgcaacatgcaattttaatcttattatggcaaagatgaatatatgaatttctaaatatcaaattaaaggatcaaaagagatctggtttataaacagcactaactcaaactgccagatccttagcttccaatgccctgctgttgataagcatatttaactcctgtgttacagaactgtattctgtagttcgcatttttttttaccttaagaaactgtagacctgtctaccatatcatgtgacattttcaaattattctcgagactgagtttttttcctattgcaatataaaagtcattttatactcaaatatgaaaaaactgttacaacatgttccactgtctttcagctagtaagctgtggaaaataaatttcaggactaataaattgcttttggtaaggcagttggcaagttatcagtgatatatttgttatcaattttattgaagttatatattccaaaatcttctatatgcacatttgaggtaatcagtttgcacgtttaactcatgtgtattttaagtcatcagcttgtgttgcctggtttattaaagcacatggtcaactttacttagattcattaagctttaactttggaggtgatcctaggggttggatcattagcccaacctgctgtccagtcctggattccttctacgtgttccccaggaccattattagattcccatttcaattcataaaacaggaattttacatgctggaaaagtctttgtttttcttttagtgcttcagcacagttattttcaagtttaaacacatgaacttagaatgataaaaatgggctgagaaatgcgagcatctgatttttagataaaatatttgatatgggttctttccaaatcaaaggaaggaacacaaatgtgagtcagcacagagtacattagaatgattccagctcaggtgagctagagaagactaatgaattcccattctttatgatcattgataacttggtatggattttatctccaatgaatttaaaattggagtaataaaatgggtaccatagagaaaaattactttgaagaattatgcatgaaatgtttattggaccctacttctagaatttgtacaattttttgatttttattttattttttaaagatggggtcttgctattttgtccaggctgtccttgaaatagtgggctcaagagatcctacagcctcagtctgttggttagctgggactacaggtatgtgccactgggcctggcccttcttctaggatttgatggaagcagaaatgattgaaattcttaatcagctatatgatgaagataaagaaaaatacagtttgacaaaaaatacagagcaatcatcagaatgctgctttagggcactcaggagagagatttaataaccatgaggctgccatccactgtggacaatgaacaaattttgggatttgggaaaggacaacgaaaagcaaattttggaatttgggaaaaagcaataaaatagcccaatgctactttatgaaaagagaagcagcattaataacaatgattatattctgatttttttcttgaggatagggagtttcttttatgcttggtttggtaaaactgagataaaaaagaaggctgtgtgttagcgctggggacgaggtaatgggacccagaggcttggaggtgcaagggtgcaggtgcggtgagaaagaagaaggtgtactgggcgggtctgaaggacactagaaataaactccctctaaatgatagtctgtagggggcaggctctgtttcttcacgctggtcaccgtgttgaagatgaggagccccaggagacggtaagtgtgagaatcagaggacagtcactccaggctcaactgtgggtttcttcctgggacactgggcccagggatttccaaatgaatctgtccctgtgccactggaaacattagacagtaagaggggtgggctgttctgaagggtcttgcatcgcacagtggacacgagtgtgcagaattaagagaaaggagaaaatggccattgagtcgaacttcaggatgaaccagtattttaataaagcttatgttgatgattaaagtctgccttgaagtggctggtctctcaaggagactaaagtacattcatttctctttctttaaaataaatccaattacagatacttggaacacccagtcctgatttgctcttttattatagtcttctatgtggacactttttagcatagccctgcttttattttatccctgcaggaaagactaggagagggaggacacctgttctttggagcaggtaatagaaagtatcatggatccacatcaagtaaagagaatataggttagaaaaaaaaaaaaaagtcgcccaggtaaatggcttggcagatgtgtggggaaaatggatttccccagatctgcagcattattggtgcacattcacttgtgaaaaaaacacaaagctaggactaggggccagagtccttaatttctagtgttctttagtagacagtcactgcttcactgaaaatccacgaatgactaaatggtgtaagttttcccctttcctggctgttttgcatgtgaatattttaacaaatagggtcttgaagaatgaagagctccacgtgctcttaccagcccttttccttgtgtcgaggcacaaactggtgagtctctgtctgagattttgtgcaagacattcccggttccatgtcaggggtggaactggatgccctccatggccctttccactgttatcattctaacatgacagctttcgtgtagctgtgtttgtgatacgtgtcacatcgtaatctctactctcaggttttatttaaatcccttttaactgatatgctctattgacactatcactatatttttcttgaaaattattattttgatgcctataactcatttctttagaagactcaagtgctttttaagaattattttaaaatgttgattaaattcaggtcaactaattgagtgcctactgtgtttctatgtacaattataacccttttcatttattttcttcatttattctcatttattctgacaaatccttgtgagtctgggaaacgattaagctttcagagaggtaagaaatgacaaacaatttttcattggaaagaaaggaaatgagatctagacagactaattttcttaagggcatgaaacatgcaggtggtatcgacaagaccctgtctcttggcggagtggtccccatactgcggcattcctttaggctgacaaggggttttggtgaaataaaatgttttcaattgtttctcaatagtcattgtcttggttttggcataggtttaaaatatccgtgtgtgctctgatggattgtccagtgggaatttacttcttataaaaggaaaagagaaagacagactgactcaggggacaaataggtggtgactcagattgactgtctgatcagagaagggagtgaaaatggcttgggaccttttctggaggttttacataaaggctgttgtattttaacaatatcgaaggcaataaatatttatcaattcccttttgattcacatatagacactgtatcatataagttcttatgaaagctacatagaatgcagttgtgcatattaatgctaacttctttattcaaaaatataatggaagcttctttgaaaaagggggccaggtgtagtggctcaggcctgtaatcccagcactttcggaggctgaggcgggcggatcacttgaggtcaggagtttgagaccagcctggccaacatggtgaaaccaggtctctactaaaaaaaatacaaaaattagccaggcatggtggcaggcacctgtaatcgcagctactcaggagcctaaggcaggagaatgcttgaacctgggaggcagaggttgcagtgagccaagatcgtgccacagcactgcagcctgggcacagagcaagacccacccgtctcaaaaaaaaaaaaaaagaaaagaaaagaaaaagaaaaagggatcttactttacgtctaattgacacaaaagagggctgtttttaaacaattatgtccaaaattcagtggacttcattctctagaaatcatatgcctagtgatagaaaacttaaaatagcccaaagctacattgttattactgaagattatttcatattcctaaagtgtgaaatgttttttttttcttttttgctgttgtaattccgaagcattaaatcttttctatgaagtcgagttatatgaaattgcatgtagttcagtttcgactctccacatgggcactgtggaagcagtgtggcgttccctggtacgtgcgtcaaggttcacgtctgagtaggttggactgagatcctatttggttgaaatgtcaatgacattcagggtattggcattccaattacacgatggccctgaactcttacggttattgtcttacttgccttcattcctgtttctcatggtatccaaggtaaatacatctgtagtttttctaacacctttttatgttcatacgtgcatgagccactacatacaaatagagatttgtatagagatttttttttaaccaaaatgaggtcatactataaaccttgcaatgcatcttgcattttcttttaacttaatatataactgaactcactagcctggcatttaaacttggacgttgaaatccatttgtggattagaggtggtgaacggaagtgggattctgcatatggaagttcatttttttttctcaagaaaaactcagtagtttagaattaagtggctgtaaagcgaagaacaccctgagtatttaatcaacttctagatgtatgtgtgtagaagactgtgatatgcataatgagaattaaaattatttaaagatgccccatccctttctcacttctgctgtaagacccattaatcttataaataaaaaacaagcagtccccaaactgcagctaaccaaccagccaaccaaccaaccaacccaccaaccaacccatcaccaacaggtgtgggtctatttcagggtctggaggcactgggcttgctggcctccctttgaccttctaacagctgcaccccctcccagtgcagactgtgccttaggtactgtgcctaacttcggtactgtggcttaggtagtcacaacagagatttattaaaaagagaccacctgagtggatgctgaaatctcgcacccccagtgacttcctatctgtgggtacatgtgaatcttaattggtcaagattttggtatgtttaaatatatatagtagaagggtatttgctgattggattaaaggaaagcaaaggtctctttcaaaactaatgttctatcattctgttcacaacctttgacaaagaatccagttaatgaagattcagtttcctacaaatcccttttttcatcctgtacccctgtacccctaccccaaaagtttttaggttaaaaaaaaaaaccccaaaacctctgagttatcttaatgaaatattatgctacttaagttcatgagataacaaaaacgtgaatagttattaacactcgcagttactcaacctatttttggcaagtgactgctgtttttaattacacatttaaaatgtttcctacaagatctcattttcctttgctttttacgtttagaacaaaaacagtcagaagagctagaagccattcaagtgcgacattgtgtgagttagtgatattatacctgcagccaataggtttggagaactttgcactctcttcacagatgttagcgtaacagacatggcggcacgtttgcgagcacacccaccgctatctggaagcaaaaaaatgatatagcagaggccaaggcaacgggaaaagcacgtgcaatatcatgcgttttaagagaaatgtgccagacatccatgagaaagatgaacagttagaattagtaatcatggaatgcacctgccaatttcacaccaccctcaaactaaaacaaacaaaacgaaacaaaacaaaagaagaccagggatctgtcttagaaataggtatcactgttttagtgaaagcatggaagacttaatacttaacattttatggttttctttgtgaaaactcaggcacagaactcaactttgtttataccatttaaattcaatttatactaaatctataagcactggatctggcttttagagtcaaggattagctccatgtcaggattaaaggctatggtacaacatacttttaagttaatatcatttaagttttaccatcttctagctgttataattcccaaagagagcttgaataattcttgcagtaaaaattattagtgacacaggtatgatacatttttttaggattcatagaggaacacatggcatcatggaaagtccactcttcctgtagttagtgttagttatgcaaataactagccttattaaaataaaagtattgatatatatggtatcgaaatgaccatgtttaaagaaaggagtatattgcttttactttttaaatttttatttttagggccggagtcttgctccatcacccaggctggagtgcagtggtaccatcacagctcattgccatctcaacctcctgcgctcaagcaatcctcctgcctcagtctcctgagtagctaggaccacaggcacacaccggctaacgttttaactttttgtagagatgtggtcttgctgtgttccccaggctggtctcaaactccctggctcaagggctctttccgcctcggcctcccattacaagcatgagccaccgcacctggcctcatttattgcttttatacttttaacaatatgtgtactatgattcatatctttaaacttatgcaagtcataatgtgaaataaaatcagtgtaagttcatcagccattttaatgtgctatgagaagtttagacttctaaatttggaagagaagtcttttaaaattggaaggccaatgttctatttatgaccagattcaaattccattcttacattcctctgtaatatggcatggcaataaatagttttgctcattctcctcattctgcttattgagtaaaaccaaattaaattaaatctttttgaaagttataaaaaaagacaatataaccaccgatataataatataatcattatatattgtcacatttccatttttcctttttctttattttcataaggaaagtatcaagtttgtttattggacatgacagaatttagattggtaaagatgctcggaagtataatttgaaggaatttttcataaaatttataaatagtaagattaatagaacttaaaagcagtggagtgattcttacttcacttttttaaagtatatgtttaaagtaacaatttcttaatgtagaaaatcattaaaccagaaaaccaacttgaaagaatattaaaagaaaatgaaccaaataaatcaaaggttataattaagaacccaaagaaagtgacacaaatgggagaaacaactgaagattccttcaggaaaggctccaaaaggattttagcgaactcagcaaactgaaagtgcttagagacaagtgcgtctgataagatggaggtgatgttattgcttccaggagctggaaactggttgaaatggttgtgtagtcaaaggtgttgaaagtaaaaactgacatcactctaagagtgattttatttcctagttctgttaattctgaacatctcacaagcacataggtgaaaagagaaaattccagaatgagaagatccagggtcacaggttaaatctctggtgttcaaactgtgggctgcgatgccctgggctgcactggtgcattcatgagggtgttggggggtagttcctgtttttaaggaaaacacagtgctaactgttggacactcaatgaactacttgcttggggcagtgcctggtttcaacataatagacgcgctatattccttttgatgacatcatattttggaaaaactgggattttgatacttgctatgataaaaagcaagtaccatctgaagaacattttatttatttatgtttagagacagggtcttgctctgttgcccaggctggagtgtagtgatgcatttggaccttactgggctcaaactgatcctcctacctcagcttccctcatagctgggattacaggcacatgccaccacgcccagctaatttttaaaatttttacagggatagggtctcactatgttgcccaggcttgtctccaacacctggggtcaagcgatcctcctggctcagcctcccaaaatgctggaattacaggcgtgagccaccgtgactgtctggcctgtaaatcattttagatcagtaaatgagagtggtcatgtacaatcgaattctaaggtctgagaaatttttcagtgtgcaacaggcacacacataatattagtaagtaattcttgttataaagaaagaaataaaactattttctttcaatttatgtgtactgttctgtcaaatggcttctaagttgttagaacaaagtatttataaagtaattattaagttattaagttgttagcacctaactacttaataaatagaagtgttacatatttttgacctaggagcacagtgaagaaattactgagacattaaaggtcactgtaaaacaagaaagtttgggaatccttgggttagacaatttatgtattttaggaagctctaagtcttagatgaaataaatggaggctctgtctttaataaagtttaataaagggctgaattctaaaacttgaggcatttgtaaaattgctggaacagaatgatctattatattgtgtttctacttccttttgtattgatactttctgatactccttgaagatatttttaagatcttaaaacaaggatgctacctttcatgtgtcagtttatcctaaagaatcctaacgctggtcttgccttttgtcctcattaatgacctgcagccttgctaggctactcttcccctgagctgcaagattcctggaagctgttcctactgctggaaacccctcatatgggtaaattatagatggataattatttgatgtctttccttctctcctttcttcaatagctaagatatgcctaagaaagtaatgtgttaaacattctaaaagtggacatataacatgttttgtatatattttctacattgtttagacactttagtatgaaaaattaaccacattccccatggctagtttattatgcactgattaaaagcaaatacttaacttaaaagaatgctttttagccgtggtgaccaacacatgaagatttaaataggaatatatatttttaatgattgatatattggatagatatatctatcaataaagagatatattcctgtttaaatgaatattgatatatatatcaataaaactggcctgtattatttatctatatagattatctgcattgtctatccatatattatctgcattatctatctgtctattgatagatagataaatagatagatagatagatagatagatagacaaaaaagtcagaagagctagaagctattttggggatgagaaaaataacttgtggggccactttattcatctatctatctatctatcatcatctgtctatctgtagatagataatgcaggccagttttattgactagctctttaggaacaaattcctacttcattttgtaaacacagtaacaatgctttcaaattcctaaggcaatatatgtgtgtatatatatacatatatatttaaaagtggtatgtttttataaaaacattataattattattttggaattttgagcaaaagttttcagtcacttttgatcaattttatgcatatgtttgaataccatattttccaatcattatacattaagtggaagttcatccaaataagcaaaataatcctatacaaattgcatcccatccagagtcaagcttactccttagaaatgagaagatgctttagaaggttacatttatgctgctaagcagtaacttgggtcaagtaccttagtgacttaaacaaatttacaaatttgtatgtgcttattttgctatgagggattgaattatatgaataggaaggttaattattgagtgtactgcccatcaacacagcatattcagtatatcatgtatgcatatccctgtcataatagtgttataataaataggaaaatcagcactcagtaaaatgaggaatactgggagttatgatccacttaagtctacagggaaatgtcttggaaggatcaggaaatatcacttcctcatgtggaacttctgctggagtgactttgtagctccaaaacatggctgatgctagtccagctgtgggctctacattctatttgctttcttctgtctcctttacctgctaatattttctacttcattccccatgtctacttctgacatctccaatcatcaagttgcctttgtgtggtgcatatgcagggttataacttctcttgattgctgagccttccttgtgtgttttgactgtctccagtatcctcatcttgcctgttgtccacatgtctgcaaggtgactgcatccccaggagcccgcccgcacagccttctctgaggccactacggcacatggcacatgacgcaaggctctgcactcgacctggggattaggtattggtcctcgccagtggctgggtaatcctccttgtagcacttgatgcaacaagagacctcaaaaaggcaaccagctggacatgagagaatatcttgggccatcctttctactctgccatggcgcgacggctcaaacaactttccagtgatcacttgtggataggaaatggtatcgtttaaacacaagttacaaaatttcaacgagaaagttgtttcttgaattactttgtattgtatatttcaaggtggggggaaggcaaaattataagccaaattatttctactgtggaaaaaagttcatatgtacaaagcatgtatcatgaacacttttacagttaaaatgtagacaatacagtttagagacacagttgttaagttatttggagatactactctcacatctacacatataatgcttataacactatgggaattgtgactataggttaattaagctgattttgtataaaactttggcactctatctgctgacttcttcaacataaagagtttatagaacaggtaagtttgaatattttcttctagagcaacttgcctttgaatttagcctatttttaagtgagagatttcaaaagtacacaaacaaacgacatactacctcttcctattgtttataggagttagttttaacatgtgattagagaaaaagggagtaggagcaagtaatagaagagaaaattctatgtttggtggctataagagtggggcacaaatacaaagaaagaaagtaatgaatctatgctatgtatctaatcagaaactcagaatcacatttaggatcagaagagtgctaaactaatgatttagggccaacatgatttttagagagcaaggctaaaagagtttaaaactaacagacagcatacctgtgttcattttcaccttggagagtttgttattaaagtcttcagttttcctgtaggaaaaaaatggtgcataattgttcactagcatgtggaagaaaatatcatgaaagtgtgtcgcatttttgtttttgatgtacctgtaagttaatatcacattatcattagtcttatttaaatcagtgtttaataaggtaggaagaatttataattctgttcatgttaaactttaattattggtcccatgctcataaaacagacatattctgtttttatgcttttgtttaatggtgagcattaatggatgaaaatggagacgttttgtgcttgtttttctttttttctttctttttttttttgagacagagtccgccactgtcgcccaggccacagtgtagtggtgcgatcttggctcactgcaatctctgcctcctgggttcaagcgattcccctgcctcagcctcccaagtagctgggattacaggcacatgccaccacacccagctaatttttttctatttttaatagagacggggtttcactatgttggtcaggctactcttgaactcctgacgtcgtgatccacctgattcggcctcccagagtgctgggattacaggcgtgagccaccgtgcccggcctgtttgtttcttttttagagagagggttgtgctctgttacccaggctggagtgcagttggtgtgattgtagttcactgtggccttaatttcccgggctcaagccatcctcccacctcagcctctcaaggtgctgggattacaggtgtgaactaccgtgcctggttgagttttccttttaaaaaattaaatttcttttacaaatatttatacaaatggtttttgttctctaagcctgaaatgattgcctgttaagtgtcctcttccagagttttaaaagtgaccctggcactttaaaatcattgccttacatgtgcaggtcagttgactaccggggaatatgtaatgaatgtaacgcatattttcaggacactgtcaagaaagatgagattcatctttctcttttttaaagacacaggaaatagatggtcactacaaaatccatctctgcattagtattgaatgctgatttttcccagtgaaatgttggatgcaaagcaattgagattaattcgctagaaacggttggcagaaaggggttgtctcagaaaaaagtttttttttttgagatgagtctcgctctgtcgcccaggctggagtgcagtggtgcgatctcggctcactgcaagctctgcctcccgggctcacgccattcttctgcctcagcctcccaagtagctgggactacaggcacccgccaccacgctcggataatttctttttgcatttttagtagagacagggtttcaccatgttagccaggatggctacgatctcctgaccttgtgatccgcccgcctcggcctcccaaagaaaaaggttttaaatattgtgtatcgttttatgacatgtgagatgacttagttctttctctggcatattctcttagcccatttatggagtttcttatttacccataccctgaaaccaaagaggaaagacacgctgataaggtagcaaatctcctaagtccaagagctccctgcaagagctgtctgaccccggccacttggcctttgctcctgagtgggcctgttgttgagtatccacaagaacccccccgcacagcacaacacactcacagcttccaggcgcatcagtactgcaacatccgaacattttcaagaattttatttattccttttggatgaatgaggataaatttgaaatgaaatcattggcatgatcacctgtcaagaaagacttttgataaataaagattttttagtctctaaaaagagcagcaaatgagcttcctggctttcttgcctttgtctgccaaggttctcaccctcttctcccttctgaccatttcctctgctcaactcacaactattattttctttcaatgtggctattggagttcacctcttttggaaagcctggctttgttcattactgatgaaaaattataataataaaatcaaaatgtgaatattagctaaatataatggtacttctctcccagtggggggaaaatgatgaaagaaaataacattaaaaatacacttaagtcctatgaaatataattataaagcaagattttatatatagatatatatgtatagtgtaatcctcgttttgctatatacacatgtatatgtgcacacatacacacacacacgtatatttgcctagattgaattactaataccttaggactcaataaatgctaaattaatgaacatttaaaataggtaaaatcacagtactgataatcacctcagtatatgtttttagagctctacgctgaaaacaatatagacgatatccttactatatggtgtttaatttttgtgtggtctgtgttcagtgtcatatcgttgtccgtctgccctgggcatcattgcagtgtagggagcagggcaggagccatgcttagcgtggccaggctagaactgagtttccacagggttatggggaacttcactggggcatttcataggccaacagactctgaaaaatgattgagggaaattttatgatggtgaattttatctcctatttttcagtgtatgcaactaaacaggcacatttctgttttacttttttgttttgttcttctccagaattacacagaaaaaatgtggcgtatttctaaaaactcagcttggtagccttaagaccgcctgtattgagggataccgatgaagtcagggaagagggcagcggccagcacaggagctttgggaaagctccttcaaacgtatttagtttaatctctcggtagctcttggtagcaaaactcctaatatgttaaccttaaatggacaaaataaatggaaaagaaaagcctcaggggatgtctgtgactgagactgaggcaacttctaaaacaagaagggataaacaacctccagaaaatgaggattatgaggacctttcccaaattcgacttcttcattccttttgaaaccaggcaacgctgtgcttacaactgcttaaggttttaaaacggaatgaggaagacagtattcgggctagaataatagtgattgacaaagaaaacatcaaatacagaaggttaactctcagaatacaaaatctgctgacagacaataataatgtttttgtaccaagttagagaactagttatcaacacctattgtttgaattcaaatgccgatatttacagaatatctaacactcaaaaagtaaaataggattaacgagaacaaagaaaggcgccacaaatccttgaggttttcatctttaaagtgatgtatcctgttacttataaatgtaatttgtgaggctttttaacttcccattgttttagatgtcaaaatgtgaaatgactaacttcctaatcaagcaagacattttccaagtcgttaaaagaagaatcccagtgattgagctctcaagaagaacctgaaaccgaaaggcttcttgggtgactaataaaaatgcacgattctatttcccttatttgtgctaagtccattaacaaatccacgactgagaactctctttagacagttcaaactaaagcgaatctaatctcttttgttctgctctgaaaaagtgtccttgattgtacttacataacaagcacagattattctggaaagcatcaaattcctagagtctttgcatgctgctagacaacagcatctcaagtattctcttaacttggaattgaaccagggacgagactatgagaactgaccataacatggagactaccttgagccttagcagacaatccacggagcaaagaagtctccgaacatgaaggtgtcagcatgattttcaataggtgctaggggattgtgtttacttttgtcaaagtttcatataaaaagcaacttcatatgtgtcctaatttgtgacaacaatggattggttttacttatggattagagtagcctccactgtcaaaatacatatggcaatagattgtgttgattgttcatggaagggctgtaaacagcatgacttcgggtctatagtcttttaattttgcttgaatttcttttttttctttttctttttccttttctttcttttcttttcttttttttgagacggagtctcactctgccgcccaggctagagggcagtggcatgatctcggctcactacaacctccacctcctgggttcaaaggattctcctgcctcagccttctgagtagctggaattacaggcgtgcaccatcacgcctggctaatttttgtatttttagtagagacggggttttaccatgttggtcaggctggtctcaaactcctgaccttgtgatcctcccgcctcagcctcccaaagtgctgggattacagatgtgagccaccacgcctggccaattctgcttgaatttctttggattatcagacatctcatttttctcggaatcagagcaggctgtgttctcaatacgtataagagaatagaatgggtaatttaacttttgaaagaggatcctaaggagtttgatcctgcatgggcatgaacatgcctttgtgcctgttgtctcataattctgcttgaattgttttgattatcaggcatcccattctgaagagcagcagagacaaaatcctttccccagttttggctaagaattctatgtaggtcattttatttttgtagacctgaatttaagcaccaagaccatgtatgaaactacaggactgaattttagctcagttaatgggaggagttgcccaaaagattttccacagacgaaccttaagccaatacattgctactgttattttgaaattaacatattcacagttcatatattattcaaaaaaggacatattgatgtttaagtagtaggaaaacattgcaggatgttagtttttttttttaaagagatgtattttaaacatgaacataaaaatacaatcatattaaggttatgcaccagattttaacttgaatttacttatttattttgaaatgggatcatttgtagcactctctttggataaactgccctaagtgatcaatgtattaatgcatctctctctatctctgactgtggtaaaataagaagtattcataaatgccaagtgatttcacttttctattatagtcaaatgacttaattcaggttgacatttatcttcacctatctttcctatatgtcaacatgctgctttgaaatagtcacatgaaaactccaagtagtttgttttgtgagtttagaaactctcttctgactagtttctctaaattggctcagagactcctctgcctgagtgggtggcacacaagtcaacagtagcggcatgactgtccatgctcataagaacaccaagtacctcccagaactcctgtgctaacagtgcctgaaaatgttccttattattcaggagccgaattacccgcggcatctatttatctatgctgaggccagaacacattcaacatcatttctaggaataaggagacattattaccacaaataataaagaaataaatgaacatgaggccgttgataattttttatgagaatacgcggagtgttagttttaattagaccaaatgtcctgatatttggaaaaatttcctgaaaaaagagcactatatgtcttccaaggaaactagcaattttccttttgagactttacaatgtaagctgttcaaaatacttatcaattttccctaaagactttactgattagaagttgatcacctggtaaatgattccttctgatgttattccaaggtctcaaagttggtgaatcactcatttcactatttgctttaaatggtcatgtgacttaacattggtccagcaccttactttcttttttttctttaggtggaatctcactctgttgcccaggctggagtgcaatgatgcgatcttgcccactgcaacctctgcctcccggggtcaagtgattctcctgcctcagcctcccgagtagctgggattacaggcatgcaccaccatgccgtatttttagtagagacagggtttcaccatgttggccaggctggtctcgaactcctgacctcaagtgatccacccgcctcggcctcccaaagtgctaggattacaggtgtgagtcactgtgcctagccaccctactttcatggagttccttagttttatattgtaatcttagggatcattacggaacaacatctaagtattttcaagtgcatcttttttctaagactaagtcatttgttcaacttgatagtacagtattaggagaattccattggcttataatgtgcaaatcaaaagccaaaaaaatttctaatgaaaataattcagattctgactgaggatctcataagtcaggcaccttatcaaagagacatgtgaggaattaattagaatatccctataacacatgtataggcaaactgaatagcgttggaagaatgggtcaagaaataggcaaagcttgactcaaatcccagttctgcccatttctatgcatccgaacaatttataccaatgtcattatcatcgactcccccgctagacagcaaagcatccccaatctggcaaactggcattattcccattcactaatatttcaaatattttgaagcagatctttacctttgattgagtcttaagaagataatctagactttcctgaaaatacatggggcattattgtattgctttagattgaagcaagccatatggtttattagactgatttctatggattttcccgtctcccaattgtcccacacccagcttagcaacatgttggaattgaaaaggaattctactttccaggcagctttctttcttccttaaaaagatcctttatttagctaagattttcccccccacacattgccatgaacaagagaaaacctaagaaaatagttgaatcaaacccttgccttctagcccagctatagacaatgctactggatctaagggaaagtgacactataaaggttttgacgattagcttttttaaaaaaatcattctctttccctttgacagctgatagccgaaagcgatggctgaatggaaagagatgtctataaaatgtcacataacaaattgtgtgacaaattgcagagtgataacatcctgatggcagcctactcctgcttaattcaataagggaaagtgcctctgatttcccaccttgtactgagaagcacacatttctattttgaggagaaaagccttgatctttttaaagaaccattttttaaaattttatgctttgctaagtttctcactgcttttaattttaaaatcttccgttttaatttttatatattgaaatataaaaatcatctgatatcaaaagaattatgtaatctagtctagttttgcatgtctcatacttagactttaagtagaagcaagcatcaaaggctctggtagggattgagatcaaccaactcatttttagggttagacatttgaggataagataaatggatgccccaagcagatactcaaaagtagttcatctctcctgactcctagcaaataataggcatcctcctttaaggaatcttaaaacgtcatttgaaatcaagatcttggccaggcgcagtggctcacgcctgtaatcccagcactttgggaggccgaggcaggagggtcacttgaggtcaggagttcgagaccagcctggccaacatgacgaaacccctgcctctactaaaattcaaaaattagccgggcatggtggcacatgcctgtagtcccagctacgtgggaggctgaggcaggagaatggcttgaagctgggaggtggaggttgcagtgagtcgaaggttgcagtgagccgagatcgcaccattgcactccagcctgggtgacagagcaagactccatctcaaaaaaatgaaacaaaacaaaacaaaacacaaaacagaaaaacaacataggaaatcaagctctttccctttaaaatattacagtaccctgcttaattaagtactgaatcatatgaggcaggggttagggaaaagaacaaaatatgagaagacggtgtggtagaaggcaaaactgtttgataaataaaataagaactgttaacatagaaccatatgtttcttcctctaagactaataggaaaacagtggttgattatgacaaggattccttttgcccaatcacagcacaagtccaaatggaaagtgttaatcaggtctactaaacccaaagcatattagacctccttggtctaagcctagaccaatagccattgattttttttttctgaaatccttagaattttcagttagtaagtatatctattttaaattattttcatggtaatgttacgtggtgaaagtattacagtgaaataagcctgcttattgttaattcactgttcttaaaaagccacacttttcttctgattgaatacacctgtttcctgagcacctgaaataacatttatatactttagcaatgtcaaggtttgtcagaatttttgacagaatatactgtcagaattattacaaattcatgtttatatgtgtctcagatatgcaatggtgaaatcccacttgctatgtggaatttaaattttggggcaggggaaaatttgctctaatttgatcttatagtcttaaaatttaagtaatacattacttacaaagtttatccagaatgaaatgtaccttttttttttttttttttttgagacagagtctcgctctgttggccagggtggagtgcagtggtgcaatctcggctcaccgcagcctccacctcccaggttcgagcaattctcctgcctcatcctgcagagtagctggggttaccggtgtgtgccatcatgccaggctaattgtagtatttttagtagaaatggggtttcaccatgttggccacactggtctcgaactcttgacctcaggtaatctgcccgccttggtctcccaaagtgctgggattatgggtgtgagcctccatgcctggccagaatgtatcttaaattgtacatcttaaggcagtttgattcattttagaaaatttgaacgagaaaataataagccaatggaggaaaaatatcatctgaagaaattttgaatgcattaaaagttggaaacttttgatatttgtgttgaacagtggatagtttattacattattctttgggatctaataaaagtagacaataaagacagatatcttccattttaatggaaatgtattattcagaaatgtattattaatatttatatactgctgctccattgttattcagacatttgaaaaaattctttacatttctctatgtactaaatgtacaagtgttaagcagaatcataggtgaataaaaggtactcaatttgaggagtaccctgttccgactgtgtctgcaacatttttattttagggaaaaacaaagtggtgtgtttattgattctgcagaaggcatacacacgagaggggaataggtaataagtagaaagatgatcttgacaggctgaattaaatttggctaaactaaatttcatgattaggttgaagagactggcttttcaaaaatttatatggaataagtctaagggctttaatgcaattgttgaaaaatataattaaatcaatgtctaaatgaacagtggtttcatgaatcaaggaagattgggctccagctgcctcacttttaaagtgtccacatgagtctgtgcgtgagtcaggctggcatgaacttgagtctctaggcaggctttggaggctgtgctgggtggggggagggtcacagaacgatatggtagagacactatggtgagtttccaggtgactaccagcagcaacaggaaaagttactgacatgtacttgaggtttatttttttctttcatctcgtggaactcatcccagtggcccttagggttaatgctcttaaatataccaaatttatgctttaaattgacaagaagatgtataaataacagttgcagctagaagcttcaatattccctcaagatgtacctgaatttaagaaacataatatctaaataagactgtttctcagtgctgggtttttaaccatctggttcacaattgtcatcagaaagaatgaaaacaagtccatcctagaaataaggggtttaagacttcagaactgtacaacaaaatgggatgtggtgtctattgcccttttgttcagcaaaatgccaactcagatgacctcacttctagttcttaccccccacatatgttcccagcattcttcatttttcatacctaatatagtccttcatgctctgccactatttaaagctaaaactttcactcaatccaccaaaaataggcaagaaaaacaacatacaaatacaaatttatattccacagttacacagtggagaacagtgaagcttatttgaacaaagtttttgttgtttcataatactctaacttatttgacgtactggctaaaggtagaaatgatcagaacactttttgagattgttagttggcatattttaacatatgtagtgaaatcctactcagtctgatctttattagccatttctcccccttttatctacagaaataaactctcaacactctttcttttatcttggacttttgccactcttggaaaagcagaaaaatttccttttgacttcccaactacacgaactctttcagggcagcctggttttagctccagggtagtctgccatgatgctcagggccatggatcaccttacagatccaacctgggcctcttgttcgcatcgactctaccctgggactcagcctgttctccttcaggtccacaggtagagaatgtctgtgtggacatcttcatggacagagatacccactgacttctgatctgatacctactgacttcatttccatttcttcttttataatggagcgtaaaagcactttgtcatctgtgctgcagcatttggtaaaggaaatccagaacccacgctgggaccacatgcatttacattgattctagttaattatgtttgagtggagtgatcgcttttctatagtacatagaaaatgttaacatgaactattattattgggatgttggctgtctgccattcctaacacagagcagagggtaagaaaatgtcactcatattgggagagggcaaacaataatggatgggccaaaaagttagcaaatttctttcttttttttttttttagacggagtcttgctctgttgccaggctggagtgcaagtggcgtgatctcagctcactgcaacctctgtctcccaggttcaagtgattcccctgcctcagcctcctgagtagctgggactacaggcacgtgccagcacgcccagctaattttttgtattttagtagagacggggtttcaccatgttggccaggatggtctagatctcctgacctcctgatccacccacctcggcctcccaaagtgctaggattacaggtgtgagccactgtgctgggccgcaaatttcttttttgtgggagaagccactttagaagtatatatctacataccttgtctaagtcaatgtgttgctataaaggaatacctgaggctgggtaatctatacagaaaagagggttatttggctctcggttctgcagcctgcacgggacgcatggcactgacatttgcttgggttttagagaggcctcatgatgcttccactcctggtggaggggagaaggttaaagggagccggcgtgcagagatcccatggcgagagcagaagcaagagagagcaggaaggtgccaggctcttttcaacaatcagctctcaagggagctcccccaggaatgaatagagcaagaactcactcactctccctctgccagggaggacactaatctattcatgaagtatctggtcccaagactcaaacacctcccattaagccccatctccaattggggatcgaatttcaacatgagatttggaggaatcaaatatccagaccatagcacacatcaatagcgaggaagtggcagagtcagagttcaacaacctatgttttaggggacttccaggtatgtgctcttaatgttacatgactttttttttttttattgtactaaagtgggagtcggtgttaagccttgtgtgggaaggtatgcttgggcaaatcacttcacttcgatgagcctgagttttaaagtttataacatgaaagacttgatttaaaatataaaagcacataagggacttttatggtttgaaattttgctaaatctaggaaaggtatattcaaccaacaaacatttgttgacctttaatgtgcaaaccactatgctactgtcatgattgtacatatcaagcagaaactaactggaagccaatatttaatgactcattcacatattaaaattcagaaaaaggagatggttaaagacccgtgcttctgatagcatcatgatgagatggggtacatattaacacatgtccaagccaccatcctgacaaccaagctgtctccctctttgttgtctgctttacttaactccagatataagatctagagaattgtttatatattacatgtctttctatattatctccagtgccctacccttgagcttctcaattttagaatttgatcgttcctaaaatagaatccattttataaatctgcaccagaagaaacagacagaacttcagtccatcaattttcattaatttttaaagcttttttcatgagtagtgtggtaggtacattggaggtaacaagaatcattgattctttttttattctgttagaatttacagtagaggagaacttcaaaacaggtatctcaatcatggaggcagcttggcattccaaatattacgtttttgcatagctcctattttaaagagtaaaagtctattggcttttgaaggaaaaaaaactaaaagatctaagcagactgtactcctagccaatattctcatcacatttttcttactggctgaatcagtcatgccataacttgctaaatgacaatagcatgggaagtacaatgacaatttgagttatttttcatgtggatggttgttgttctgtgctttgattactgttgagaaatgtcggcatcaggctcacaaacaattgccaaggtcctatgacccacaaaaacttcaatcagcctgttcccatgttcagatgttttggaatttggatgtttactttacataaattatgatttaatattatggctatttgtaaggctactatgtgataattgtatcattaacttcaaatgattaagaaaagcaatctgaattagggagaagtgagttataaagtgcttgtgaaaaaaggcaacgtattttccttcaaaaatacagattaactctaggtcaaggcaataacacctaaaataaatcctccagggtcctagtttaatgaatacataagaatgatttgtacttctaacatcaattcatatggaatgaatgcttctaaaaaggtttattttgtgtagtataagtatgctagcactttgcttaagaatctagcttttaatattatcaaaagtaaagacagcctagactctcactgaattacctcaatttctaaattggtatgtctaagttacgattcagacataattcatatttatttcccatttcatgttggagtcaggatattcgcttctccccaaacctcaccccatttttccagtattcctcacctcagagaatgctatcattcattcattattttttacaattttatttatttatttttttgaaacagagtctcactctgtcgcccaggctggagtgcagtggcgtgatctcggctcactgcaacctctgcctcccaggttcaagctcttctcctgcctcagcctcctgagcagctgggatcgcaggcatgcaccatcacacctggctaatttttgcacttttagtagagatggggtttcaccatgttggctaggctagtctcgagttcctgacctcaggtgatccacccccctcggcctcccaaagtgctgggattacaggcgtgagccaccgcacctggcccattcattcattattcaattcattaatcaaaaagtttgagagcccattctactccacaaattaccctggatgttccctctccctcaactctccatgttttgagaaataagacaagaaacattcagctctgggaagggcagcatgcttctatctcagtcccacagttcatttgcccaagagacttgggcatgaaagataagcatttctagtccttttgattttgcacaggtcagatataggttaggcacaggttaacacagagtgggcagatgggagtctctgaccagctcatgcggtgcaggagttatactgttgcttcactttcccataacagcaatggatccgaaatggatgatgatgttccagtgtcacacaggtaggggcagcatggcagataaacgtgagagaaaaagcagtgtgtgcatgcacatgtgcacatacacaaacacatgtgcccatgcacaggcacacgtacacatgctgttgtgttccccacccagttgtctcaaaggccacgagtttgtggattttatcttcctagttcagtacaggactacccagaagttggtcgatattaaagcctcaaaggaatcataatatcacttttgtccagattttattttccaatcctctctttgttttatcaaaaacattttaggagtacattttttcagatggattatgtaaacactggacctgttcgttaaaaaaatttcttagagatcaagaccatcctggccaacatggtgaaaccccgtctctactaaaaatacaaaaattagctgggtgtggtggtgcgcacctgtagtcccagctacttgggaggctgaggcaggagaatcgcttgaaccgagaaagtggaagttgcagtgagccaaggtcgcgccactgtactccagcctggcgacagagcaagactccatctcaaaaaatatatataaaatcaaaaataaaaaaaaattccttaaagtttaatattgatatgttctatatgcaaacatgaatgggggttttccgttttttcactgctatacactcagcctctaacaatatctggtacatattatttacccagtgaatatttatagaaagaagatgtcctcatttacagacatgatggaatgactcccatcgtgaagtggtttgtcagggagagttagacaaaggggcttgaggattcccctcatttgccattacagtccaccccttggctcttctagtctattgagggcctttcttctgagttgctattggacatcttgaatgtaatggtgtccctagacaccagtttacattgtcttccagcatatgtcacttgaggaatctctagatgatttagaggtgtcaggctaacaaatccacactcattcctgaaaatccctggaaaatggcaaagataattgagctgatattttggcaattggcaggatgattttgtttgagtctgaagtgtattttaagaagttatttaggtttcctgaataccaacagtatcatgaaaatattatgcttgccacgttgatttaatcaatcaattctaaatcaccaaattatatcatacattttaaacaaaagcatttttactattgaaccctaaacatgaatgtgacttgtgatttttgtttttccaagagaagactaatacaaatattcattttagaaaaattctcagtacatgggctgtttgtatatatcttaccacttcatatcccaaccaaaatcagatccacaaacagcaagcaaacaaacccttgactcttttctcttttagttagttgtaatataacataagtgatattgattgtagcaatggagaatgattattgttactttgggggttgtgtctcaagtatacacaaatggataaaccacaatccttggtgcatgacaaggtcatgtacatccccctccctcctttccttccttctgtcactaaacatctacacaccaaccatctaaagccaaagatagaccttcgtaaggacctgtgtctatccagatgacttctgctgttataacatccctcagctccatgcatttgagtagccatcattctgaattccatgcttatcattctcttcctttcctgttcatataatttcattgtatttatatgtcttctaaaagcacatttattttagttgttttaatctttataatgatataatgctgcatataattacattgctaagattcatctatattgttggttatccctgtagtgtgttcacttggtctcctatataatatttaattttgtcaaaataccacattttgtacatccacttcctgttcaggggcatttgggttgcttctagatttttgctatattggagagttctgtcataaacacgtatgtacatgtttcttaatgcttttcttgtgaattaactgcttggcagataatttaaatgatatagctcctacttaaaaagtattttctatgtgccaaaaactgatctaagaatatttacagatattacatgtatattaattacatatgtgttacatatatattacatattacacatatattaattgacctgaggcctcacaacaaccaaacaagctaaatactattgttatcttattttactgcaaagaaacgccaaaccacagggaaggtacaaggtcacacagctattaagtagtgagtgaagcttgggaatgcaggcagtttggcttcagagtttttgtactataatgtctttcttggatctaaggacataaaggattgcaacagtttataacacataacttagttattgaccagaatttgagtgtgagtctgtcataatcaggattaatcaggtacagtacaccctgtaatgagcaatattggaaatgctcatgtatactataattactctaagacaaatgtcataaacatctttgttttttttttttatcatgggtacaaggcacataaatttatttcaataggacagctgctgcttttgatgcttgttctcacaattccgtggtggtagttgtatttgtttgttctcatgttcctaataaagacatacccaagactgggtaatttataaaggaaagagatttaattgactcacagttccacatggctggggaggcctcacaatcatggcagaaggcaaagggcatcttacatgacagcaggcaagagagcttgtgcaggggaattcccatttataaaaccatcagatctcatgagacttattcactaccacaagaacagcacgagaaagacgcaccccatgagtcacttacctcccaccggatccctcccatgacacgtgggattatgggagctacaattcaagatgagatttgggtggggacacagccaaaccttatcagtatttctctgtgtttctcacaaacatccctgagcactttattgttatcacccaccataggatggtcaggcccatctttcttccccttgaaggagcccaggcttctcctaggcttcagtgttaagggcacagtgggttctgggtgaccctcataaaatcagatcatgaatttaaggcagagccgacttgggctctcactctccaggggagatgttcttagatgaacaaaaattctccttagtcagaaaagcagcatcctcatcaatgtatggaattgtggcaaacatattaagcatgtcattccttaagttaatatctgtcactacataataactcacgataaataaatgtggtcaagaaactatattgtcacaggtacatgtaatagataaagacagggagcacaaccagcgtttgtttaactttgcaaggatcaaaccatcatcagaaccaccctttgtgtcttcattaattttttgttcatgctgattctgaatgtttagtctcaagaggaattatgagccatcagattggatgagtcaccttttagttataatcacaggagcattcaaaaatgaaatcactttattcagctggatgaaccttataaaaagtaaatgacttcatatacatttggcataaggctaatgagctatttttagtttttcctggaattatcttagcccttctttccgccctccgtgatgcctgcctccattttaccccttcccagtgctttcttggtcatgctaatcaaaaaggaaagggggaagaaacatgtggttttgataaccttcaaatcattaaggcaagggggaaaaggcccacaaaaggtggctctgaaacgtggagcgcctttccaagatccaaataaagtgttttctagagagtttcatgttatttttatcatgacttttataatctactactatcttttaaaatctgcattagaatattatttctggatctccaatctttatatctatttctacgtgggtatgactgtatgtgtccctcaaaaaatttcaattcagttcttgtgaaccagagaactcttcaaccttttctctttttttgagacggagtctcgctctgttgcccaggctggagtgcagtggcgggatctctgctcactgcaacctccgcctctcgggttcaagcgattctccctgcctcaacctcccaggtagctgggattacaggcatgcaccaccacacccagctaacttttgtattttttagtagagatggggttttgccatattggccaggctggtcttgaactcccgccttggcctcccaaagtgctgggattataggcatgagccgctgtgctggccaaatcttttttttttttttttttttagtaaaaggaaactaaagttacaataaagaaataaagaaacttacattttgttgacactaaatggcaggtttcatacaaagactaatcttttttattagggtaggaataattattggtgactttctctgccaattttccaagtgttggtaatacatgttgttactttttaaatgtgtttttgttacttttaaaatgaaatgaaaaagacatataaattatagcatacatgtctacccctacatttaaaacaatatattcctatgataaggcagaaaaattaacctacccttccctaacacaaacttccctttaatgcctgtggccatctgtagatcctgtcctctgttagcaaactccactcatttgctttttgaagttgagttcaagatcctcccatctcctcacctgccccgtcacccacatctctgcattactgtaggctcactgcatgtgcccttcatctgacattgaatctaggctgtcttgcaacatttctgatattactgccatttaatttaactttttatatgcattgccttttttttttttaagactagtcaagtgcagtagtgagaaggaagaaagagtggaacaaggagttcagctgtaattgactaaggtgactcactctgtggaccagcctgcattgcctttctggctacattggtaagtatgttaaggagagggacaaagtcacttgaagtttttggcctcggtttcctcatctgtaaaatgaagggaaccaggcctccgaatgttgttaatccaacacctataactctttttcccaaggttgaagatccccagtaatatttcagcttgctttcactcgatgttaatccaacacctataactcttttccccaagactgaagatccccagtaatatttcagctttgctttcactcagtgttccctgactcagagatctcaaaccctaagggagaggcagagtgtccttcagtcttgacgcctgggagctgtggatgcctcattgttgctcgtcttgcgacataaaataacagcatgctagtggccaaaaggcatgaagtgttcaaacttattcaaagttcaaagtgttcaaaccttttatgtacatgattctttaaaacgagggaaaagggaattgctctgttctcaatcgactgtgtctgagttcttaggatttatattagatccacactcccccccaaattttgaagatggaatgaatgtgttttctcctatatttaccactcaagttttttctttcctacatgctgactgtttgtgttatggtcattagattctagtactgaaggggttttggtttttgcctttgttctctgtgtgagctatgcagtggcttttgtgctgaaggagggagctcccgtctcatcagtttcagaacttgagtgatggattcgtcgtggctgctgatggtaacggtgggcactggccagcctgttgctcatgcagcgtgggaggtgagcgggcacagtgcccgtggagaggtggtgctgcctgatgagcttagggaaacccggtaaacaccgatgtgctctcccagatgcaaactgagtcacatccctgtcaggaaactgcaaataaatcgtgtgcaaaacggaacaaggatcctattaattaatttgggataactttattttattttttattttttttagagacagggtctctctccattgcccaggctggagtgccgtggtgtgattatggctcactgcagccttgactgcctggattcaagggaccctcccacctcagcctcttgagtagctgggagtacagatatacaccatcacactcagcaaatcttttcattttttttttgtagagctggggtcttgccttgttgcctgggctggtcttgaactcctggcctcccatctcagcctctcccatctcatcctcccatctcagcctctcaaagtgctgggatgacaggcatgagccactatgcctggccctgacatgagactcttaaccaggccattttacaaccaatttcatgcattctacaattaaacaagatagtaattgtgtaacagatctagacaactttttcatacagatatttattttcccaagttcaactagggctagagcggtttgtagaaatgtataggtctaaccaatgcttcagttcacatggtctcttgctgtacagcaacagccaggtgagttctaagtgtcaaagtgcccacaaaaactgcagtgtaagtgaagctaatctttggtgtctaacatatttttactgtgtattcacttcccttcatctttttgcattattttctgtctcaaagcaatctgttctacatccttccccatccaaattcccaacatatgttggggtttaggcaataatatttgaggcaatcgtagaggaatgtccaaatgtgtttgaatgaggggctgtttaacctcatgtagagctatttgaagattcagaaatgtacttctgaagcccgggtctgtctttaaaaggccagacttggtatatcagcacctattcagcacacgcacaagctgcccaacaccacactcagctgaccgtgctccccgccacctatcctctccactgatggagtttcatttttctatcaagagcatcaccattttgcttgtccagccccaaaacactgacatcatatttgactcataactcctcctactatcctcatgttggagcagatcctactgatatgaacagaagccagagaaattctaggcagaaaagggtgattccccagcaaaaccccaccctcaagctgaaaagcctgaaaccatggcccaaagtgagaacttgtatccctctttacccgctaaaatgttgcctttcctaaactacctataaccatgccccaccccatcctgtgcccataaaaaccccagacttagctggtaggtgggactacagatgaatgtcagagagaagcagcttgactttggagggacagcttgacggcgtaacttcggagaagaatccagccagagacagctggattcaaggggaagactacctacctgcccatcccctgttcagctccccttcccactgagagccactttatcggcaataaaatcccccacatttatcatccttcaatttgtttgtgcaacctcatttttcctggatgccaggcaagagctcagaagccaccagtgcaaatataaaaggctgtcacactggcctttgccctcgctggcgggggtagctgcctcatgcgaaaaggcagagggcccactaagctgttaacacttaagccgcccgtggacagcagagctagaacagcactgcaacacgccctctggggctttgggagtcacaggcacccccacctggatgctcgaacggggactgcatggagttcgctcctgccagtgccaaagcggccagcgggttccagcgctcatgcacgccagcttccactctgcttgctggtgcactccctcctgtgaggagttgagaggggcaggctgagtaaatgaggcacccccctcgcaagtgccgtgaaggggtcaggggaatatcctgcatcgctactgtctctttaaaatctctccagaacctgcacacctctcatcaccaccttctgtttaccacctaacaccttagtctagctttccagtaaccttatggtttttctcccttcctccattgacatcacctgcgttccactgttcccaaagtatccagagtgatgctcaaacatctgagagacatcaggcattctcctattcaaagccctccagtcacctcccatctcccctcctttgctggccggcagcatcctctgtgtcctgggccctcactgcacctctagctcatggctaccactcttcctctttgtcctccagcctctaatgaggctggctacctcgttaagccttggacactccaagcccacactgtcctctccctggagccccaggtctctccttgagttcttcagatttatgctccagcacctctgtatcagagacctttcctaactgccccatataaaatgcagtcctccatgtttcctttgtcttttaaaagtttttctgcagaacacttcttatcacctctcatcttacgtgtttgctttttatctctttcccaccacaaggattagctcagaagagcagagactttcatcaggagaacgtgattcagaggcaggaaatttaatcatggggtggaacctataaggacgttcagtccacgtactggcatcgtgtggctctacacagggtagttaggggaagggatgagtattacaagttgctgaaaacaatatatacttttttcctttagcaaatgcaaagaggtagtcagcttcaccacttaggcaaatgcagaaatattgctgctgtggaaaagggtgcaagagaaagtcagagtgaaacaaatcggtgctttataatttagtgagtagaatctgtaatcattactataatttaatcattactatcatttagtttcccactgtcatgatattgcagcctggtacacattaatattgccatatgttcatactgcacaccattatttgcctttgtcgttttgtgtgaaactagacaaacatcacaatctgactttggactctgaccattagcattgatttcaaacagtgctgaggcaattctgtgaaatatggaatcaccaccactacacaggatcttaaacttcaattctagaaatgggatggaacagctacccacctatccttaagtataatgaaaaaattactttcctggtgataacataaccttcattatttaagtggatatatggttgattttctatcttacatttaatttccttgggttttgttaaaattatgaatgatgaggcattgctttatcaaaataatacatttgcattttaacagattttcttccattctttctaaaggagtatctcaaataatgggaggagtcagcaggctagagtgtaggatattttgcagcagtgtcttgctttcagcttcacgtcatcccattgctccctcagccagcctctgaccctacacttggtctataccaggtttatatactgagtttcatggatacacttaggtggcattaagtagaataatggcagatgtaatgtttatataacttcacttaaatttagtttaggcttttttttttcacctcatcaacacagaaaacctataacctaaaatttgtgcagaaatgtgtttcacaacagcaattaggtatacaggtgtattaatctgttctcgcactgctaataaagacatacctgagactgggtaatttataaaggaaagaggtttaatggactcacagctccacatggctggggaggcctcaccgtcatggcagaaggcaaaggaggagcaaagtcatgtcttccatggtggcagacaagagagcatgtgcaggggaactctcctttataaaaccgtcagatctcgtagatgtattcactaccacgagaacagcttgagggaaaccacccccatgatccaattatctccacctggccccacccttgacacatggggattattacaattcaaggtgagatttgggtggggccacagagccaaaccatatcaacaggcatgctacctaaacctctcaaatcatttaaaagtttcacttatcttcagaacacatgagtctataaagaaataagcaactgtgttttgggttataagttaaaggcttgtaaatcattaaaaagaagaccactttaccatggcatttttcacgacagattttttaaaaatatcaacattttctcattaatctccatgaatttgtttgcaaagaataaatttacttaatcattagctttattctgcttttggatagcatgactaaataagttgcctaaactgaaagagtgatgttaagactaaaagtagaagttatcagtatttatgctgatgtaacaggcataaaatgggattatgccaggcaataaggcgaaaaagagatgatgtaacaaaattccttctattttgatattaatttagtctccagcaatttatagcttttctctccaagaaacaccactcctgtaccccaaggagatagtaaagttgagaaaagccctatgaaaaggccaaaggaacagacacgaaataaaaaataaaataaatatttagtttaaaaaataaaaagaaataatttaacctagaataattaagactaaagaaacatgagactgaaaatttaaaatcagaaaaaaactggtaaagttaactctatttttccctaagccctaacttaccaggattaaaagacactccattatatttcaaaattgtttttgatagaaatagattaaaaagtactttatgtagcgagtagaacatttctggaactcaacaacttgaaatacaacagaccaaaaatgtagacagaatctaaatcctttagaaatatgcaggagtgacagctccatccatgttttcctccctcgactacaagtggcttaaagacagaggtcataaaaaaagagtgaaaactactaaatgctcaatagataaataataaatcttaagtgcttaataaatgttgctggaatgtgtaacagaatattctgaaaggaaggctattcttaacagtcatgcccactgtgccatgtcctacaatgtgactgctggagagagattagaagtaacatctttttctatggcaagccacacagtcagagacctaagagaaagtagtcctcttcctcttctaataaatagaaatagacagttcctatatcatcagaggatttcatagaaaaagtatttcataacgaaggcttatgatcctgattatgggctacttttaagaactgtggcatcacctgctgctcaactcccagacagagatgggcgtggtctcccgtaacacctgctgctggggcaggctggcgaggtagtcaagagtgtagatgctggagccaagccagctttgtgaaaagcccattctaccatatccagatggatcacttcagaaagtgacttatcctctctctgaacctgcccacatttcctcctctagaaacagggataacaacggtgccaacctcctggggtggctgaaggacccagtggatgcgtatacacgaagcacttagaagtgagtctggcaggtactgccaaaaatgtgactcctgctgctattaaacaggggatgttgccttggcaccgacaggtgtgactagcggttgaaatatttcagatacggggccccttcttgccttggtccctcattcaaatgaattcacgaatcaggttttctcttgtataaatgagttttttttaagggcgtctactaaatcttggtttgaaggatgaattcttctgggctcacatttgcttctttactccacagatggtggagtaaaatctgtgttcattgcaccttccgctggtgctttaggctccaggagcagcagctccctggattgagtgggagccagttctgcctgactggtctcaccagcacaccagactgcgcaggcgggtcagaggcccacggggaggaaacatcagtggagggaggatgctgtgagcggtccacccctgcatgacagatgtccctttacagaaaagaagtgggaaacagactttggcaaagggaaacggcagagtagcaagatgattttgattactagtgacatttaattgcaattagatttttaaccacaaccaagaagatgataaagcttttccatgtattttccataaaactgtccgagcttaggacactttagtgctcattcttcctgcaacactacccaccacaggttcactgtattggaagtatactgagaagagctcgtggctggcgtgggagcgccgctgtcttcaaacctggaagtgaagtgcacccacacccagccacagcagtgattccccgggagcgaccttcagggagttgctaggagatggccgctctgtgtttcctttgattatagggcataaccctgccactgtcaaaatgccagaagaaaagggcagtgattgctggacataatttttttctgttacttcctgtgagatattgttttgcacaaagggaggagactaagggagccatggatatctctgtagcagaaacatggcaactattatctgaggaaggccgacatcctccaatagcgatcctgtgtgcaacgcgtattatttgcttcttcaaattgagtcgtatctttcagtaatttcttaagacgctagacggtattacacataggcatggggggtggcttgtggtttaaaagcagggcttacacatataggtagaagccgcatgtggtcaaaggagataaagtaccacaaactgaggagtgtagttagctgggcgccctggattgaggtaaagtagaaaaagactgtgatacttctgagcccaagacatttcactctgccacactatctcctgtatatgcagttattagatagacaattctttttccgtgacagccaatatcaggtagggcttaaaagtcacaatctgggtttacaacacaactcttctgcttattagccgcatgacctggggtgagttactttctctctctgtgccttggtttctacaactataaaaccgaaatacgttacagtaagcacttgataggatcaccgtgagaatggaatgaaatcatatatgtatggccgggcgcagtggctcacgcctgcaaccccgacactttgggaggtggaccacttgaggtcaggagttccagaacagcctggccaacatggtgcaaccccatctctactacaaatacaaaaattagctgggtgtggtggcgggcgcctataatcccagctactcgggaggctgaggcaggagaatcgcttgagcctgggagacaggcgctgtaggaagccaagatcgcgccattgcacttcagcctgggtgtcagagtgtctgtctcaaagaaaaaaaaaaagaaaatatgtaatatacttagaaaaatagctggcgcagaacaaatgattacagaaatatgagctatcattttcattattattattagcatcataaacattatttcgttgtgctctgaatgcagctgaacagtactcaagagtttcaggatcagttgtataaaattacaaaaaattagaaggtcacccatcttgagaaaagacaagtttgtataaacaggacaaactactgaaagcaggagagttcaaggaagccaagagaagctgagaaagttttcttaaatctgctgtcttgttggttgctgatcaccacctcattctccatgataggtgcacagttggcgtacaggttacctagggctggatactgattgagcatatcctgtgcacaaggacacctatgtttattccacttagaagtctgaggttgttctgaatgtcaagcaacaaaacaatgcacttctttgggagagctggggcattccagattctggtcattaactgggtgagtgtctttaggcatcattccacctttgtggacttctgctccctcgtttgcaaagtgagagagtcagacactcaggttatgttcccttaatctccacctttaaaaaaaataatgttctgatctaccttcataagagcagttgtgtgccttaattttctttgcaggtttgctctatgcagacctgtcatgtggaaactcagagttataaattagaaacaggtaaatgatttatttttgccctgcaaatgagtcacactctctacaagtggattattaaattccattaaataacaagcttgcccaataattctaaaatagaatctggttttaaaaaaaaatcggtgtacctgttctctgttgtataaagaaaggtatgtgatagcatcgttaaagtatatgttttagaaactactctggcaaataattttcttagagagaggttaccgagaaaagagaaaagaaaaatttagtttttctggcttggagaagcagcaagtaaaagtcacagctctggaaccaaagcaagaaagctccttgaagaatgaggtaatcagacttgccggtaggtactctcaaaccagcgtgaactgtacactgcaattaattattaaatgtgctcaggctaggtcaggctatactaacagaattcagacacgtttttctctccagcatttggttatcagttttgtgacatatagagtaacagttataaggatcagtttctgcaactccatccctcaacctacttttttattgtaaatagactgaatgtggggaaaaggcaaagagaaaaagtgctatgcttcaagaacatttgtcttgatattttggtggcaagcatcatcaaactaactatatttggctctgactagcttagcatgagatgttagtttttagccgcaaatgagtagcacttgacaaggtgagaaatcttccttcaattgttgaaatcatccaagacgtgtttctaatctacattttgaaaacaaaagccctagcataatgcaataggaattcttcttgcctgtataactggattctgctctagggtcttgtgggatggttattacacatggcagagaaagctacgtgtcctcttgcacccagtccctcttcttaatttataacggaagtttcagctgaacacatggctttagccaggctaagattacatttttcagtttcccttgttttatcaccaaattttgaccagtgggtgtgagaggaaatgctgtgtgcatcttccaagaggctgtggccttaaaggcaagaggtgccctctttgcttttccctttcctgctggctggaacgcagaactgatgtcaggagctggggcagccctcttgaccaccaagggaagccatgtttagcgctgagaaagacagagcaataaatggaaggagcccaggttcccagaattgtgaagcctccgtactagccttgcaccaccaatctgtacttttacatgagtgagcaatacacatcttttatgtttaacctctgttaatttgaatctctgtaacggcagctgaggttttatcgcaataaatgtattcccacagtcagaatccagacaatttcaatagttccattttatatttatgtataatcataagaagaaagtccccaattttacattaaactctgtattccttctaactgtcttgggttgagtgacacggcggctattgaacgtatttctgtggcactgtaacccagtagatcacacccatgcaattgctttctcttccttaggcccaggtcacttcacctgcacctctttaaagactgtatttcctttctgtgtccctccctccctctctccctttcttccttccttccatgtatctaagagattggcctgggcctccggtacccaggtgctctgccttgtgactccatcttatgtgaaaactgtgccaggtgctagaaaacagtttgcaaattatattttggtttggagaccttgaggatgcatttactgaattttttgactggtatttacatgatcatctcaaagaatgaattgcagttttttcacagtggaggtactgataattcaccccttgaaatgaggccgtgtgggatgagcaaccttgaaccaggaccttaaaagcttagattccagccacggctccgacacaaagtgacagccgcgtgaccgtaggcccatcgctctgtctccctgggcctcaatcttctcacccttgcattgggaatgatactaaagttcctcatccacctgcctcatgggattgctcagaggatagtgtgagacaatctaccacaaagtacaactgtgagccacttcctaactcctgctttcccacctattcttttttttttttttttttttttgagacagaatctcactctgtcgccctggctgtgatctggctcactgcaacctctgcctctcgggttcaagtgattctcctgcctcagcctcctgagtagttgggattataggtgcctgccaccacgcccagataatttttgtatttttagtagaaacggggttttgccatgttggccaggctggtctcaaactcctgaccttgggtgatccgcctgccttggcctcccaaagtgctaggattacaggcgtgagccagcatacccggtccccacctactctttaactatgacagatgtgaacgtttgatctctttgcagacaagatcagcacggtgactgggtctttgccctaccttcctaagcaaatgacagaactggtagcagaactggagcccctgaagcttctgcaggcaaacttcctggagcagcccaagaaagtcagagcccctccttttcgtcacattcagttggaattttggaaaccaagcataatggagaaataacttttttggtatagccggaagatgaacccttgggcacagtttcaaagtcaaatattttactgtaaagtggaagaagaaaatacccagatctttctgcatagtcaagtggcttatgttttgcacgcattggaaagaagggaaaacaaaagctgtcttagaagacgaaatcaatcacatgaggagtggcactgctccagagagctgaggtcttcctcttaggaattacagactttggttccgtataattaggccctgtgttgctcaacttccaaataatttagagagaattatcatgtgagagtgcacatatatacatttttttccaaaacaaccttctcaatatgtagcaaaatgtagtcaaggaagaaaaaaaatgagaagttctttagatttcagccaaaacaatcacttaagctccaagtcactatataaacaccattaatacctgttaaaaggtcgtgaattctgtaagagatgtttggaacaaacagtgcttcagaactacccacaaaaataaacaaaaaagagatcatattatgtcactgggtccagacaggatgatgaaacggctatgatcacgtataagctttatctatctttccagagaacagtgtcagggacatatgggttactttccaaattttgtttaaaaaatatgaaaaacatctgtgaaattctggtaagacaaaaagagtttctaattctttggatcgcaaaatgattcttcagttctaattagctatgataaattatgttaattctaaattattatcattcatgtgggcatttaatttaaaaagtggcattatttggaaaacagtctctgcaatttattctaatgtagtttaacacgaagcagctacattgcctttttggatattttcagaagtgtgaaaactgtgaatatcacttcaggctttgcagaatggtactctacaatgaatctgtgtctggcatctgattggtgataaaaaaaattattgggaatagattattagttattctgagacagaattttgagaaacttgttgaaagagtcttgtttgaagagcccataaggaacctcctccttcacacccatactctggctaagaatgttgactcttttttcttaattaaaggctgaatcactgataatattgttgatattaagtgcctactaaccagcagcatgagcttttaacacttttaatgtcacccaaaagcctacccaaagtgcccaggaaaataaacagttttctaagattcagtataattttattttgttttgtagctaaaatgcgccagagctgtattcatgtcatcacagtgggaagaaggcaaacatctgagaaattaataaatcccacagccgatctgagctgtcacccaaccccaaagggcctcagtatctgcatctgtatatggggataactcagttctccagagtttgtaacaggcctagcacagtgcctgcacatgtaagagctcagaaagttatttgtaaattagtaaattaatttataaaattgtaataaatcaataaccattaaaaaaaaataaaataaaataaatcccacagccactaaaagcatatcgtatttggggcacaactctggccatagaggcaagcacctgacataacacagatggcttcttgctggtagcatggtggcaacttcgctgaaaacacagagacaaggactgtttcactctgtctcccttaagaactttgaaaacagttttatgtctttggagaaggagcaccaatttagcttgcatcatggatcatatagaacagggtatgttttaatgtgctaaaacctaagcaatgtatttaacagagcaatctatttccatgaggttcgtgagaaaataattcagaggctctaagggaagttgggagaagaaaggacagcccgtaccagtgcactcaaatagccagaaagagcagagatgctgattgctccaagcagtagtctgagtcttattctattcatttccttagagtaatttccagtatttgttaaggcatacagaatttgggggcttgaggtagggagtgtgtcttatccatgcttggaaatgtaacagcttttgaagttttgtaatgtttcttttttaaagcaggcatctttctagttccactatctctgtggagttgaggaaagaaagtaattcatagacacagggcagcacgctgacctttcttcagtgaacgtcaaggtcctgggctcataagggaataaggaagaggaacctcagtatattaatccatgggctccagccacgtggcagctacatattttcaatcactttgcttacttcaaacttttcttggtgtgccatgtacattaagaacagataactaagaagcaacccttctcagtgtttttggcatctactgatcagcacctgacattccaagttatttcctcctctactcggcatgccgatttctgtactgttgaacagcaggaagtgctttcaagggtctaataaattagcctttcgttgtttcaacttccaagtgaagttaacaataaaagaagcttagtatgaaaaagatccagggtttcttaacctacctcttgtttcttattttctttcagtattggcttttttttgatgatgtttgggtgtttggggagtggaaacaccataaatttgatcttaagctgtgctgggacaacttttgcatgtttttattgaatacttgggatattccactgcccagagagttaaaaaaaaaaaaagacaaaaggatgagcagctagttaatagtcttcatagccaccagttatcctttaatctagtattttctagagtgctgtgatatttgcagaattaacccacaaaacagtatcctatgggccaaccggtgatgagactgagtttgcctttgagaactccggtgggtgttctaacctaactttcctacctctcttcactgtcatttatattgttgcctgaggactcttcctaatacctagccaaagtatggggggcctctgctgtctgagaggtcaacttctaacaatttagtgtgacctcaaggccaccccatgacctgactccattctcctttttcactctcgtcttcggccacctctctcaatttgccagactatctgctctccctggaatccaccatggacgctcatgctgtttcccgaatctggatgtagaatttccctgacctttttatttacaaaattctacccatctttcaagattttccttttcctgagttgattattctttgtttctgtgttctcaaaacactttccttgagcaatgctaaatactagtttccttcacgtctgtttctctcaccgcagcatctgtgagattaaggatagtgtctttttcaccatttatctctcactgctcctagttcagcaccttgcatatctttcatgctcagtgtacttaaaaacaaaagaatcatacataagacggtgttgccagtttatcatttaatgaagaggcttttttcttttatcaattatggtaaatctttgactagttcaaaaagggatttaggcagatctatttttgagcatttctcctgttaatatttatattgaacttcagccttttggggtcaacagctagaaaccatcacagcctgctataatccattagttacaaaaggatggaaattatcctgcaaaaagcgccaggctgcagaggttcttgtttggaattattacactgctgttggatattctaactacccacttgtgttcaaaggagaagcggcatttgagaaagcttctaaatgtgggttctgccacctaccatgtagaactctatgccagtgggtcaaacatacttgccgtctaatttagcatcccaatatagattctagcagagcttctttgacatagctaatctctctgagtttcaatttcctcacctataaacttgggagtaacgactttgtgtggcaagaaccccaagtaattaatcaaaattctaactttgtgcttggacatagggattgatcataaatgtgggctattattgtcttgatctttgtttttgctgttgttcatatagtacttattaatatggcttctaatttcaggtttgtcatttctgtcgttttaattttattttatcaaataaattatcataataatcttttcattggctctcctgtccctagttctccccctaatattgatctctctccttttaattccaagctgcaattgcaaggctaatattttgaaaggaacactgacttcacattatctattaataaattctaaaccaagcccaacacaacatgatcctaacctaattttcaagaatttattttccttctcagtttttttttgttttttagtcaaactgaactttttgttgctcctttttttgtacatttcatgttttagccttcatttgagtttaattagcacattttaaccagatgcctacattgtgtcagatattttctgggtagtaggagtgtcaggataatccaaaagaatccctgccttccaggagcccatgactggtgtggcgaggcaggtgtgattttgattcatcttttgtgagatgttttattcgttgagattacctctaattactcttaaaattacacacagttttagaagtccatctcaaaatagtcccctatgaaaaccacataaatccctctcactcatttaaactaatatagttccttttctgtgccacttcatcttgtcttactttatgttatttatgttggtgttttcttgagggcagggatcatgctttattcacatctgtgtctttcatcgtaccttatgtataacaggcttgcaataaatatgggttaaatatcaaaggaatgtaatagtacaatttgactttaaatagaataataaccaaagttttcagggaccatttttcaaaagacccattcccccaagatacttaacctacaatgcttactttgtataagctctgttacttaagctaacaaacaatagttctggaaacctcatatacagaaacataaggatatttagatgtataatatattatatatataatatattttgttacaccactagacttggcttgaatgaaccagaatattgcttgcttatttccttgatgttcttttcttacacggtttgttctacaaatgtataaatattaatatattagaaagttatagaaacagatgaaggaaaaatagacacaaatatagtatggaagcctggacataaaccagggatttcagaaatagaagctatggagatgcatccgggaggagggtctgttttagcacatttgggcatgcatctttaaataggagacacatttctggaaggaacatagggtcctgtgggtaaagtattgggttgccttgttttatatttacttgaggctattacagagaatcaactacagtgtaaagggagagcaaaaccaagcgagtttggatttagggacattaagtacgctttgaacagatcagaagccctggacagacgccaccacaaaagcagcagcatctggaagtacacgtgctcatctctttgtattgcttggtgtgatttccatggctactaaacgagtcattcacttcaacctacattgatgtgatcaaaatagtttcatcagagcaaattctcatcccctctgaagagtggacagattcttaaggattgtccacgtttgtattaacgaccctattgcttatgccgtcacaattacagctaaccagataggtgcagtcaatggattttgtcaatgatttaccttcaaagtaacaatactcacatacaagtagaagttaaaaggatttcaataaatttggtaattgactttttaactatacgtttgtgtcaggcatttatacttagcaaatcttatttatttcaatgtatttgattgttctgaaatcagtgacaggttaataactttgttatcagattactaaattaagcttttatcagatcatgtttacattaaaaaagaaaagcctgaagacattattaacttcatttcaacaagcttctgtaaataaataggctttcattaggaaaccagccctatttatcaaggttattaaaccattttgtaacaaaaagcatgatttacaaaaatgtcccatgattaggcttattttattttgatacgaccaggtttgctacacattttaacataaatcaagataaacagcttgttcagaaaaaataaagcttcagaaaaatgcaccttaatcactgttttgagttactgattaatgtttgtccctgaatctgctccagacagattttatgttttctttgatgactttcactggaatatggttggcttttatgattaaacccatccttatggtataatccttgactaggagttagacattgaaaaacacttaaaactatacatggtcaatttcttataattgatttttttcagtaaactcatggagaataacttttgtggtgattattagaatgttcaaaaacatatttctattgtgaaaacccagtgcttgctttctgagtctgcgggtctatccagcctgcccaagaactcgattcagctaaggttctcccttccattatggagcctggaaggttttatgcaaaaccagtgactgtgctccccgagaaagtccactgagtagcgtgctggacagaacctgaccaggactccatgctttcaagctctggttctaccgtctgttacttaggcaaatgttttcacctgactgtagggttgattaaggcttttggcttgccccaaaaacccctgtatttctggatgggaatcagttggaagtattttgctagggtcctgtctttgccattccatctagctctagtaatcttgatggctcttatctcttatgctctggatgaaaactggtaatacttctttctccatttgttttgtgtaagcatggtggtcggtaagatgatttctggtgaagcagcaaaaccacaggctcttgtttctaaatctggttaactgaatgccttctgtgttcacctgtcatcacaaaaggatgcgcaggagcactcattattttaatcggagtcgttcctaattctaaagttaatcatggcgattctcagatcagggagaaaattaattaagatgcaatgctattttcttctctcccagggtgacatctcccaggtttctcattaaatcgcccatttagtgtttggtttcagtgctttggagccaggcagaccagatgcaaaccccagctgcatgtgccatttgctccctgaggggcagagatgatggccttgctgccagtggcatctccagccctggaactgtgctgggtgcacacgaggagccaaatgcatgttttctgaggggagtaagtggaagaatgaatgaagtcagcccttccatctcttcttccttagctgtcaaataggatgacaaaatacctatttgccagtggttgttgtgaggattaaatcatagatgtaatgcatttagcacagtgaatgggcacatgagaagaattctataaatggcggttgttcatcttcctacaggaagggcagatctctgagtcatagaaattgcttcttatttcccactttcctttatttccttatgtggtgaagtataagttccactggtattcaacaagtaaaactcttgttcagggtaatgtgctactaacttttaagtctgcatattttaaaatgagagaaaatctagttttttcattaactttctactcatctctttctgggcccgctcagcaaatccccggtttcagaggactgccctgtaaggaactatagacagggtttccatccgtatttccattttctgaataagtaacaaggggaactagactctcagggcctcctctgcctgcttcgtccttatggagctgatgtggggagaacactcctcactgtccagtctagtgatgaccacagttctgtagccacgtggatctgtgtactcgaggtcagttagttccagaaaatcatccagtctaacatttgctcagattccctaatttctactctgtgaaagacaaggaatagtacagctcttcagtttcctgggggagtgcttcattacttttcctctttttctttctacttagtctaatgactcagattccagatggttctgcctaagtttagaattatcatgatctactttgtagagagaaaagaaaacatttcttgtacagtacaacttatgtaattttttttcagggaagtgagaaaaatataacacgcagtgtagaagaacttttggctctaacattagatatcaatgtttcgtattctgtcattggggtgtattgtaatttacttatttactgtctaattccttctgtagctagtgaagtttacattttcttttttctttttttttgagatggagtcttgctctatcgcccagactggagtgcagtagagccatctcggctcactgcaagctccgcctcccgggttcacgccattctcctgcctcagcctcccgagtagctgggactacaggtgcctgccacggcacctggctaattttttgtatttttagtagagacggggtttcactgtgttagccaggatggtctcgatctgtgaagtttacattttcaaagaatgttttaatgatatggaaaaatattctccaaacaatgatgtgcaagtacaaggtacaaaccaggaaagtgtaattctaattttttttttttaaaggtcaatatactttcttttttttttttttttttggaaaagaaatattcctaataattcatttaatcatctggagagtgggttgaagttttgtaaaatttaatttcttcattatagactgtattattttaataaaagcttttctttggtgtcacccattgtgtgcagcactgagctggggccctggagctctcactattgtccatctggccgcaccactgtcagcactgctttcaatgaactgtaacagaatactgatgactcagcatttctgctgctgacaggaagtccttgagcgagtctctttgtagttcctccaagaaaggatgctcaggcactccttgggtgaacagctgcaggccatggagaggacaaccgggttgcagtagtaagtttgcactgggctatcccagagctagaacaagggaacaggtcagcccctagagtcccagaggtcacagacttgggcaggtccaggcgttaaatgcagctgtgcctttggagctggacatccaggtacctggctgcctgctgggaacaggtgagtatgtatcagccattgtgaagcctcaaaaggctgcagcctgacgtagctgcagatcaggctgtacccaaattgcattgttactgatgaaataattttttaaaaaaccaatggtatctatttgagcattttcctcatggacaccattcaacagaatgctgttctcggggaacaaatgactcatgcaaatgactattttctaggtttttctcatggtcaagcagccatgatctttttatagctttattttattttaactcagtcccaatggttaatttaaatcctttctttctttcatcaatgatacaaagagctcactttactacagtctcatcttgacagagtcaaatgcagaggctgtaaggctgcccacctgaggaggaggaactggaacttaggaaaacagctcagatgcttcatgcaaatgaggaagctcaattggcttctattgaaaatacctcacgcatcattttctcttgtctctacttgccaaaatatttataaaatatctttgccctgccatacctaactaagcctcttggaatttattttttcagtgagattctctgatgcaataaccaagcactggcttttagaaagtgttctctccccctccctccctccctgcctgtctctctccctccctccctgcctgtctctctccctccctccctgcctatctctctccccctccctctctccctgcctctctccctccctccctgcctatctctctccttccctctctccctccctccctgcctatctctctctctccctccctgcctatctctctccctccctgcctatctctctccctccctatctctctccctccctccctgcctctctccctccctccctgcctgtctctctccctccctccctgcctgtctctctccctccctccctatctctctccctccctccccgcctgtctctctctcttcctccctgcctatctctttccctccctccctgcctgtctctctctttctctctctctctctctctctctctctctctctctatatatatatatatatatatatatatatatatatatatatatgtctgtttctctgtctcactctagatatacaatcaaatcagtgtgcagatggaggacaaagagtatcacaaaattattattgtaacttgtggataataaatttcaaaatctgatgtctgtgctccaatatctgacctccttttttgcaaaatatgcacatgtgaaacctgatttactactgaggaagttaaccctttccttttgaaagtaatgcatcagtagaagatggaaagttcagtggagatgggtgatcttctcaattatgtgcatgagaataagtaaactcccaggcattccgtcactctccaaagtcagaacaatcaagaggacacatcaggctttagaaaaactcattcccttggaagataatctcaatagcatgtgtgaataggaagagcatcaaagtgtgaccgagagagtgtcagagaagagtcacctattacaagcatgatcatagtacttaggaaaaagtaagttccaggcttatgtggatattcatatagatattttccagggttttagaggttcatgatttctcagggagaccaaagtgcctatgtgactgtgaggggttattagtcctctgggttctggctttactcagaaatagcctggaccacatgggtcagtcctgccccacagacattaggccccctcctggggcccctgcagagtgggtcagttctgcagatgtgggaagggatgagtgttgggtttgggaaccaaaggctgtgtgttgagcttacagtagacaatttggagctgcttcttgcttagagatgacccaatatccaaaagtagctattgcgggcaagtggtgttccccaaaaaggtatgttgaagtccttcctcacccccagtacctgtgagagcgatcttatttggaaacaggatctttacagatgtaatccagttaattgaggtcatactggagaaaagtgagccctaaatccaatgactggtattcttacatggagagagagatttggagacagatccatagaaagaacattgcgagacaatgcaggcagagatgggtgatgctgccataagccaaggactgccagcaaccaccagaagtgggaagaagtgaggaaggattcgctgctggagccttcacaggcaacccggccctgctgacaccttgatctcagacttctacacccccacgtagagtgtgagacaatagatttctgttgtttcaagccacccaattggttgcactttgttgcagcgctctagaaactgatacagtggctcaaacagagcctctaggtgtctcttcttttgcaatccaaagactgcaccagtgctacttgaaggggtaagagagctaaataaatttgcttttggggagatagatttgggtaagtttctccatgctgagttagatgagtgatatgtggtggtggtaaaatccagataacccttgagtgtgatgatttcagaaagagagagccaggaggcctgggagccagcaggccagcgggggtccgcccactggccccgaaacagcgaacagtgacattggagcaagggcccatcccgtgcttctctggagccccactgggcagagccaggtggagaagcaggaaactgcacattggtgggctggaggggcttggaggggctgagacaaggtgtgtgcttggggataagggcgttcctggtccccggtgaagcatcagtgaccaagaggcatcctctagaagaggtagacactacatgggaagggagaagcagcatgaaggaaggcgctttaggacaaggggatcagttacagtttcttcgccatgtgccttagacctacagcttgctattccactctgaaataaggcagagtgaagaattcaaaaacaatcactctgggagaaaaaagcgagttctcttgatatccttgctttctcctggcctcatttcctctgatgttcccctgccctcttgcaaatcaatcagcctaaatcaagggtgtctgtgcaggttctcaagacagacatgctgctgggagtggcacgtacgtgaacgtcaaggagatgtcagggcatgcgcatattctttggtgcccaccgtcttattttcttaacttactgggaaatctttttgttagagtgcacgcattaagtttcttcctggcctcatcagccccaaacccaggcagtggcgggcggtttcccgtgaggacagcgtaccttctgaagaaatgcacccagatcagaatggtatacgagtctgtcctattctcgctctagaaaagaaatgtcacaataaataggtgggtggggtctgccccacactccccaaaacaaccaaaacagcggcgagatcaaactgaggacaacgttatcatcatatattcttttctttacacagtttgatacctacctacttctcagaacaaacaccgcggaaaggaaactgggtggatacttactgtttttagtttgttacatactacaattagtcaccattagctaattatatagaaaaggggaaattggggctgttttacccagagttggttttaggtgggggtgaagcaggcagggtgatattggcagcctcatggttggttttgctgattcagttcctctttccttgccccctatttcatacaaaattcctctgacaaagcttcctgtgtggccactggtcagcattttaatagaatggaagggtgcagcacagcaaaggccatagtgttaatatccctcgcatctgccgttcccacctcctccttgcttttccagtcctttccaactctgcataggatgatggggagaggagggagctaggaagggtgagaggcaagcaaagtcatttccagcattttaaagtcagctctcccaaaatgctctctctctccatagccttctccctactggggcttcaaagccttccctctacctgaaaccactcagggtgcaaggaagcctcttcaggtccccctcatccttgatcattacaccagctcttgaggatcctttctttctctaaatttggcaacaatcttctgttgcagactcttttcactattggaattccctttcagggactgctctctacaacttatatggctgcagcagcagcttatctgaccatttaaggctctacactgtgcagacagaaaaggatcacactcctctctcagacacattataagaaattttatacaaggcctgtgcattttcaaaacacaggattgacctaatgagcaggaatttgagaccaggtaggaaaagagggtcatgggatgtggggagctgcctgggggctggtgggaacttgccaggggtcctcatatcccttcatgagacagttgcctaatcagcctatttcaagggatggccctgatttcacggtgaaaagcaaggcatgtttctgcagatacgtcagtgctctaacagcaacatgtcctctgctaggaggacatcctaggagattcgcttccattgaatcagagtaaactatttttttttttttttgcttcttggcagaatattatttgcagatatctgcaaatttggtaggaaagcttttttttctaaatggaactatcctgaaaacaaagggaaaaaagggcaaacacacacacactcacacacacaaacaaacacacacactcacatgcgagccttcccccaaatccttccaagtcttcattctatttaagctgttcataaataatatctgatgataatctcattgaaaatgcatctgtttttatgttaatttttgttaatttgacatccctagacgatatcatgaaaatatttactgtgtgtacgtttgtgtgtgtgtatgtgtgtgtgtgggtgcaattttgtccccttagtccatgatgaattaaaataagtagtttacctatagataactaaaattctatacatgtcttcatgaagtttaccttatttaaccgttgcaattaacacatatcccagaaaaatctttaaattttatttttaatattatcctaatgttgctgagttcccagcaacacaattatttattgcagccaacatctaccatgcttactattacagcaagctcttttccaagttcttatatcaataacacacaaggcagggcctgtgatatttcccatttgtggatggagaagcagagccgtggacaggtgccaagtcacccaggtctcaggggtggggtggggtctccccacagacagcctggctcagacacactctccactgccgcagcgcgagggacccttgtcatcatcccacagagtttgccttgtcattgcttctgaagtgcttagagactgtcaatgaaggagcaatctcaataaactttgtggttttgtcatcctcagaaatgaccaatcttcatgaaggtggtgttgtgcaagcctgggcttctattaaaataaaaaagtgtgctttgcacctaaggcaatggtgggattaaagcaagtagcaaattgatgttctcatttaaaagtcttgcctggtctgtgagtgccctgggcctgcaaaggtaaaagaagcctgaccacaaagcaactgggcattctggaggttactgggcagacctgagactccagagaaagtaggaagagaaggcagattgtcagttaatgatggcggtgttcgtttctgtttgtatacttttaacagtctaaaaatggggcttcggacacaatacctttcctaaatgaaaccagtgcctgcttcgttacaggcacaaggtatgtactgtgggtgacatccagcccccttcagttttccagagtctttcctggggtcttgcttggctcagggccactggaacacaacccacccgatgacaccagggtgtgtcgagcctgtggtcaaggttcacacgtctgtgtgtgccacaaccactgcagaggggaaagacatcatccacacaacatcccaccctcagcagggacttggaaaatcaggaacccgatagtccatagttggggagactgaaaggttccccaaacaagcaaggctgctccattttacctaacaataccatacctactggcacggtttctccctgtgccccattgctaacatttctccttcgagttggcatgccaaggaaagcacagtgaaaaatgtctgagttccgggttgctcttagcaacatccatgaatctgagtttctaacctccttccctatagaacagtgcctgaaggaagaactggcaatgctcactggtgtcagaattgcccacgatttttcccttttcagcaattatttaagtgctccaaaagcattgcttccttactgttttcaaggcaagatagaaggagaggttaatcttgcttagaatttcctctgctttcaagttccaggttgggggtataaagaggtttgatagaaaagaaccgcagcagcccaggcctggctgcaggagaaagcaaagtggctggggacagggggtgtggagagcaggtggtctcccgtctcctccatcagggtcaggaatgtgtctgctcctttactggaaccatcgccctccctggatggctgtaccgtttagggaggcctgtgctgacaatacaggtgcaattcaaaagaaattccattaaaataaagtgggcagtggggagaaacggggaattctgtcatgaaacataaaacctaaaatactgtctggtcaaaacctagacagcctgtgagacccatgagagctcggagaccctgctttcggagcataggtggggacccgaggggtggggccgtgagcagggtctcaggccagccgtggagaaggcggctgcctctgcggggatgggcaccgcagcgtggtgggcagatatgaggaaggcaaggactttcccattgaccatgcaaaaccttcacgaagtcagggtctgtccaccgtctaaagatcgagacctcatgttgagttctgaggtaaaatgggaaaacagttttaacagtgcagtgaagcttcctgccaataagcaaacctttccaccctccgctcagctacagaaacacatttgggagctccagggaggaggcggaggggcacaggcgctccccagtgtgggccacgctcaggtgtcccttcacaatggcagccacactgcttcgtgaaacggacacactacgggatggaaaacagtgagagggaagccacggcatcaagaagcaataatcacagaatgtttttgtgctgtccacgccttcctcaacatctgcctccacttccaagtcaatcgagacagcctgtttatgtggagctttgagatgacacatacactttactgaccctagaacaataccctttccacatctaaagcaattttcgtgtaaatgactgtgccattaaccttccagggtcattcaaatattttctgagaaattggctgctttcgggattttcttagaatgccatgtgtttcatttttgtgcagaacagatgacaggcgaggcattccaacaggacttcagttgatttaactaattcctgtcaggggaagtgaagtgttgggattcataaagccgatcccagcccggagattttccttttcccaaaacagaaaaaacaagacatgctgtgtggttttgcaaccgggcaagtttcgaaatatttttaagctttctactttgccaagtatttcataaaaaaactattttctttttgtttcgtgccaaaaaatgtcacccctaaatattttttcccatatctggtcacatgtccaggattttttcttttctaagaataaataatttttctgggttataaaaattccacttgctctatcagattaaacatatctttatatagaaaaagcatccgaaacattccccaagtgggtctaagggaggagtcttaatacaattttgttaaattaattttgattaaatattaggccttgaattctttttgtgactctcacaaagttcaggcttattttgttacactttcaagtctccctttttttcactctccacatactgtttccttttattagaaagcattcaagaagaattgattggtgtgtttgaccaaaataatatgttggaagtgataccagtgcaaggggaccctctgggttccattctctatttgcatagttagctggagttagaaggttcagctgtcagggattcaagaactctagcatcaaaaaagtgtgaacttgcaaatgagctgtcaaggttcatagcaagtgaataatgcagctgagagctgacttgtctccaccctggtgttctattgatcttgctgctggataaagcataggcacataggaacactgaaaaatagcaatttgtatgggttggactggtattttcttttttaccagttaaaatgttaattacattcacaaagtcaaaaagctgaataaatagtcttacagttggaaatatagggcaaaacaaaacacaggcttgaaaaagcaataatagctatacacctaaaatgtgaaaaatattcatagagaaatgaattgtagggcattaactcttgcaaaaccaccaaaggcctggtggaattaatatgctacagatttgaaacttaacattgggcaacttaaaatgcatgtatttgttattgatatttaactaatccttgtaagtaaatctactataagcgaaaagcattctaaattgatgttattgctagtttgcagggaaattctgaaagtctatgtgtttgttggtgcatgaggggatgtgcgtattgaggtgtgtgttcaggatgagggcttctggtcctttagaaatggttccctctaagcttcttggtttccaaatcttcatcactctttttaaaatctaaaaatgcaggtttactttatatggagagcacattgctatgaggagatgtgacatttcagaaagagcacatggcactgattctgaaatgctaccaagttgcttcagaatatacccaaattctctcaaagattaatgatacactaagaaactgaaggacacagcaaattattttgcttgtcttcaacccactgtcaccctgccacaaattgaacctaataaaatttccatccctctcccatcttatgatatgacccttccccctcatgcatggggaaattgttatttacattgtgaaaatatcaagcatctccaaacacttacgttttgtggagccgggtctcccatggtaaaatgagagcccaacacggtgagtttgcttcctaggaatggcaaatcagcatcgcgatgccctcaaaccagaaataatacccttcatttgctgcaactggttgagtatcagtgctataaaaaatagatgatggaaaaccggagcccttgacagaaatacaagtctgctgtgtgtggcttgtgcaggaatggagcagagagaagcggtggtcttgtctacacatcatacttgggcttcgcccatgctgacaagtggaagcacatgcacagtggacacacgctgtcaggacattcatccctgctggcacgtaaacggcagggagctaaactgctagaattcaagtggcacagaaacttgagcctatggaatatcactgtggagtgggcaggccaagttctttacagtgctctttgcttttgcaaagaggtaatttccaactcaagaatgctctgtggctttggcgtcaagaaagctgaaagtcagtgaaatagagccttgaaggtcatccaatctgcgctgcagcaggaagtgaattttgggagccccaaatgcaaaataggcagctcagcccaacattaactcagcccaacactaactcagcccaacattaactcagcccaatattaactcagcccaacactaactcagcccaacactaactcagcccaacattaactcagcccaacattaactcagcccaacactaactcagcccagcaccagctcagcccaacgctaactcagcccagcaccaactcagcccagcaccaactcagcccagcactaactcaacccagcactaactcagcccagcaccaactcagatcagcaccaactcgaaccagcactaactcggaccagcactaactcggaccagcactaactcaaaccagcaccaactcaaaccagcacaaactcagcccagcaccaactcagatcagcacgaactcaaaccagcactaactcggaccagcaccaactcaaaccagcaccaactcaaaccagcaccaactcagcctagcatgcactgattctctggcatagactcagactccaaaaatatgtcgagaaagtctaaccaaaatttgcaaaattaggacctgtggtcagtaccttgactaaatatgactctgtctatgaacacaagtaggcataatgtaacataagacagtaaagaggggcatcgttagaaacctttagcattatgtcagaaagggcaagaggactcaagtagaagaaaggcagagagaataacagagggacatgcatgaaaagtacttttttcttcttcagtcctgcaattgcattaggaacagaggtcaggcccaagagctgccctctcctcacttttctttctttcttttcttttttttttgtttttttttttttttttgagggggagtctcgctctgtcgcccaggctgaagtgcagtggcatgatctcggctcactgcaacctccacctcccaggttcaagagattctcctgcctcagtcaccggagctaatttttgtatttttagtacagatggagtttcaccatgttgaccaggctggtctcaaactcttgacctcaaatgcccgccttggcctcccaaagtgctgggattacaggcgtgagccaccgcacccggcctgtcctcactttttatcacatactcctgctcttgtggccctgcttgaacacagcaacagggtctacataaaataaattaaaatacatttaaaaaaaaattacctgctttacttctggtccatagcattggacatacccagccagaaatcatacactgggctggtttttgggagccaactcaaatgcttgtcctttgaggtaagtattagggtgctcgtggcctcccgccccacgggtccttcactcactgaccctgacctgtgctcactttgtctcaccacctacatttcccaacagttcatgtttgatacagctgctggtcctgccaaggctggaggccctccccatccgctgatttgcctttctctgaaatcggcatcttggctcctctgcattatttctgattggacttgtctctctggcttgttttctctgctaattctgatgaagacgataatctctagctctcaggggccagccctggctacacagtttgggggtagtgttcaaacaacccttgagaatcttatttttcaaggctgttggctggcactttagggctaaagcaagtggtgaattaaaacacaaaacaaaacaaagcaaaaaccacaggcctaaataaacatatgcacccaggagcatgactgtgcagacagactgcctggctttgaatctcattgccaccattgattggccacttaaccttgcatatcacaagatgggaataataaggcacctgcttcatagattgttcttttagtcttctatccgtttgttcattccttcagtaaatatccatcgagcacctactactgcccagacatacggatccagaaatgtccagcacagattaagaggccacagcctcgtggattttccattccagggcatttttcttcaaggatccaataagatatccccctaaactatacatcatagagcctttgacacagtaaacactcacatgccattagctgttatcacggtaacaataaaaataaacttttagcaaaggttttaactaaatgaggtgagaatcataaataaagatatatttgctatagtgaaaaggagagaaaatgtaggaaagtcaggcaagaggaatatttgccaaaatcattcatgaatctgacacattagattctgggcgtgtcctaagccttgacctgtgctacttgatgtgggatttgcacacctgggacacacgagcttctgaagttcagactgtctgcactctatctgacacactccacagctgcacaacttgcagcatgagtcagcaccatcctaacctctaaagagccccgcgggcacagcgaatgcacctcccagccctttggacgtggtggcgaccagctggtttcctggagaggcatctcctttacacccatctgtgaaagaaatctagatctaagccttagatctcaaggttagaaagggggtaaggttgaggttccggagtgctactctattagacacattgtcctttttaaattatatttttacaataatttccatttattattttttcgtggcatcctagtgaggcaggctagtttgacaacatgctgcttaggggaaatttgctgttaataagtcttttgagctcactaaattttggtgcagcatgaaaacccagactgttttcaactctctctctggcatacccgcttgattcctgatagggctattaattttgcgcagatttcccaatttgctccccatttgctacctgggatggtgaagaacagacaaatagcccttcggaagcaaaagcagtcccaaaccaggctgagtttcgtgatggcttcttccacattgtccttcattgctgaggatgaaaacatagagctaaaaactgtgatacacaatgatttatcacctcctttccatgtacacacctagtagtttagaactctgttagcttcaaaatctattcagtcacattgcattcccctccccaactcccacaaattctacatgaaagagggttcaggtagcaaatgagtggaaggacagggcaaactaagactctgatggtgagcccctcctcctcctgattcagatgatttcttcctcctcttcctcctcctcctcctcttctggttctttcttctccttcttcttcttattcctcttcctcctccttcttcctcttcttctatcttctttcctcctcctcctccttctattttctttcctcctcctcctcctctttctcctcctccttcttcttctccttctccttcttctattttctttcctcctcctcctctttctcctcctccttcttctccttctccttcttcttcctcccctcctcctcctcctgtccccctcacctttcccctttccctcctctcccatttccactttcttccccttcttcctccttctcccccttcctttcctcctcctcttccacttccccctttctcttctccccctcctcctccttttcctcttcttcctcctccttcccttctctctttttttgttatttgatctccaattttcacttcctaaaatttcatatggttggatgctattataattattcaattacacaatgattacatgtgggctggtggttttgaaacaatgtaccccattgtatgcattattgcattcatgtggaacttgaactgtaggaggtccatgcaggcttttccagggtccccaagagtactttgtgggttttggatccaggtttctgtttcactaaatcagcatattactctagtctacagtgtactgttgggctagaaatagtccattgactattttagactctgcatcacgaaacgagatctatggttttggttgaatttcatagaagaatattgataaattatcattgttcagatcattaatcttctttagctcaaatcaaacaatgaagtgatgttatcttgcaaaccatgcaggcaggtggtggcactaatgagcctgccacatcggattaatctttgaatgttcagaatctcagaatgagaactttccacaaattcaaaactgtttgatgaactgacaatgtccaagtccaccaaatggtccaacattcagagatgaaattatgtcatgacataagaagcctaatggaatgaatggccactatgcattaaagaccagaatgtgaaaacctggctcctaccattcagacttccctgaaattgtgaaacatgattttccccttcaccctagggaagaccctctggcaaaggcacattcactaagggtgagccttcttttggattgggggctcagaagagagagtcatattgaagtcgcccaaactgttctttgccctggctgcccgctgactttgttaggcagctggtgctaaggagagggtaaagaaaacagaagacacttgtgggccggctcagggatggacagtacctggccgctctccctgtgtgatgcaggtggcttgttctgaggtaggtgggcatacaggcagtgagtacatctccattgcagcgggggaaggtggatgtgggactaatcagggatggagagggagggatgctgcaaagatgcccgagcaggtgctgtcagtggggactagggaagcagtgtctctatccgagagtgcatgccggtggtaggggagcaccaacctgaacatggccagtaagaacacaaactagacctcccagattctcccgcaagtaaggagagatcagggactgttccaatttttggcgttcatattttttagacagttgtcttaaaaaaaatgcctgcttcacttgcgttaagaattaactaatcatggtccagacttatgctcaggtagacaaggaggactgaagccacagtgggctccttccaacctcacatcacatcttcctcatagcacctgtgcacccgaggtgcagatcctgatttgatggcgacctattacaaatttccttagactgcaagcaatcacactatacttaatagctatatttagtagaatacttagattaatacttggagagaatttaaatttaaatattatttccacagccaaaagacaaaacagcaatagacaaatgcattctctttttagttttcttcaacggatatatttcatttttaagcctatctaccccctcccccgatttgaagacatccctcgggctacgtggggaggaaagcctgtgtgactgatcgctgcagtgactgctcttggccatgactgttactgccattttggcctctctgaaaagtgaggcagcctaagcctcacagatatgtttcctggtcacatttttgttgtctctacagaaagagaagcaaacgatatcaccaaagtcctaactctatcctcccactctgtgaactacagaaaaggaagcagcagaagaaataatagagggaataacaaagtgacagaagcatagagggaaaagcagcaggtggcttttcatcaaggggcctttgggtaagatttacaggagacaatgttttctctgcgcctctgggacttgaaaggtcatggaaagaggactcactcgcgacagaattcaaacactcgtagttgtgtctcaaagtcctccgcggacatcaccagaaggcatggtttcaggggtgtttttcagaagggcgatggatttctttggatccacgtagtctctcttatctggttagagtttcttctttttctttttgttcttttttgacacagagtctcactctgtcgcccaggctgcagggcagtggcaccatcttggctcgctgcaacctccgcgtcctgggttcaagcaattctcctgcctcagcctcccgagtagctgggactagaggtgtgcaccaccatgcctggctaatttttgtatttttagtagagacagagtttcaccatgttggccaggctggttctcgaacttctgacctcaagtggtcctcctgcctcggcttcccagagtgctgggattacaggtgtgggccaccgcgcccggccttatctggttagagtttcttaggtgggaatggagttagcagtcccagaccaggccaagttaggacaagctgagaaatgcatcctgtggttgacacatggtgaggaatacccaagcaaaatactcttgtgtgaggcttagactctgtaagaatctaccactttatgaagagactttcttctcccatctaccagattttccaccaaatttgttgcagccttgttatgggctgaattgtgccctcttaaattcatgtatcgaaggactggccccctaggacctcagaatgtgcctgtgccctgtatttgaagacagggactttaaagaggggaaaagttaaactgaagtcattagggtgggccttaatccaatctagctggtgtccttaagaagagtgccgggcgcagtggctcacgcctatgatgccactgcactccagcctgggcaacagtgtgagacttgtctcgaaacaaaaaaggaggaaatttggacacacaaaaaagacaccagacaccagggatgcattcatagaggaaaggccatatgagatcacagcaagaaggtggccgtcggcaagacaaggaggaaggcttcagaagaaaccagacctgctctcaccttgatcttggacctcgagcctggagaactttgagaaataaatttctgccatcaaagccaccagtctgtggtactttgttatggaagcccaagcagactaatacaacctgcaggctttaaacgatgaacaagggatgtgactttattgtaggaccagtaatttgaatttcttgcaaacgcttgagtgtaagcattagtcaatagtcagtgatctgactggaaagaagcagagggcacaagttcatggcagtgtgctcaggggtacctggcccctctgtgaagagccccatagaagacaaggcacttgggccctgtctcaggggcagcacaagcttccaggacaccaccgtcactggtcacttgctgctccccactgtggccctggacagatgagtcaggcccatggtggtcagggcagtggtttctcctcgtcctcccccagcctgcactactccgtgcctggagctgtgaaaaattggcctttgctcgggcgcggtggctcacacctgtaatcccagcactttgggaggtcgaagtgggcacatcaggagctcgagaccagcctggccaacatggtgaaaccccgtctctaccgaaaatacaaaaaattagccgggcacggtggagggcgccggtaatcccagctacttgggaggctgaggcaggagaatcacttgaacccaggaggcggaggttgcagtgagctgagaccgtaacactgcactctagcctgggtaacagagtgagactcagtttcaaaaaaaaaacaaggtctttgctgcttccacagatgctcacatttctccctggctcattttaagctgtgctaaaatctggtaacaaagcttgcttttatttaaggtacattttgtaagttttcgggtggcccactgtaaggtagagagccctgctcttggtgacttgctttggaactagaaaattagcatctagctgtaccatatctgggcacatgactggggcttcatcaggtagggctgggctttcatgaagtaagttgcagctcagggcctcggcgtgcgaggagtgcagttgctgtgtgtgactggctctgtcaccaggagccccgcgtattcttcagggagaattttcaatcatgctggttttgatttaggcaatatggtcttgaaaatattttcatagtctagtctccatcaatcttattcttccacactgacatctgcttccagaatttggagtaaggcgagctgggaagtagggctctgaaatcttgaaggactgcctaagcccccccaccacacagaagcaaaagcagcctccacaggatgccagcttagcaagggaggcctcacgagcaattttaaggacctcagcactgatgacgagagatggtgtgttacggattttgcatctgcagttttgccattagtggcattttaggaataaataaggttgatatgttaactacctcaaaataattttcccattcaattagattttgttagtgaactcactcatcagtttggatagttcaagtagtatactgaaaaatgatagctaaacctggcttatgattagagctggtttacattttgccttcggcaagtggaggatttccctaggctgtttctggagcctcatttattgatgagcttctgtgccctactccaagaagcacctttccacctgagaatgaggggccccatttacaatattcttggatgaggacctggggaagaatgcaggagagccccaagctaagatggtattcaaactcagagcacggcagaaagttcccaaaaagatgttagaagtatggctcggcttgctgctgttttggcttttaaaaaaagattatagcaagaaccttttagggaactccacagccaccagtagggatcggcaggcacattgccccagctaaccactggagtggtgttcagggagggtttgggatgtggatgctgctccaagccatctgggagggagacaggtgcagggacagtcagcatgaaagcaactggggactgggattgccatagctcaacagcctgatgatggcctgaggttgttgccaagagcagctcctaggaactgctccttctctgagccaccctctgggaacagcagagctgtcagagaagatttaattgttttgatcttcctgccttcttgatatcccattgagagtcacccttcagggagaaggagatagagtcgtcattttgtattaagcaatgacaagaaagaaaaaaaacttttaagatgaaatcctgatgggattgaaaatcaattaatcaatcacacagacctctgattcctggtcattctggctcagaattacagacataagtgtgtgacactgtgttaccttagggtatatggacttttagaccagtagaattttatggagagaagaaacagtaaagatacattagttcaatgtatgcattagtgtttaaggtaataattttggtgcaaaagcagaatgggccagatagactagtttgccaggagtttatggatctaatgaaatagtttcagttgctcatttagagaaaacaaatgcagaaatagagaccacagctcttaatgcaaccaaagagagaaaatgcatgctgactaaacgtccacccattaggctccttattaacagaaatgagaagttattctttggggactgttgctctcctgctgctctgtcatggggctatggcttcattttccatctataaacaccaaacactggaaggttggttgctaagagaactcactggggaaacagttaactgttcaaatgtccccacttacgtggatatgtgcaaataccaccctctgttcagatctgcatgttgcagaaagacactacgtgcagtggactaaagctggacgccggagtgtcccacagacccaggttagcacccctgccctgccactcactagacatgtaactcacagcaagttcttaagaactctttcgaaactattcctcatgggcaaaaagaaaaggatggcaaagcatgattttttaagtgttcactgtgtataccaattatgaacaaattgtaaaatcctgcttcatttcatcaccatcaaaccataggcttaaatttgctcataatcccgacaacactgtgtgtttggaaacagtggaaacaggaagaactgagagcgggtctgcattcaggatccacgtggctccaatcataggtgtgaaaagactcacatattccgtagcatcataggacccatcagagtataacagctaagattattacacatgctgttccagtgtcccactcacactgcaccacagaaagctctgcagtggatcaattgctgctgtgcagtccccaacatccgatccttgctgaagtttattgattaagctggctaatacactccttacacagttatttggtaccatattgaaaatacattaattctaaaataacaaacaaacaataactttcaacctctattgctagtttgagaataaaatgctccctttggtgcagtgagtagtgctcatgagtgacagacaatttgaataagaaaactgggctcttgatttagatttttggctgtcaattacatttggaaagttgggggtaaggtacaagctgcttaggaacccttatttcttccccctgcccttttgatatcatttctctctcttctccttgaccttaggtgggtcaaggagttggaattcaaatcacatgagcaaatagcattcaaatgtacatgatatataaggcactttagcgatccaaaaaaaatttacaatatagtttctgtctcaaaaagtttattgccttgtttggggagacaaaacataccacacgaaaagttcatgatacaggatttaaacaagggctcaacaaatcatagaggaattgttatataacatgggttcttccattaaatggtaaaggaatgctcttagctctaaatactaaaaaaaaaaaaaaaaaaagagaaagagagagaaattcaggaactgtccaggtaggattgaggtaaaggacagggacgaaatgaactttttgagaagcatgtaggtggctaagtcagtttggatgttaggaactacactgagaatcaagagatgaggaagaccaagggcaaaccgaaacgagacaggctgagacaaagcgagatgagacaaagtgagaagagatgagacaaagcaagatgacagaagtttggtgatcatcttggacattttgctaaattaggtgaaaaaggagcaagaaacaggtatccttaggcaaaggcaacctctgaccaagcttgatgagggcagatgaggactgattctagcatgagagggaggtgcaggagaggcagctgcccagtaggtcctcagaagatggtgaaggcaccactccaaagagtgtagatacatactgaccacaacagagacagaatgtgtgtgtgtgcacacgtacacatgaacgaaagaggctagggcatcagaggggagaggaaatacagggagaagggaagtcaaggaaagatgcctgacattccacaggagaagcttctgcacaggagcagtggggataacaactccaagatgcactggagaggggtttttgctagagagtcagcatcgcaaacaagcagagtacctttgcattaaggtgcgatttaaaaatatgttattatctaggatagtggtgctcaaccatggcgattttgctccccagggaacatttgacaactgggagacagttttggttgccacagctggcagtggggatgggggtgctaactgccatcgtgtgggtagaggacagagacgctgctgaacacccagcagcacgcaagaagatcccacaacctggctccagatgtcaatggcaccaaggctgagaaaccaaatttagaggatcccagggaaaacagaaaagtatcttaaaaataaacattacccagtattgtacagttgacaaatgttaacattatgcatttattaaaaacaaatgtaagcaacatttattactgtagttagaattttaaaatatgtacatatactgcagcagacttttatttatttatttatttacttatatgagacagagtctcgctctgtcgcccaggctggagtgcagtggcacgatcttggctcactgcaagctccgcctcccgggttcgcgccattctcctgcctcagcctcccgagtagcttggactacaggcgcccgccaccacacccagctaattttttgtattttttagtagatatggggtttcaccgtgttggccaggatggtctcgatctcctgaccttgtgatctgcccgcctcggcctcccaaagtgctgggattacaggcgtgagccaccgtgcccagccctgcagcagacttttaaaaagatatattcagcttcatcacccttttcttaaaaaactgaaattacttctgtcaaaatcatgccgatggaaagcaatgacatgctaagcacagtcctttacagaaataattcagatagaataagtggaaaataaccttaaagaagattgaaagaagcgacaacttaatgaaacccagctactggttccattttctatttatccttccaaattgctaatgaattctgacccatttagtcatgcaaaatatatatcctgaagaatctgtatcccttttgaggtacttaatggatgtttagccggcaaggaaatatggcatgcctattattcacaatagttgatctttaaattgacattaatatgccacacttagagtactggggaaattctagccaaatatacaaagccgctgctactaagatgaaagacattccacaaggaggaaactgatctcagaaccagtgaccacggccatgagggcttcgtggctgctacagcacgttagccataaacaatttccatctgaggaagtgcattcagtgcagctgctgatgcatagtaaatatttgatcctaattggacctaatgatgaatttcaattctgtattcaccattcttttataggacaccaacccataaacacaaaaaataaaaaaggttttggggaacatttttcatttccttaagtcatttaataatgatgaattgcctgggaggctctttgaaaagatagatgcggctagaaagttactgggagaattagaaattgcataaggattcaatgcaaaatactttgtaaaaagaaattttaacttccttgtttaacttattttaattcattgagaaattaaaggtaaaatatactttataaaaatataatctggcaaactttaatttgggtaccaatttggaattcgattaaacaggttcaagtctatttttatagattataaaaatgctcctttcagataaagtaaaaaagataattttgttttgggagttaaaagaatcaatgtctgtgcatcctttagtctcaatagaataactcttattctatcagtaggcagaaatgtttaagcagcactgtccaaaagacatacatgtaatttaaatgcttttaaatggaatagaaaagtgaaattctctggtgttttttcttgtattctttcaaaatcatagcaccaatggatgtgagtttctaacattattcacctatctttttaaaaatttacccctgaatgcttatacactgctggtggagatgtaaattaggtcaaccattgtggaaagcatttggtgatttctgatagaacttaaaacagaactatcattgacccagtaatcccattattgggtctatacctaaaggaatataaatcattttatcataaagacacatgcacgcatatattcattgcagcatcattcacaatagcaaagacatggaatcaacataaatgctcatcaatggtagacttgataaagaagatatggtatatacacaccatggaataccatgcagccataaaaaaggacaagatgatgtcctttgcagcaacatggatggagctagaggtcattttctaagcaaactaacacaggagaagaaaaccaaattctacatgttctcaagtataagtgggagctaaacattgagtacatatggacacaaagaagggaataacaaacaccacagcctacttgagggtggaaggtgggaggaggtgagggttgaaaaactacctatcaagtactatgcttattacctgggtcatgaaataatctgcacacaaaccccccataacacacagtaacccccgtaacatgctatcaatctatctatataacaaacctgcacatgtacccctgaacttaaaataaaagttaaaagaataataaaaacagaaagtttacccttgataacacgttttatgtataatcactaaatctactaaggcacatttgcatattatattatagagtctgctagctctacagtttttccaactgtgtacagtcggccaactaccataacccacatcttccaaatcctagtggcttaacaatggaaaatggaatatccagtgcagctcagtggagtgtggggtggggggctgtgttccaaacagccatttagaaatgatgctccttgcagctattactccaccataccatggggtctcacagtccttcacatcccctgagtccagctgttagctgagaggagcgagaatgtacaggatcaggtatgggtttcatgaggcagacctggaagggcaatacatcacttctacgagccagaaattgtcacacgattccttccaactgcagaggaggctggggaatgtaatctacctgtgtgcccaggaggaagggaaatgggctttgtgaaaatgtgcagcattatctctgacaaactggcaggaaaaaacccactaatgtcatatctttatatacctgagagatgtatcatcaatgaccaattctctgcccttggcagaatgccgattggaaatatagctttggacagggccaatattaggctacgtcaagatgaccagcatgtgtcctggcaagctgacaacagactctgtcaaacagtcagcatggccagattaccctcctggtcttccaggcaatcatgctcctcttcccactttgggactgacacctttgcttcccatcgcaagcacagccaattcactgaaaagagttgactagtgtcacttgcattttcatctgaataagggaagagtcactgtcacttggaatgtgaccatagactccactatccttagactacatcaaaattatgctcctttaaactatttggaggtaaaagacacaagaaaataataggcaccagaagcatacacaaatgtgagatgtttggcatggaagacagttttctactcataaaatacacaacttgaaagttggtataaatatcagatcctgaatcctgccagccacatttttactggcaggcatagcaggagacagcacaatgaaaattctcatagaggttggaagtagcaacaagtcttgaaaactcatttgactatcaaggagggctagaccacacattaactcagaccacaaaggctaaaggtctcacttagactctcttatcactcagcatttagaaccagaagaataatcacattcattctttcaagactttccctttaactatacataagaaaggaaatgtctttacattcctcatatctcacttggcataaaatctaatgtttgttcatctcacttatcttaatcccatacctcctcatgtttattagaagaaaaaaatgtaactctgcatgtcagaaaacagatctgaagtaaatatcagttaaaatgcaaaacaaaaagcaaaagaggtctcagatttttacaaatgttgttttatagaaaccataaaattgaggtaacttgatttaaaacaagtgaagacatccaagaattttcatagtatgcaagtgatctggactggtggttggcagcattgacattaaatcagctgaattttcattgacagctcattagaaagatgttccaagaaaatcgaatacaagatgctcaacagaagctcttctctatgcagttcataactgttattttatgtccttacaagtcatgactcatattagaacacgtaactctgtaaaatttaaagatttttataaatcgcatgaaaaatttccccttagtatagctataattttgctgtttatgtcacatggatttttaattacattttccaaacacgaaggcagtcaatttgataaggagaatatttcacaaaattcactcttctgttctaggatcttggttctaggtaactcattctccagaaagaaatcatatcagtcagttcacaaaagaaaaaaatatttaagccacctaaaaactcaagtactattcattgttaattttgtctggatctttacattaccttaactatatggtcagtctataaaaatgtatctgtacatatgcttacaggtaatatgtaatataagtaacatccagggatggatcctgaagcgggcttccatttttttttggcatttgtattttaatgaaggttaataaaagccaaattacagccaactgttaaagctttttttttttttttttttaattctatggtataacaaaatcagttccaggtttttttctgaacaaatgatcctttggtctttcccgtggcatgctcctaaaacaactaaaacaaccctctacgtctaatcagtcacctaagatatcgagtggcaagtctttcacatttgctgcttataattcctgaatggtccatattgagtattttcatttctgggtaagggaaaaagcattttggtccattaattcacccgctcgctcctggaggacgttaaccaattctgctatcacaaagacgtgagtggcatcaatgtcttgcatgatgaacttcgcaggcttccatttttgttcactttgggatggttttcctgtcgaactgcgtggaaaagcaggaagcacactgtccactgtaggggttcctggtccagcagaagactttcagatattgtcaagtttagtccacttctttggatctcagtggcttttattctgacataagatatttagatgttgcaagcccctccaaggaacactattttataaacagaaacatccagttgtgtggccatttcataattagcttctgaaatggacaggaaatgcacctatgtgaaggaggcagagcagggcaaatgcctttactgcttttcaaattttgatttccgggtaggaaacacaactaaacctcctatcaatttttagtctttacctgtacatttctaacttttagagatttctgttaatgttcctttttcttgttaactttgtatttgatattcaagaaacgttagaaatgaatgcctgtataacataatttcaagatattaaaatagcatttatcattaaggccacttgctttataccaacatcacaattccattttaagagttattccatgtcctgggaaattaaatcactgtctcaactccttccaggtgacataagaagacatggaggcatgatggtctagcagagagaagcctaggtggtatggattgttccatgttgtggaacatattacagagacaagggtatacattagttcagcaatttcgagttcttaaaacatctgctttctctccagctagatctatacaactggatggagaagatcaggcttaggtgttctgtaaaatttaaaaatgagacccctaatggcagctttcctattttactcatatttttggaatattttcaagcaattgctgatacaatctggtgagccactgatggaattgagtgtaagaaatggaaactgctatggattgttaacatagagactgatgaccagattacaggtgcatatattttgtttatctagagttgtgtggaggctgctgttcagagcattgctgacaccagggcatgaaactagtgacacagttaatgaggctggtgatgaagaaactctcgggtcctaaccgataatttcacatacctagtaaatcagcattatttcatttgagttacacttgactttttaaaattaaatatcatgcgaaagactttccagaattacagcattccaccaaattgctctagccaggaccccattgaggtccatattgtaaaattatcaggttatatctaagccatcatctttcttgattgcacctccccctctgacatagtttcttctcttggctgtcagcacactgtgcccgcttgccttcctcctatctccctgggcatgccttctcagtttcattgatagggttctcctcctcctcctggcctctcaatcttggaggtttttagccttgaagtttcttagcctttttgtcctctttctgcactcactgcctcattcagtctcaaggctttaaacaccatggagacccagccatctcttgccgtctcctccatttccacccattccaggcaccttccttcctcacctggccgttgcaatagcttcctaattagtctccagcttccaccttccccttcttaccacctactcccttcagtgcaaaagcctcaacctctggcactcaccctttctttctcttggttgcagctatcctggcctccttgctgtgcctcatactggaaggccactcacactttagggcatttgcagaggcagtgccttctgcccccagatgggtaaccctatgggcaacccccttcaacttccttgctcaacatttgaaactccaagctgcactgtcctcaacacattctccagatcctctttaccctgctatgttttgagccccttttactctcttacctactgtataatctcctaacatgtttaccttttactgtgtgttctgcccatgggaatttaagctctgtgggggcagggatttttaccaaggttgttcactgatgtgtctcaagcgctcagaacagtcctttgcctttggacagtgctcggatttgcatgagtgaatgactgtgctctctccagagtgatgaggatgtcaggattgctaggtttagaaatgaagcacatcctatagtatgacagagcctgcagaggagataacagcttctcgcttaaagatatggagtaggcgttaaaaatgatttctgcccaatgtaagaggaggattttccaattaccaaccagaaggagttgcttgctcttgcctcagtgattctcacaataccatatgctatcaagttccattgccctctttgtacatgtgagggtaaggtgctccattggatgtatcttgaaacagaacagagtttgtgtatgtgaggggggtgtgtacctttttctaaggattgagctggatgacaaaggatattgcatatttaacgggtagggagaacgcaggtgcaacaattcacaaaaatctcataatagtgaatgatggtgaatgaatagagaagacctaagaaatctctcaaacgggtgagttctctaggaattgaaagggttttttttttttctgttacagttttaaaagaatgtggaaatggaataatttgatgatattaagctgtggttttgatgaatgctctaagaatcatccccagtgataaatattcaaagataaatggtgatgttttagatagaagtcaatcgttattctattgcctgtaacagggttccttagttataattctgttagttgctctcatggtcttatgttactaatatagtcattatttcaaagcttatcacattctgtaaaatcctgtagtcattagcaataatctaagccaacgttagcaatccattaaggttagacatttaacttctataaaatactctatgccacagcactttcatattcctatggggcaaatttccatcgtagactccacgttggctccttgaaatggtgtgtactcaaggatagcccagcttaggggactccaaatgccatttcaattttaactttatacaacagattctcgttctccatccatgcttagacttcccagctctcaggttcaactctcagatcaggaacaaccatatgtactatgttttgtttccatcgaattggcagtgactcattatttaattactctccatgtgttggccaaatatgaggaaagaatactctgaaaaattaacaaaatgtggctggcattacagccatgcagtgcctcatgcctgtaatccctgcactttgggaggctgaggcaggtggatcacctgaggtcagaagttcaagaccagcctggtcaacatggtgaaaccccatctctactaaatatacaaaaaattagctgagtgtggtggtgggcacctgtaataccagcttctcaggagactgaggcaggagaaccacttgaacctgggaggcggagattgcagtgagctgagatcgcgccattgcgctccagcctgggcaacaagagtgaaactttgtctcaaaaaaaaaaattaacaaaatgcatctgtataggcatcctatgtctgcataatgcgtctacacaggctttgggatgcagcagcattggatagaacaatactgatccctggcaaagatacaccacaaaaaagctcggctgcctttcacaaatacgagttcatgaacacgtccaggaagataaaagtgtgcagtgcattaaaaacacatttccttctcattagttgcatgaggatataaaaattaaatcaaatctgctttgttgccaatttcaagaatgtgactgaggacaaggagcagaagaaagcagtgtcaccaatcctactcggaataatctgtcaccatgttagcagagcagaaaacatttcattttaaatgattgctatttcagttacataataaaagttaatagatacaaccccaaacataagatttaattcattcagacacacatatacttgtgttagtctatgaaggaaatatatcttttatgtcaaaattatgtacttctttgaaatgtagttcaaagtgaagaagaaaactttaaacattttccttcacttttaactccttccatgccccaaagcaaacacctgaacatatgttaaaatacttgaattcatagctgccatcagtaatgtctttattcattcagagattttacttcaatatccctctgttagactttttcctgaatgttgatcttgaaaatctgtaccgaaagcttaagtttttctccaaagtcacattcaacttccatagatcatatcagaataatactcctttgatatttacatagaagcaaatacaacaatatctctataatccatggataatgtatatatgctactatagatagctctcattctgaagatatttttcccaaggcacaaaggccatcacataaattcacctgcatttttagagtggatgttcagggcgatgtcattggagaaaggctatgctcccagtgactgtcacggacaagtacagagtcttgagtaggctctcaacaaatgattgttgtgcttattaattgaagaagaatgatcttatatgtgaatcagaaaggaaggaaattaggagtaagtgacaacgaagcaagtgatttgtgaacattgtgtccgaaagagaatctgaggaaaagggtgttttgaggttagtagcagggctgacattgaatctgagttccatgcccagcagtgagccacaccctttccttactaaggaatctggaaatgttgccagccctgccttttatctttgaaaacacagggctatttatgtctaaacacaatgcactgaatttaccttcattggttgacacagttatctttcctgatcctcaaaacctcaacagacagcaaagtgcacaacttgctatgtaatagaagtttggtagatgggaagtctacatgcaaagctgatttattttggcaagataactcagccgcaaggggttacacggaaggcagagagaatggatgtaaagtgtagtcaggatactactgagaaatcctagtcaaggatgttgcaatagcctgtgaactaggaaaggagtgatattgaagacgtgtatgtaagtagaatcaatgagtagggactaagttggtatgaagaaaaattcgaatgcttgtctaagattctaattctcagtaactgggtggcaccatcgtcaagatccagccctgggaaggaagagcagggtgggagttggaaagtgagttttagacgcattgaatttgaggtactcagaagacattcaaagggaatgttcaccagcttcttggaaatgtgagtctggaactttcacaagagatcagggatagagattagggattatcgtgaaggaagaaacaggtgaactcagggaagattacagagatttagacgagagggacagaacccaagggagtaactttaaggttgggcaaaaaaaaaaaagggcacctgtaagtggaattcagaagatgtaatcagagagactgaaggtaaatcagaagcttccagtgtcacagaaggcaaaggggaacagatttcatgaagatgcgagagtcagcagcatgtaatgccagtaatctaaaagacttgtctccacatttgtttccaataccgctttatgttaattatgtaatatctggtttctcagctttagtaacaatgacatgagaaaattcaaaattattttttgtgtcatttctctcagtgtgtttattattatttaaatatatttatatgctttcatgaactttacttatgaacgagttaagaacatggcatcccaaaatacaccactctggcatattcagtatttttagttaaaggcacttaagaaaaaccaggtgaggtcgggcgtggtggcttatgcctgtaatcccagcactttgggaggctgaagcgggtggatcacctgaggtcaggagttcgagaccagcctggccaacatggtgaaatcccatctctactaaaaatacaaaaattagctgggtgtggtggcaggtgcctgtaatcccagctattcaggaggctgaggcaggagaatcacttgaacccgggaggcggaggttgcagtgagccgagattgcgccactgcactccagcctgggtgacagagagagactctctcaaaaacaaaaacaaaaacaaaaacaaaaagcaggtacaagaagatcactctgaccttccttctgtttctgaaaagcaggagatgacattcccatgtgaaaggtgtcctcccttggccaggtgggaggcatgattcctatgggcaaggaccagaagctgaggctgagggaaacctgtaccacctgctatactggcccttccttcccagccattctcctccaatcacctgccctggcccaagcccccgaccccccacctcatcacatttctgcaatttactgctctttgtctaattccttatataagtggtcaatacaaactgcatctttgggtcttcacaaattctgaaggttttcatgccacataaacttatattaaataaatgtatatgtttttctcctgtggatctgtcttatgtcaatttaattctcaggcacaacacccacgtgccccatcccctaacaaatcctaacagaggagaggtataattttgccttccttacacctagaaacatagaaaccatcttttctttgaatttaatgatttaaaattataaagacttttggcttgcactgaattttcagattacatgtgaaattacttgtaaagaaaaattattcaatattatccattttgtcaaaactcttaaaaagatagtgatgtctaccagctttcgcattttagcataattggaatgagtctatggataaaacaaatagaaaaaattggaataaaaatcctcaaaattaagcactggttcctgccaaatggtaatgaaaagtcactagctttttccaataacattaaggaagtataaatattattaaggaaaagctgtgtgtatataagcttttctgaataaattaaattacacgaaatatataagctacagaatgaagtctttatattaaaaacaggtagtcctattttgcctggtatcgtgtcaacaggaaactcaagcatatccagccatatcactgctctccatagtcctgtagcaactgagaggactgcttgtctgttttactcacttttcatacatttattacataaattctcttaaaacagaaatcctttcttctcaacctgttgacccaaaaccagtgttaaagaggttaagataatgtatacactgctagattcaaagcccattataaattttcataaaacataatgacaaactatttgataacttaaagagtaaatatcagatttataacaatgccatacaaaaagatacacactacaaaaaccatcttgaatgtaagtttacaaaagatgtttgtctgctaaggaactaaattcattttctctttgaattcaccatttatagaagttttgagccctagaccaaaaatatggaagtataggccaaacattatactatctgtgataaattttcagaaaatttgggctgctttaagtaatgtatttatgttttacatagttcctcaatgttagcagctgtgaaagatatttacaatttacttcctatgtagaatttatcttaaatttaagaaatagcaaatagagggaaagatgttttaatgcaggtctttattgagtcgttcaaatgatgaagagaataatataacaaatgtccatgtacccatcatttatcttaaaatagaagatactaattcaattaaagcctgctgcacatgtctctaattggaagtgccttcctacctccagaggtaaccattatctgaatgtaatatttatcagtccatatatttctttacattatgatgatgtaggtttttaatgaatactctttttaaggttaaagtaattccttcctttgtctggttgtgagtttttatcttgaaagcctgtgttgggtttcatcagtttttttttctgcactgattcagactgatctacagtcagaatgtaaagttttaaaccacaaaactcatatgattcatatatggtggtgaaatgccttcaataaataaatgaagcaatatgaaaagaccctcatgaaaatattttattcaatgaaaatgaaattgctttaggcattaaaagtagttatctatggtcacctaaaacactatttggttttactagtgaattcctcatttccttcctttctgatttatatgttagataattcttaaattaataagcacagctgagggttaaacataccaaatagtcttctgccaaatgtttttacacctgtggttttaagtattttagaatattgattagaaaaattatacatgtgaacataaaaaattatgatgtggacacaaatgatttttaacatcaaacgttttttaattttgatatccaaaatacataaaaaattgtaaggggataaaaatctcactgcaatcaagctttctcacctttgcataaaaattatcactttgatttcagacaagtttttacaagctgtggttattaagaggtggatctcaccatgtgagacaaaaaaacacgtgtgtgccaattctaaattaatttccaaatatgaaatacatccgttaattcttaaagatgctcaaacacaaaataaaatatattttgaatgtagacaagtaggcatcatcaatttttttaccacagaaaaaggtagtattttattactttttccacataaaagtctacctctgaatttaccttttcactcggcttttcatttttacttgtttttttagttttccatcataagccagtcttctattatatcaatacaaactttataaacttgtttacacttaatttttgtcttattctgccttgaataaaaatagtcatagtggatataaaaagaaaattctaatgatttaatttgatgtcagaaatacaatttttaaagaaaacatcgaatttctgctgctaagagatgtcactctgtaagttttctccaaaagggagtgttttactgccctttacaaacagagggaaaaaccattttctacttcagaatgaggcgtggatcccttagtctgacatctgacatccttcttgaatttgcactgaacctccatctttatctccaacaattcctggctgagtcccttcactatgggcctactcatagatgtgcacagaaatgaaccatctggtgtgccaggccacaccttccaacacttggctctgctgggaccacaaggatgggctttctcatctcaccgtacatttagatggccatattgggtttcggatagtctcccattcttaaccatggtcttcaacagtttttgttttaaaagtgaatactcttatggtaaaaaagataaatgtgaaatagaaaatactgtagatctacagatcaaagttatatttgaaaaccacatttaattgtatattcacatatttttgtaattcacaaaaaatatacccatctgtaacttttcaacattcttgagtgttttgaaaattaacaatttgttctaaaacttgagagttacatagttttgaaatatttcaaagttcagttcaaacacacacaaaactcctggataccacctggagctaaattcaataccaatcgaattttttaggtttgcaaaattgaactaaagaagtaccactgagttgagggcatgtcaagatctagcattaaaccaattcagatttgtacttggaccagcatattccaggggtcacagtagccaacatgcaatgccttaaaaatacatgctgtacgtgtgtttttctattaagctaaattcaatctctttttttttcaggcataaatttatttgagaacaagagaataatgtttctattctatcctttctaatatcaagctggtctttaaaattttttttaaactgtgtcaatttcctaactcgattcttttcggtatgccgacaggttatttcaaccagcctcgtcctaacatttggctcattatactattggcacattcatgtctttctctgtaatcttcacctcccgtgcttgtttttctctcagtgaagtacagaaagccaaaacttaggatttgaaatgtcgtcttcactgcctggaccaatggttttcttgttttattgaaaatgaaagagctggccgggcgcggtggctcaggcctgtaatcccagcactttgggaggccgaggcgggcggatcacgaggtcaggagatcgagaccagcctggctaacacacggtgaaaccccgtctctactaaaaatacaaaaaattagccgggcgtggtggcgggcgcctgtagttccagttactcgggaggctgaggcaggggaatggcgtgaacccgggaggcggagcttgcagtgagccgagatcgcgcccctgcactccagcctgggcgacagagtgagactctgtctcaaaaaaaaaaaaaaaaaaaagagaaagaaaatgaaagagctatgcatttggtgaaataataaaaacacaacctttcatctctgataatactgagcattaaataaaattataggtgcaattattttacaggtaagttttactttctaggacaaagtctagatacacagggcagtactgactgccccgaggcctcggtctctgcaccaattggtctcatcttatttcaagtgctctcgtctttgtcctcctcttctcagttacatctgtgtaacagggtctgtccagcgtttcatttctctaatcaccttgaacattgctcagcagtattactaacacatgagcctgatggtgagacttttgttctcaataaataaacacaaactcaatgcaccttcccaggggctttgcatgggacctaaatattctttgagtcctgagttttctctcctctgaatctttgctgtccatcaccttctgccatttgaataccctcttatccaaaccaaaatcctaattccagtacagcttttcctttgtgataataccactgattttctagtacaatatacgcccagctcccaattccagctctgagctcctagagttctgggggacttcacattgcccatcttcttttgcagagtgttatatccaggtgtatgtgcccagctctcctaccagactgttcatctgcctgtggcacggctccttgcacacagtacgtacaaggcttggtaacagaatcccatgttcattgaagggcctagactgatcacattttaaataatgcacaatgttctcacgtctatttaaggaagaaacaactgatttctatcttttaagattgcatttcaagaccatatcaaaggctttgaatctctcaccaagactaacaatgaaaaacaaatttggccaagtgcagtggctcacacctgtaatcccagcatcttggaaggccgaggtgggtggatcacttgaggtctggactatgagaccagcctggcagcctgggcaacatggcaaaaccccatctcttctaaaagcacaaaaattagcttgcgtggtgacacgtgcctgtaatcccagctactcaggagggtgaggcacgagaatcacttgaacctgggaggcggaggttgcagtgagccaagattgcaccacagcactccagcttgggcaacagagtgagactctgtctcaaaaaaaaaaaaacaaaaaaacaaaaaaaaatgcaaatttgatcatatttaattgaatttgtttcaaagtaagggaaaggggagtatgcaagggcgacatgtggcctgttcttctgaaaaagcaagaaaggttatctttatacaccagatcaaggtattgacagctacagagtgaaattccatacacaaaaagaaaattttcttcaagtgaaaaaagtaagtggccaataaggtcacattcaaaaattaaaaatggatgccctggtcttgattactgataccatttttcaataaaagtaaccagagctccttgaagaaataattgattttaggactaggacatgaaatgtacaaaatgatgcgggagcatcttgtagtaccagggaaaaaaaaaagtcaacccttagcatgaaggtgtaagtcaaaggcacatgggagactggagatgcattttggatttcagattttttcagattttggaatatttgcatatccatcctgcgtcatcttggggacaggacccagatccaaatgtgaaattcgcttatgttatatgtagtgtatccaaatagcctgaaggtaattttatacagcgtttttaataattttgtgcataaaatgaagtttgtgtacactgaaccgtcagaaagcaaaggcatcaatatctcagccacccacatggaaaatctggtgttgtttggcatcaccatcattcctgactgaatttatttgctaccaataagcaatcattttcctgctcttactcagacgtgagtacttaacagtagaaaatactactatttttgtttttgaaagagtcttgctcttgttgcccaggctggagtgcaatgacaccatctcggctcacggcaacctgtgcctcccgggttcaagcaattctcctgcctcagcctcctgagtagctgggattacaggcatgcaccaccatgcccggctaattttgtatttttaatagagatggggtttctccatgttggtcaggctagtctcgaactcccgacctcaggtgatccacccgccttggcctccgaaagtgctgggattgtaggcgtgagccactgtgcccagcctaatactactattttttaaacagtaaagatacatcctattaatacagtgaaaaataatgtgtttaggtaactgggcagcacaggaaaaagaccgttttcctttctcagctgttagacaacagcagcaacaaacaatgcaggctttcagttgccacctatgatgctgtgtttggagtaaagggcactgtacactgtattttttttcttttttaggtgataagaaacatctgaagcagttgacagatcatgaagcgggtcctctgagaaatgagaggcattctgccggatggcatttttttttttttttgagacgaagtctcaccctgtcacccaggctagagtgcagtggcacgatctcggctcactgcaacctccgcctcccagtttcaagtgattctcctgcctcagcctcccgagtaggatggcttttaaaatgttttctccagcgtcatctgcctcattaacagcgatttttgtcttagaagtctctctttgagtttctaaatggacatgactgcttattctgttaggaatgcactccactctagtccttcaattagcccatcacattgtcactgtggcatctgtatgcacattttctgccgtgttaatgtcatcttcattgtccaattgtggcatcatgttggtgctcaaaacgttgcagattttggaacattttggatttcggacttttagagtagagatgctcaggctctactacttcttatttcagagaaaaacataatatccaaataactaataaaaacttggttggagaatgcagacttctagaaatgactgtttaatctgcttatgataaataatcctctttgctctactgcaaaggggagactactgctgttactgttttgtgtcatcatgtcctgatcagacaaacactgatttaaaaaaaaaataaaacaagtacattgtatatgtaaatttagactgtaataatatatccttgagaaataaatattatatggactccatttttctctgacagtcaattaagcacaaaaagatttttaaagcactgatttttgcattcttaaatgacaaatgaagtcttcttgaaataagatttttaatgatttagagaaatatttgcacatacactagcttggtgttgattctcaatttttaatttttttttaatcctttccctggcattttcatcgtttccttttttttttttttttttttttgagacagagtttcactcttgttgcccaggctggagtgcaatggtgggatcttggctcactgcaccctccgcctcccaggttcaagctattctcccacttcagcctcccaagtagctgggattataggtgtgcaccaccatgcctggctaattttgcattttttttttttttttagtagagatggggtttcaccattttggtcaggctggtcttgaactcctgatctcaagtgatccacctgcctcggcctcccaacgtgctggggttataggcgtgagccaccacgccaagcctatccttcccctttttctgttttgttatggatgatgaatgtcttaaaactactgaactccttataccttgatatggttagtgagagcttccttgtgggatggttctgaatgattttctctagaacctccatttgaacatcttcctttcctctgctcactgtaccagtctggggctatcaaatcacatatgctgataaatgctacactatgactggtgaagccagtgctaaaaagcagcttctacatatggcacttccaaattgtgttattgctagcttttccagtgctttctctactagggcatccactgcatgtcacctgctaaaatgcaaaccacatctttaatgaaagtctgttttattgaatatataagtgactatgaaatttcaaaatgaaatttgatggcaatttaattttataataaatctatatctatgtatctcaccaaagatagcctaaatctttagtgaggccacacattcatttttatgaaaattcttcacatgagtttagaaatctcccaactaagaaaaggacaagtcagatcttagtgtcctgggtggcttagcatttcataactgccagagaaccatgaggaccttcctgggactgactcatgggagttatctgcaatgattttatgtttcccaatgggtcatattttcattggagattatttactatgcctggaatcctaatgcttggtgtctctaatgagaaaaataatacaaaaaaattcaatattcagccaacacaaatttatatgatctacaaaagaaaggaatgttttcagatcctgggcttgattatttttgttttcgatgtgacagatttgctgaacaaagcttacaaatctcccttttcctctctgctcgctactaccccgacccagaaaacacacacacaccccttcccaaccggggaccatctgaccgttcacacccacatcaactctgggtcgccatgcttttctgagggacattgccttcactgagagctcctttattctcagtataccttacattcccagccacagtactgaacttctcaatgcttgcaatgttcccttggagtatatcagttgagcaggcggaaaaaaaatatctggaagtttattatttttccaccaatatatttgacaccacctttggagagggaacaaaaggcatactgtcaagcggatagacctggacaaaatgttactgtttgttcctcacgagcacagaggtatatttaagcaaagaaaggcattccacggctctcccgggacttccttccttcagctgaattataccaacatgttcacaccactgagggccaggctgctggaatttaaaacgcagacctctatctgccagtgcttcgatcccacggctacaaacattcacattaggattgaacctggctttcaaacatcatgagataaatgggagtttactgggggaaaacgtgtgccctcatgaaactatagtagaagatgcggaaataggactgtccctgttcagcagattctatactaatacaataaagcctcaaagtcaccagaagtcacctggccttgggttatgtttcaaatccaggctcactgacattcatgaaacctttggcaacacaggccaagtttcgtgcaaggctgggtagaatacttctttcatgtggaagctgggtgaaactcggtggctttggctagctttcacctgaagtttcacattcaaacaatccaaagtttcaacgtaaaattcaggggtgaagagaaacagaaagaaaaaaaaaacaaaacaaaacagggggaaaatggcttgcctgggaatggaatgatcacctaccattctccaaaaagatttcatcctggtgccatttaattttgccgctggactatcacctctagcaatatatttgcactcagccctgcagaccaaggcttcccagtactaagggagagtgagtattctagctagacgcaccccatccccccaacaaagcccaggctcaaaataacgggaggatttaaaatggtaaccatacacataaatgcgatgattgacatgcttcttataatgtagatttgaaggggaaaagtggcaatgaaatgcccaggtttgggaaacttaaagattagactgaacatctctaggtttttctactataaatccaagttctggagattcgattgcatctgctcctaatccagggagatctctgccgtagctttctccacagctccgcccctttggagatttgtcctgtggccacttgcgtttgtccttcttagcaaggtgcagaggacggggcagactgcgtcagcgctgaggagctagcgtccttgactgggacttaaacagtctcctgacaggattaggctcattctactcctaaccttcaacagaacacgcagggaccgtttgccagggaacgtcaaactctgtatttggctgaggactgtgaaaataccttgtgcttggggtgggaaagaagaagggaacaaatgtcacacacacctgtgctttcttcacaatgaagagaatattccaaagctgattgaatggctagtaagtgctacattttgcccattttaggaaatacatttttaagaaatcccttatcccttacacagcagaagtttcactcgtaaaacagacttctggctactaaggttttttttttttttccagttttcttttgattctaattttctttttctttgttatttcttcccgtttttgttactcagacgatccttatgtggttaaaatgcatgctttcctttgatatgtgctctgtgataccaataaacttttctgaaaaaaaagtatttctgaactccaaagatttcagcatccatgtttttaaaaagcaccagttgggccccaaggcacacggagattctgaggcagcagggcagccagcgcggggctctgtgcactctcatttgctgcttgctcttacacatctgccagacaggggccatgaactgtcctgaagtctgtgttggggagaactttaccagagaacacttttcttacaattgggggtccctctagaagtgaaatctaagacagatcagtgaggaaaactaaagctccaataaattgtttaaaggaaatgctatgaaagcattaaaccaaaaggaaaaaaaaggagactttttactgagcatagtaaatagccacaatcaaagtaaatgctgtgtttgaagttaaagtccacagatcaaagtacttcgcaaaatgtcaagtgcaagcgtaacgagggggagaggggagccacagaaactgacccgaagtatcacattgtcacgttagagaaacctgccagcagatgtacccagcaaaagacagtcagcttagtaaggaatcctcaacactgtcccctaaaatgtgctaggaacatacaaaacaacaataacaaaaacaaaacccccagattcccccaaatcaaccactctaattccacacgagcaatgaacgaaacagtgatgaaaggagaacattatacaatacggctcgctcattgcccttaaagaacaattacttatatatattatctttactcaggtggatggttgcatctttttcctctttttttttttttaatgcccctggaaagttaaaaataaagcagtctaaacaacaaaaatatgatgtctgaaacatcctctcattgctctggcaatcaggcttaattagacctctgatccatggcttagtcatagtcaagcgtgtactgcaggtcactattatgagagctttaagcaaagtttaaaacttacagccacaaaaatgcccagatgctcctgctgtattctggaacaccgtgtttacctgaaaattgttcacaactccccttattattttcactataagtaagttattttaaagacattagttatgaacataccagaaaacaattaaataattccagaataaaaaatcttacctacaggcagctgagttcaacagttgctctatacagaggaagtaggagtcagtggccttttacatgtagagattgtttatttagccctttttaaaaggtcttgaactccagaggtttaagattaagtccaatccaagtgtctgaaggaaaaaaagcaagagagaggcaaatgagagagggaaagaatcccagctgctgggtggtgctactgttctgagagcatttgagctattttcagcattaacagcagccggggttgtctgcaaagggatgaaaatgccttgcccagatcgccaccccccactccaggggggagaaaacaccaaccaggaaacccacaacgacttggttcattgtgcaaatattcatttaaattttgaggaaaactgccagcaccattgaaaacaaaacaaacccaaagttgactggaatcttaaagaaacacagtgctcctcaagttttcaaaatgaattacctgattcactgaaaacgagatgtcctacttatgctttattgagaaggaggcttttcttctgatatttcctagggggtcttaagaaatagttgagagccctctggtagcagtatctgttgtcagtctattcttaagactgaagacaaatgatttcttaaaagagcccgcacctaaatttccagtttcatcaactatgctatttttgaaagctactgggttaagcgttgacatctcttatctattggcagagactggggaccattcagtgacatgaggcagacaaacagtgacccctgcttctgcctccacaggccaatgaagaaatcattctggttgggtcactggcaatgactgacaaactttgagccttcattttgtttctagaaataaaaattaagaagtcgtattcattcattcattcagcaaatatttatttggtgagcacttcagagcttactataagccaagcactctgggaatacagtggtgggcagaatgaagtgtccttgccttcaggggtttagagcacacagatgcagtgagaataaataaaaacagaatttttaaatattttccagactttttcacatgatgagactattcacatcatggcagctgaagactgagatctctttctattgtggatgaaggaagatactgtgtgtcatcagaccaacttcaggcttccattgagtcattgtgcctttacaccaccaccagggaggaaaattacttactttctaccaaggaagcagttaagtatgtttatgaacgctttcattccaatagatgaaatccctggtttttttcaaccccctactccccattacaaaaagaatgcttaagtagtcagaaagtactgctgagaggctttccatcgggagatgaaaagagagtcttcaacctgaattcagtataaaaaactgccggtggctcaggcccgtaatccagcactttgggaggctgaggcaggtggatcatgaggtcaggagatctagaccatcctggctaacatggtgaaaccccatctctaaaaaaaatgcaaaaaattagcaggatgtcgtggcacgcgcctgtagtcccagctacttgggaggctgaggcaggagaatcgcttgaagccgggaggtggaggttgcggtgagctgagatcgcaccagtgcactccagcctgggcaacagagtgagactccatctcaaaaaaaaaaaaaaaaaatgccctgatatattttataattaatgtgagggttggttgctagatgcttatatcaaattcaaattcaattctttctttgccattaaagaaagacactgaaatagattatggaaaatactgaggattatgccatgtgaaaaaaaagggttacatgactactacttcaagtactatttaaaaacagtgaaatcctttggctcaatagaccttatattaaaactgtatttcaaattaaaaaattataaattaactttgaaatctctaatctgaattttataaataagatcaactttgttttaaaaatgtataccaggctttaaaaaatgactctagaataaagcatttttcttttcacttattttaaatggttacattttactatgtcttaaatacctgccaatctaacatgggatatttgtttctcttggcctcaatgtggaatggtaattctactggtaataattggaagcctagctgcagacagacacattttttaattgtttttttctttttcctccttataatagtttataccaaaaaagggtataatgcatttaaatattggctttccttgagaagctatggcattaaggaaacaaagatcaacataacccactctcgtataaaacagggataataatgagttgtcatagggctcataggaataatgcacagaaaatgcttacctgggtaatgtctgacacacagcaagcatttggtgaaagtcagtaccatcatctctgctgtaagtgtaaagctttgctctccaaatatggtggctacatgtggctactgagctcaatgcggctagtcagaactgagatgtcatataagtgtaaaatgcatgctagattttgaggtctttatacaaaaaaaaaaggtgaatgatgagaaattactcagtgggtacgatgttcattattcaggtgatggacacattcattaaatccgtgactttaccactatgcagtccatccatgtaacaaaattctccttgtaccccacaaatttgtacaaataaaaatagattaatgttgtctcttcctaaaacatgtaaactatcatatcatttttatattgaccacacgttgaaaaaagaatgtaaattatgacattaatttttatattatgtgttgaaatgacagtattttggacatagtatgttaaataggatattttgctaaaattaatttcacttgtttcttttttactttttcaaatctgactgctagctaatttaaaattacctatgtgacttgcattctatttctactgggcagtgccatgcaggccaacggttctcaaaaggtagtgagcatcaatgacccagaagcttcgtaaaaacagattgctgggtccaccccagagcgtctgattcagtaggtctggcggggcctgaaattctgcatccctaacaaattcccgggtgattcttgacctcactttgaaaaccgctggtcttgggccttgcttcttaaaaaagtagtccacggaccaacattaacgtcatcacttaggatcttgttagaaacgcaaaacctcaggccccacccagacctactgagccagcatgtgcattttcacaacatccccaggctgcgtgtaaacatgttgaaacttgagagaaatgatatgaagtagtgtctgtcatccctgggtgaatataaggtaaacttttacaaacaccagtaccccggccccgcccctagagagtcagatttaatgactctggatgtgactcgagcatctgcatacgtgaacagctgattccagattaaagcaagcactgagtcccatcagactggatgtggaaaggccaggatctagatcatttgtacatcattaaggcatagttgacacagatcaaaccatattagagggtatttacatcccaaaagaggatcttgttaaccccaataactctacaattgttagaactggtgagaaagacccatattttggagtagagaggccttctgttattcgctccacctctgttccggccttaaataaacgagcacgccaactttaagagtgtgtctgaataacctcattagtttgccgaatgacttctcacattttcaggcggcacctgagcgttgtgtgtttcacagagcttggtaaaaataaaatcctcactgtaagagagaatctgggctcacgctggtaacatttaaaacttccaattctatatgcaaagaccatctgcagctttgcttctcactttcttggttgaacctttcagaaaacttttaaaagtgcataatacttaagagtagagtctggagtcagggtgcctgggttcgaatcctcatcctgccacttacgcgtggctgtggctgtaggtcacttacttagcctccccatacctcggtttcctcctctgtaatgagacctttttttattgggttgttgtgagggtgaaaattgttatttgaaacagccatggaaaaatctgctgctttgtaaattttatatgaatgttggttaaataatcaaaatatatttgaaaaactgtgcagatttccatatgtggctaaatttagtaatttttaaaagatactgtggtgatttccaaggactttcatgggcgtgagtttttgaacacatatatttagagggtttctctgagtgttgttttacatttttttcccaagacagcacagaattctcaattgattcctcatcgcttcctattatttgagaggatcccagtaggaaggaagtaaatgtagttttcccatgagtattgttttctagagaacattctttacccctgcagtcctttgaagagtgagttgtgctatagatgtttagagacctccctggtccctgtcattctagtggcattgtctagtatcccaggagaacaatgtgtcattctcttagtcaaatattttagtgcttagggcgaggcagcaagaccatctgaaacactggcgtgagtttcaaagacatattgaaacagcagtcagattctcctatagaaatcagctaatgctgactaaaagaagggatggggatgaacagggaagtgctgaagtcacgcacattgtaagcaaaatgaaggctagactaagtagagtaacatttttttttttttttttttttttttgagacggagttttgctcttgttgcccaggctggagtgcaatagcacaatctcggctcaccgcaacctctacctcccaggttcaagtaattctcctgcctcagcctcccgaatagctgggattacaggcatgcatcaccacacccggttaattttgtgtttttagtagagatggggtttttccatgttggtcaggctggtctcaagctcctgacctcaggtgatccacgcacctcagcctcccaaagtgctgggattacaggcgtgagccactgcacctggcctggagtaacaccttttatgcttgtctgcttcaaccacactcaatgaagtgaagcatatgcaagaaaaataaggatacctggtagctctgggcacgtagcaagcatccgtcgggtcatctacaggaacctcacccatggtatgccacctgctgaacaatgtaatgcatgcatcgggctggaaactaaagcccatacattgagtgactttagaccagtcatgcaagctccctacacttgtgtcctgaaaggcagatagaggcatgggactgcaactgccttactgactcttaaacctatgctttctcttgggcttatctggattacattcggcagtctgccatgatttacgcctttttgcagcactgtttgaaaggagtcaaatcatacgtccaatgacttctactgcctggttattgatgttaagtaaatactttttagtaggcgatttgtcatcacatgtgtcattttgccatctgggttgaggtttatcaagtgaggtgaaaatcttaacaaaaggttaaaggaccagtatcattgaaagagattatatagaaataacttcttaaaacctctgttagaagctcaattttctagttgaaactttgtttcatttatttatttttatttattcatttatttttgagatggagtttcactctgtcacccaggctggagtgcaatggggtgatctcggctcactgcaacctccacctcctgggttcaagcgattctcctgcctcagcctcccaagtaactgggattacagacatgcgccaccacacctggctaatttttgtatttttagtagagacgggtttcaccatgttggtcaggttggtctcgaactcctaacctcaggtgatcctcctgcctcagcctcccaaagtgctgaaattacaggcatgagccacggcgcccagcctgaaactttgttttaaactggctgcctgaattctttgtgtatttaaagagcacctctgctgtttatgtaaccatgacttagcttttcttgttatttctattccatttgaaattgagcatatgcaacagtcgctaaatctgctatgaaaattgtgaagccttctccatgtggcccactgaaggccctgcacgatctggtgttctgcagcatttctgcccagatctccaccaccttcctcccagtgccattgcctccagcctctctagcctcccttccattgcctcccgcctctccagcctcccttccattgcctccagcctctccagcctcccttccattgcctctggcccctccagcctcccttcccttgcctccggcccctccagcctcccttccattgcctccggcctctccagcgtcccttccattgcctccggcctctccagcctcccttccattgcctccggcctctccagcctcccttccattcctggactgtgcctcatccagggccctggcttgcctggctcaatgtgatgggaatgccttccctgcccagtggcgaatgccatgcagcctccagctttcacgtgtctcttcctcaggaaggacttccctgctccaccagcgtagccccgccaccccctttttttaactcgtaaagaatcaccttcctcattccttctaaattcaggttcagttgcttgaatttgttggagtaattgatcggagcccctctcctccactagcctatcagctcccgcttgcccctcacatgacttacattcctcccgcaggtactgcattctgcctggccctaagtaggggccaatacgtagttgctgaataagtaaatgattaaataagttctgccgaaggcattaagcaacacaagagtacattttttggttctatatttatcagaacttgtgaaataaaaagtatctgatcatgtaaaaagcaaaacattatgtattctaattaagcagctgtttccaaccaagacgattctctgaaacattgctttgtagctacatatttggtttagaagctgtcttaagaggcaggtgccacttgcttttcccttcaggatataatatgttctgttatcttaatttgcatttattctaaaatagatttcaataaaacaagttacttgcattcatatatcatattcctagacctttttcacaaccatgtgatactctactagggtagagtgaggtccctgataaacatttcttctgattagggttattgagagaattatgtatttgtctatatattgcctggcagttataccacctgaaaccatatgtgattatttataatgtagttttatgagcagacaggcagatataaagtaacacatcaaccatgccacctggtcaggccatagtcattccaatggtatgaaactctttcttgtggccatattatgcataagttataaacagacaatgaatggtcactgactgagaagactggagatttgcaatcttattttctggcaaatagccaagtcatgtcaacaggagagataaggagagttttgtgtgtcatacactgtagagcaggggtcaaagcctgggataggagagggcttggtcttcactgcatttatttgaaaggagctatggaaacttttcttctaccacttgggcacaggaaggcttgctatggcccaacaatgttttaaaatgtattctttacacatgtgtaaaacactctgaaatcatcaagatacagcatgaaacgtatcttttctgagacattaaaaaactgaataaattaatccaacaagccatggcacaattccataattactatgaccacagaagttaatttagcagggatagtacataatacacaccgtgctaggaaagtgtccttgaaactcatgacggtgaaggacgaattaagcccaatgaaggacagttgaccagcattcaagaggtagaaggaactatagattccttatatcaagtacatgagaaaaacttcctaaatgaatgaggctggaaacacaaaccctcagagactggacataggaatattttctgcgttgtctgtcttctaagcagactctctctctacttctacttctgtgttagcaacgactacagtgctgcagtaatatagatctcctcagttctcaggtggccaagtgaggccttgggaagctaaagttcctggactggccacctctggctgttagcaacctcattggtttacctctgtgcctgcaaatattcttgattttatgtatagtatattatagagaagtctggaagggaatgctttaaccagcaaagtcaatccattaaacaaaaaggtatgggagagacacgttaagagatcagtaaccatgttgtagtttaaaaaaaaaatgcgaagtctttgttcagaccctcggggtaagcagaagtagactggtctccagtggcaggcatgagagggaatatcctgcccgcagtgatggacattttggtttcaggcagagaggcaggaagctgccctctgaatcagagtaaatgctcacattttgaccttctagcaagggccctctttttcttggcaagaattccttcgaggatcattttcagtttgaggttctgtctgatgttttattttacaattaagtcactattcccatattcattactctgtaaaataagtcaagtaggtaagaggtgtggtagacacttccttctgcctcctgaggatccattttgcagccttcctcactacagaatcctgacagtacggccagttaacaactgacctgcctggattccttgcagtttctgaccaataagctaaaggcaaggcatcctgttgaaaatttcatatgcacagtaacgacactaacctcccgagaagagggcttccttgtccttttctttcttttttgagacggagtctggatctgtcgcccaggctagagtgcagtgacgggatctcagctcactgcaagctctgcctcccgggttcacaccattctcctgcctcagcctcccgagtagctgggactacaggcacctgccaccactcccggctaattttttgtattttagtagagacggcatttcactatgttggccaggatggtctcgatctcctgacctcgtgatccgcccacctcggcctcccaaagtgctgggattacaagcgtgagccaccgcgccaggctgtccttttctttctaaccttgttctgctcctctttttgtagactgaaatgcagatgtcattctgtgggggtgcatgctaacagagagatgatacagcgatggagagaggatagagaggaacctactctgggctacctgtccgtgggatttcttgttatttgaggcaaacccaacctggtgaaatgactgtattgaggtcatctgttccatgaaagctagaaacagaaacaaaacaatcatctaaaaacaaccttccttacattagaccggctgaacgacagcaataaactattaggcctgccattaagatattagttaaaaaatacttccagaagttttgaaagaacttctgggcatcaacaacgaatgcttacaacagttgtggcattaagtctccggcccattatcatttcctaatggagcaaaatctgccatgaaaaatgagccgacatgcctaacgccccgggagctgcatcatttgaatatttttgactctaaatatagtgaagtagttggctcttttttctaaaactacaatttactgatcagtgatatcaagagaaataagaacacagcagtgatcaacaggaaacacaaaacaggaacgcattgtttattctgttctcggtggacactgccagatcattgttcagagagctttcaacagggttgcttcgatggagtttagggagtttttaaatctaaattgaagatgaaatgtgtcctcgggacagaaaaagcaattttgaaaaggttattcaaggccataaggtattgactttgagcgtttaaaaaaaaaaacaaaaaacctgtaagaatcttactgtggtttcttaaaatggtgaatgctgtcagtcataatggaggggaaggtaggtttgattaggcggccggtgaattttcagagttaaacaaagttaaaaatacacaggcaacatgaaaattgttctaagcgttcctgtgtcatggtttctgattaagtatcatgaatggaagaaatgaatataaatcataacgattccgttttataacagacagtctcgtgtaaatattttgtctttctagtcacatgtgccaagagctgtgtgagagtgtaatgatggagagcgtggtctgtacttacccgccaccatcaaacccaactctattactgccagcttctgtggctgctacaatcttcttgggcttcagttctcttacccaccaaataggcactgtgtggcccttgactcataattgttgtgaggcttaaatgagttaacacatgcaaagctcttaaacaacagcaactcacaggaggccctccccacgtgttggctgaggctgtttccatcatcatcttaagagcatgggcttggagaatcaagagttctgagttaagtttctggtacttcctcgaattagctccctggtttgggcataatcgttgagcctcattttcctcatctgagcaatgggaatatcgttcattaccttaaagcattaagaagaggggtgaagaatataatgctggaaaaccacacctggcacactggaatcattagataccattttgtttacattacacggaaaaaaattatttgcaaattgatcttcaaaaatatagagacttttactttgctgttggggaaaatgaaatggattgggcacacctagatattgaatttaatttccttatcatttatttcagatagctcacattcaaagttttatgttttgggtttttttttctattttaattttaaacaagaatacatgggactgtcaaacaactggattaagaaaatccccatatctgagctaatcactttgtcctatgattgacataacagtctccttcgagcaacagcattaccactgcttcatttagtaagtagagaaggctaaagaggaaaggtagtggcgttaaaagaaatgacctggaagaaatagagaagaatggactttgtaaggccctgtgagagtctatcattcctctagcagggggaggagcagagttataatcctatctaccttgttacaaacaaatacacactaacttaacattgattgactatggttataatgaatggtaattgaagaagtatccctctatcacagcagtgattacattccaaggaaagaactgagggtttggaaccaggcacagctgatctcaaggcgtggcttctcccatggcaagccatgtcactttaggagagttacttaatctccctgagcctggatttccttatctataaatagcagacaggctgggcatcgtggctcacgcctgtaatcccagcattttgggaggccggggcgagcaaatcacttgaggtcaggagttcaagaccagcctggccaacatggtgacaccctgtctctactaaaaatacaaaaactagccgtgtgtggtggtgtgtacctgtaatcccagctacttgggaggctgaggcaggagaatttgcttgaactcgggaggtggagtttgcagtgagctgagatcatgccactgcactccaatctggatgttcatccatttttttttttttttttgaggctctgtctcaaaaaaaaaaaaaaatagcagacaaccccatctacctctctgggaggtttctgagaggattaaatgagactttgcatgaatattggctactccatcaagtggttgcagaggaggggttcagtaggctgttgttgctgtttacctctttttcctactacactgcaggctccttgaggataggattcctttaaaaacaaaatacaaccagttcccagcacagtggctggtcgctagaatgtactgagtgaatatacaccaaataaagcaagacagggatactttgaatggaaagatcaaacaacagcaataatgaatagcaggcttgacttgtttaagtgaaaatggttaagagagactggcgtggacaaactgaactgatgcattggggaacagattaagtaaaaagtacgtaaaagacaacatcttcttcacacacatatttagaagggaaagataagccgtaagggacagagaaactgttatacgacccgaggggattataaatagcatccttaaatggggctatttctatatagcctctctattttttactttgtagaaagattgaatgactttgacctatgatttctgagagctctgtctgatttcttttttaatttacaaaagtttttatataaaattcaggtcttctcatttctctctgagcctccctcctcccatctgtctccaccctatcctaagtgcctccactttgggtactcttgggttttatggctaaatccagcaacgcagattgtgggcgggcaggtttcccgtattgttcctaccgcccatttctctacagcatttcttaaatagggcctagtctggagactttcaggacgagtgttatagttctcacttttcatttaaccttgaatcatagctggaaagcacattacgaaacctaggtaatcatcccctacacattttgaaaatttgggagcagaagatgattttacaggtaaagccatgaccagcgccagggtctaagaaacattgttgcggcgaatgggcaggtgacatcacatggcgcaggcagcatgttccagatccagatctgagatgggagagggctttccacggggcctgccgggctgttccgtgagcaccagggctgctccagcgccagctgctgctttgttctgcctgggagcagctttgtcggagacttgctactcaaacccctcatgaactaaatgagctgttaatgctgttcgcaatcgtagactcattgaagtgtcaggtggtagcatcaatggagcaacagaaagaggttttcatagagaaagaaaagagataccgacagagaaaatggggtttgcaataatttcagtaagaatggattcagcgggggaaagaaattaataggctatatcctaaaaagaaaaacaaataaaatttggtgcttcaaagtttcaaattaggcacatttcagttgagtcatagccagacactcaagtacggcagtgtgatctcagaatcagtcaactatcaaaggagaatagcaccatttaagataattagaaaaatgacttcagaaatgagataatctcagagaggaattattcgtacaaggctcgctggtgaaacttctgaaaaagagaaccttgcagctgagttcactttatagcattatattagggtatacttatttggtgaattttataattataccctgtaatgaatcttacctgcaaagacagagaaagactcaattcaagccacccttctatttgcatatataacgttgggtaagagaagaaggaattggaaagctcttcaccaacggtgcccatcactgtggccaaacgtgggttctaaattgcagagcctccaccattctgcaacttgaactctgttttcgtgttacagattaagatctatccacttggcctattttaaaaacagttgcacacatttgaacacaccttcgagactccaaattggacttctgtaccaccttctattttcggtaaccacaagggtgctggaaattcaagtactaacaaacgccacgacctacaaacttaagaacatgagctggagaatacatgattcctgggccgcagaacacacctgcgctctggactccaattattctttggggcgtttgacttacagatcaaggaccaggtcaggtcatctttgtttgggatgtttatactcttttttgtgaagtcttcaacattgcattgctctttttcttaacactcaaaagtcagcttaagatccagtgttaaagcttatttttgtgtttctttgagattaatatgatatttccattttccatgagaaatgagactgccttccttctactcttaagcagtcctgtagagaactcctaatactcattcatctccactcaccttatccagattcgaattagctacaaaggtactcagggattctatgcaataattattcaaaataaagtcataacaattttattatttagcaaagtataatttatgaaataaatcatatttataagtataattaatatataattgtgtattagataatagagtaattgcttatcaaatatggaatatatttatatataatcaagaaattaaatataatttcttataatgtttaaatataaattattaaatataattttagcaaataaagtcataatttcattctatagtctcctctatttttatgtttaaatggatacattggtgtcctcagaatataccatttttttacaacagaatcattcaagagagacattataactttttaattctcttgatttttaatgcaatatttcattaaactccttttaagcattagaagtttttgaaaatgtgccaggtgaggtattgttaggtaattttgctgctattcttgcttcttgaccattttctcactgttttagtgcatttggaaatgagtttgaccctaagtttcttcctacctatataaatacttagaaactcttgtactgtttccaaatcaactggagcagtgcctccatgggctacatttgccgttatctgtttcactgagaaacaatatatctactgtagttaaaaagttcatgaatggtccttgctaatttctaggctgttgaaacatgtctctaatttcacagattttgaggaggcaagagatctggagttttatttctttttttttttaatagcatagtgttggatttattcaggatatgagaagacagtcatctgcgcacaacacatttgctatgaaaaaaaattgttaaactacacttatctccactcactgcttcagtggttatgttaactttgtcctgagagtagctagcattggggtaagatgtaaaacacaaaaataatgatgtattattcgatcagtctattaacccatactgattagtggccacactcaaaaagacatattgtagcgaaaacattcccaattctcactcacatgataaccaccctggctctacaagtacaatacgtgtatctttgccacttatctgttgaatgtgtactaatagcttcctccaatgaataaggactctaaacttcagggatcattacaaggtacctgaggagctgggcgactctacagttggaattattttcacattaaaagagccaagaaatctatgaactcatattttactcaatttatttgtgcagccatatataaatagatggtctattcatgtaaaagaaactattatttcaattctaagaatgttaacttcattattcataaactagtccattggtctgataagaaagcatctctcatctcacagacaaatactctaaaatatgtttatcactaaacaactggctttatttagggaacaattcaagattccctgatcacattttctgaaatgatccaattttgtcactcagcattgactctgtaccacagaaattgcattcctgttccacattgtgtcaatggaaaggaaggctgattttggtacttagctatgaatattccatactctctgttctctgaaaaatgtgaacattgagtagaaaatcatgagtatgggggaaaaataataaaatatatgaatgtgcttttaagagcatggcaatgtagtgaggcttattaaaatgccacttttcataaacaatttaaaaagtttctctaagtactaatttgggaaagtatgctaattttcaatacttaaaacctacatctgtttaaattagaatgagcacatttttgccacatgtcacattttattaccatgcaatggtaagtataaatttaccacctacataagaacaaaatatgggcaatacatttatgaatacattaaatgtttaagaaaaagcttttctgcacttcatatgatcttgttttgtttgtacagactcatgtttgtgagctgggcaagttagcttcagatataaggtatacatagaccttgggtgtggaaggtccaggagggccatgacttctgttttattcatatagcacagtgcctgccccatagaaaaaacctagctcacagtggagaaaagtgaatgatggaataatggacgtacaaagccagccaaggtgaggctgtacagtgtttatcataaacagtggatgttctgaagatgacctcttgacttgttttttatttttcttactctaagtgcctcgggtgaactctttcacctagcatgttaggactaatctgcaacgtggaatttattataaaagtgagtgctcatacttgatatttgtcacactagatactcttaaaaatgtgaaaaaaataagattgtttttcccccacaagtacatgccgtcagagtaaccattttcttctttagatcagagtgctaatagtcaacaaagggaaattgttcaacatgtacagagccccaagactctggattccttttaaactccatgtgaactgtatttggttccaaagtagagctaatcattcttaatccaggggtaaaaccaccactgccagtaaacagacaggccccctggcattgaagatcaagttggtgatgatcagttttctaatgggacagcttctaaataatgtcccaatttaaaattgatgcaaattttgataatggaaattgacaaaatgtttatattcagagggttaaaaatttgttttctattgcttagtcttgtggcatcctagttagatgtctaaacatgattggtgctacctaaatttcctttggccccattctagatacatctccttattttgaaattttcataacgttaagtagatttagaaaatatgggacggcgtggtggcttacgcctataatcccagcactcgggaggccaagatgggaggatcacctgaggtcaagagtttgaaaccagcctggccaatatggtgaaaccccgtctctactaaaaatacaaaaattagctgggtgtggtggcaggtgcctgtaatctcagctcctcaggaggttgaggcaggagaattgcttgaacccaggaggcagaggctgcagttagctgagatcatgccactgcactccgacctgggcgacagggtgcgactccatcgaaaagaaaagaaaagaaaagaaagaagagagagagagggagggagggaaggaaggaaggaaggaaggggaggagggaaggaaggaaggaaagaaaatatgaacaagcaaagagaagaaaataaatcttcagaaaaaaaattgttgacatcctagactgttttttttcttcctccctctttttattgtcgtgctatttctgatcttgaggatacggaaatttggtgttcacttataaataacggtttccatagagcccatgagcaaaaaatacagagagaatgataaaatgagaaatgtaacattttcttttggctgatctgtagttcccacaaatgggcagtctagaaaactgttgacagtgcagggtttggaatgtggccgactcaagctggaatcccactttccccacatgtgtgaccctgtgcaagttgtttaacttctctgcgcctgtttcctcttctgtaaaatgagaataatgtactcatcagagcgtttgtgtgaatagtcaatgagaggtatttaaagaatttggcacgctgcctgacacactgtgcattgaatgaatggtggccattattattatttataagaatacttactgttattttactttcttaactaaccctgcagatcgcaaagctccaataccatgtgatgtgaagactcattttagatcagcccaagaaaaacaccattaagcaggtaaatccaaattctgttgggaaaagatcatatgatgcattctcaagcaagtgcttcaggattgtggcactgcagtctctactagcctaggcagtggcaggatggctgttctttgggaataaggtctttagaaaacagtgagctcccacattctatcctgtcatcatttttgccgtgaatactccacataatttatctccagatgattagtttgccttagtgcaatgtaattaattgggaccagaagatacaagagtgtgtttgttatactctaatgaagtttctttgagttttaagttggacttcaacagttaaagaacaacatgatcacggaaagtcaaatggattgtatattaagaagatttttatttatttatctattatggaaatttatttttattctgtgtatttttttatttttgacccagttgagccttgtttggtcaatacctctgggagatcttgacaaaacaaagcgtgtctgggccaaagatttcctttccatctctggggattttttttattgatgatgaagttattatggactgagagccagttatgtgccaggccctgtgaggtatcctttgcacaaattacttcatataagagaacgactggtcctatgatctatgcacagcatccttcttttacagagaccaagcctgtggttgaaagatatggagtcacatggcagcggccacacctcctcgaaagctaaatccatgactgggccttggtccccgcaggctcctgcctggcctgccccttcctgtcctgcaaaattggaaggacattggtgcagaattggaggagccctgcctttgacaaggcacatacaaagggaaagtctgtcaaaaagcatttgttttactttcttttttaaaagaaaaaaaaatactgttatttactgacttttaaaactaagtgaccaaacattggtgacataaaattgtttcttaagtataacaaatgtcacttcaaattgttttttggattttaaaaataaccaggtaaagaaatgacgttagggtggggagagagggcagcagaaagagagtggagagatggagaaggaggaggagggaggaaatccaggcagtgggtggggcacggccccactgatgagtgtctgagccatgggcgcttggtgctattcagggaggcaaggtcctatgttcataaataatgtactacagggacagtttgaaagtgatcattaaatttacatttttaaggcaggggagttgcagtcacagccacaaatataaaaatctaaataaggtgtcttcaagcattgtcctgggacaagaactgcagatacatggcccagcctcaactctctagatatcctgctgatctcagggaattcagatggtgtttcctgggtccagttctcccccgccacccctctgaggaagcccaatctaaagcatccatgttggatgcttttaccatgacaaggtgtggagaaagaggaatttctataagtagaatgataatgaggagctgccagatttctagcaggctggggactcggtggttccccttgacatgatgcttctgggcatgactgaggtcctgggtgtgtgactgagggtcagggtgatggtgtctgagcatgattgaagtcctgcctatgtgaggaatgtgggaaggatataacaggactggtgcacccagacctctggcctggggagaagctgctttcacctccagccaggaagagtggctcccagcagcaataccccacagtaactcaaagtcattaatcatctcactaagtaaactgtgtttgattcacagtaggcaagagtgttcacagatgatgcctaaaaacacaagtagtgtgtataggcgggcttcatgagcttgcaaactgagcatgtgcacctgaccctgtgcttagaacggccaggtgttctgtttgataccctgctgtcatcatctataacttattcatcatacttttggaattgccttttcatcttgcgctgggccctgcaaatttatatagcagattcttgttgggtaaatttcaacagagataaacaaagtttccaaagtttctgagactccaatctcacatcctacaccctcaaaaatagaagaaagaggtcggggcagcttcggcaattccttcctctctcctgccactgggacaagctcacctctgctgcaccctccctgcctcagcaatctttgatctgtaccttcagagaaggtttttatcctagtccatccccagcagacacctcctgcccagcctctctctgaaggtctacatggcaaccacgggctacatgtggctcccgggcacctgccttgcttgcactgagatgtgttatcctgcaaaatacacacaagatgcgaaaaaaaagaatgtcaaggaaatcattactattttttatacttgttgaaatcatattttggctgtactaggttaaaaatattataaaagttggtgtcatctgtttccttttactttttaaaatgtggctgatagaacattaaaaattacataggtggcttctctttgctgctcaatatatttctattggtctagacattttttttaaaaccacatatccacctaagtgttccacctatatctccatctcagaaagtctcaaaccagtttcactatcttcttcccccaaaacactttttccatgtcttgttttcccaagacagaaacctggtgattaaaccatagcctgcttctactcccaaatgccagctgagaactgttggttctgtctccataatctctccacgccagcacttttcccccagccctactgtcctgtctcagctgagccattcatcttttcttcctggattactgtactgtcctcctacaggaaattcccttattttttttaaattttcttgtagagatgggatctcactgtgttgcccagggtggtctcaaactactgggctcaagtaatcctcctgcctctgcctctgaaagtgttgggattaacaggcatgagccaccccacctggccctatgtgaaattcttgaattcattcccaccctacctcagtggtgctctcacaacagagaaactatcttataaaggaaatcctatttcaccttcctgcttgaaatgtctcacagttgccctgccatctggctctggtctgcttgctcgattttactcactatctctccatatcgggcatcctgcattccagccataccaatggctcccagggccctgcagatttatatgaaatccatcgctccatgcctgggcgctgtggccacgctgctccctggtcacggtgaggctgggcatgcctgggcgctgtggccacgctgttccctggtcacggtggggctgggcatgcctgggcgctgtggccacgctgttccctggtcacggtggggctgggcatgcctgggcgctgtggccacgctgttccctggtcacggtggggctgggcatgcctgggctctgtggccacgctgttccctggtcacggtggggctgggcatgcctgggctctgtggccacgctgttccctggtcacggtggggctgggcatgcctgggctctgtggccacgctgttccctggtcacggtggggctgggcatgcctgggctctgtggccacgctgttccctggtcacggtggggctgggcatgcctgggctctgtggccacgctgttccctggtcacggtgaggctgggcatgcctgggcgctgtggccacgctgttccctggtcacggtagggctgggcatgcctgggctctgtggccacgctattattccctggtcacagtggggctgggcagcttccagagcgaatgtggacatattcttaggccccacctcacgcacttcttcagagaaacctcagaggctcctccacaagccacgggtacccccagatttccctcactctatgcatcccatgcgcctctagcaacgcaggaccacactcgagtagagctgtctgtgccgaagactgtttggcagacactgtttcagatgcgttccagacacttaggagagcgactgacacagagcagggcttgactgattacatccctcgctcatttctcccggccccgtcaccttagttcatgcccaagttttcctcttgtcgaattcatcgacactatcatttcgtaatcttttcttgtgcccttcatttaatttgatactgttaccagttatatatttttcacccacaaatatgatcattacttttcctctgtaaagaagctccaatggttctctctctttctctctttttctttccctaaagaattaacccaaactacttaacatgatgatgatcctgatgctgatgacaaaaataggcatgggtggccattcattctgcctctgacgtgccaggcgctatgccggtcattttgcagtaatctcatttaatcctaatgataatactcagatgtaagtgctattatctcttccccctaagtagggaaataggggtcaggaaaagcccaggagcctgttccccaagaccaagttagcactacagagctgggaatgaattccaactttatgtgactgcaaagctcttccatgcccccacaccaccccacgcccggttctccctactgttcctacattccagacgcaccatccagcctgcaatgtgctttcacaccatgttcacctgcagacaatgctttctccatctaatgcccctgccttcaccatgcacacactgaagttgcctagaagggtcagtcacactctactctgtgccttccttctgcctcggcacttgtgatgctgcgggattatcagtttcccctccctcatcccaaagactgaacagtcaccaagagtagcaagtcgactagtcaccactgaacatacgcagcctggagaatcagaggtgcacggtgtgtgccttttacatgaactcatgcatacaccaagaatgatagtaatgcctgctcacatttgtttagcatctcccacatgccagacctcaccctacacaattagaatacataatccattcaatcctcccaccactctttaggataatgtatcatcttaatccttatttattttttccagaataaacttgtgattctaacaacttcaacataaaataaataacttttgctcaatatcaaactctataaaatcactaaaattggcccaatatcctgggttttttaacttgcattatttcttcctgataatgacatttaggccagtcaaatcctgtattaccgttttaaacaaagaaaaaaagattatgagttgcttttaaaattcacgtgtgacaagcagaaaaaactcgtggaggcagtttcaacatttaacctaagtgtacttagcaactacacttaatagctttttaaaaagcctcgtttttaaaaaaagtggatctttctttgcagagtgacttaaaatacatcatcatagtcttattaattaaacatgttcttatcagaaaaaagcgtctcgaaagctagtatatatgcttaattaagctgtatgcaaccatcagtccatatcttgaattaggctacatgtgaggccctgatttgccccattctttctgctacccagaacagcactgctcactgcctaccagtgtttccagcaaagatataaagttctacatgtctaaacgtttttgccctgatatcaaaagcaaagcaaaacaggtcttctccattcccattttggttaacagcatcaccatctgcccactggcctgatccacccagaagcctgtcttcttttttgaacttgaaatactcatgtgctttatttgtataaattcccattattccctcactgctccaaaaatagagaagaaagtaacataaatgtactgacatcaatttgagaactagaacatgttaccttcccgaagtatccatcttggatatagggaaggagacttagcctcataaaagcacatgaaggaatgctcagaggaaatactctaaacctagttttctggaattggtaagcagaagctctggagtcagttacaggttgtgagccttccaccaagaagagccacctaacataccaaaaaaataagcatgagattcacttaaagtttgacaaatttagcaactcctttccattgtctgcattttagagaacctattgatgctgttgtaacagctacagagaatcgtgagatgcccagtgacattggctatagtggtagcaaaccgggtagtgggaagttttctaacaaatactatgtaaaaggagaagcctgagtcttttaacaccacagatcaaacactgcaaatggtaggacgagcattagagtcccgctgaggtcgctgagacttacacttcacacgaattgtagtggtgcctagatctccctgaagagtggcagaagcagccgcccatcccttaaactacacatgtacctggcttctcaagactccagagtttacttagagatgagtaactagagcacaggaatttggaagagagtctttctataaactcccaggaacaaccaacaccagtagtggctgacgtctgtgagaccttctttgcgtcagatgcagtgctctcatcaacatccaacacacgtgcctttaatgcctgggactatggcgacactcatttagatgagggaactgtggcatagagggtttcgtacctcggcttacttcactgcaatcggctttctaaaccagaactcccacccgacaatgtgtgagtccaaagtccatgtttctaggtgcagtggctcactcctataatcccatcactttgggaggctgaggcagacggatcacttaaggccaggagttcgagaccagcctggccaacatggtgaaacccgtctctgctaaaaatactattagctgagcatggtggtgcacgcctgtaatcctagctgctcaggaggctgaggcaggagaattgcttgaacctggggaggcagaggttgcagtgagccaagatcatgccactgcacttcagcctggatgacagagcaagactccatctcaaaacacaaaaaatacaaaaagtccatgcttctaaccactagcaatcaccctataacatattcccctcaatgaaaaagactgaatccaagaaatctcacctgcgtcagactttctaagtcatagagatttatagtaataattttaaatgagtctttgactttcagacccagcgtatgaaggaggagagtgtgagtcagtgccgttcctgggcgtccgctgggaacttccctgactgtccttctggctctcaggagtggagctcacttgctcaattcattccagtgtcccagaggtcacagtctcccctctgtgagctgggctgtcctcggtccctgggcctatctctttgctgtcctccctgggatcttgcccctggggtagccctgcttcccttgcagctttcttctctgctgctggtgccttccccagggctgtgcatgggcttagctctttcttcatttctctccctctctcctcttttcttcctgctgtcttagctgggccccctccatccttttatttcctaattgtacctgttgcttccatacccttaaaagcatactccattttctccctagatgtattgaggtataattgacaaagctgcagacatttaaggtgaaccacgggctgctttgatacaggcatgcactgtgcactgatcaccacaatcaagttagtgatcacttcttatcttttttgtggatggtaagaacatttggatctactcccctagcaagctgcaagtgtgcaatgtggttttattcactacagtcaccacgctgcatgagatcctcagaacttatttgtcctataactgaaagtctgtgccctttgacctcattttcctccccccaccaattcctggcaaccaccattcgactctgtttctatgagttcaacatttagactccacatataagtgagattgtacagtatttgtctttctctgtctgacttgtttcacttaccataatgtcctcatatgtatgctgttgcaaatggcaggattttcttcttttttagggctgaataatatcccattgtgtgtatatacaccacattttctttatccattcatccatggacaggtccttaggttgtttccatatttattcctttcctttgtatgtatatccagaagtggagttgctagatcatatggtagttctggttgtaatttttgaggaaactctgcacaattttttacaatgtctgtaccaatttacattcccatcaacagcttacaagggttcccttttctccacatcctcaccaacactcgttatcttttgactttttggtgatagccatcctaacaggtgtgaggtggtgtctcactgtggttttgacttgcctttccatgatgcttagtgatgttgagcacgtttccatacgtctgtttgccatttgtatgtcttctttggaaaactatctatgctggccctttgcccattttttaactgaatcatctctctctctctctctctctctctgtgtgtgatgctcttgagttgtaaacacatttcttaatctttccatgtgctttaatctcagcactttagcaactgtcaagaacaaagttcttttcaaaaagttcatctcaaagttggccactgactcgtaacaggtaaaacccaatgagcacttccctgagcctcagtttcttcttttctcatgtgaaacagtgatgatagtgcatacctcccagggctgttgagccagactcaacaatttacatgaaagcactgagggggtgccaaatacatgtgagtggtataaaacaattcttgatgctacaaagcttgcttttccacactattgtcaaaatcccaccttgttcgagccccaattaaaataccattttctctaatccatctttcccgatcctctaacaaacttcaattctctgagcaatttattatcatcttctggaactccattgcttaagacgatcaaagagtttctttattgtataagttacttctgcgcatgtcttttgaaggaataaataaatgcattgattatatctgccttatagcactccatcaccttctatcttaaattacagtaactagcgttcctgtcttcctgcactaaattgtaagctctttcaatggcttcctggcttattctctcatcttttcctccggtccttgatggatgtataataaatgaatgagtaaattatatgaaaatgcaagtatgatttttttaatatacagttacaacttcgacatccacagttgggtctgaccacttgttaagttgtacccagaacttaggtctttctcgctctccacgttccctatcaaggccatcttttcaataccaaacaaattagaaagaatacaatcagctaacttacactaacatactaacaaatgggacaacagtcttcaaggtctggaagaggagagcagagaactcatcattgcctgctcaagcccatctaccaggaggggaaactccagatactgtgggccacttggcacttaggaactcatggtactgatctgtatattgggcagatatagttttttggtgatagtcttaaaaatcatgtgtcacctgtcatgacacttgccagatgaaattctgattttatttcccaagagaatgcactgacaaattaataatctgacctttaaacgggtgatatttctccatgtcaatcaacaagaggccattctgttttgttgaccagataaaatactctttcactctctgaggggttagcgagagtgcatgcagatttctccaatgctttgcttttggttggaagcagaaacatttaaatttcaaggcaacacttttcctaattcctactgaactcaaaagctctagtggttcagtgatcccattggtaacaaatacttagagggccagagtccttctgggtcctatccttacgctcctgttctctcctcctctcaggccttttctgcaccatgcaaacccagcacctcttctcacaggctgggctaaaggcagaatgcaataccatgactgaggagcctgggaatgaggcaattcattaacagaacattccccaggaaacataattttctgatcataatctctttgttcctgacagttgcaaaattaaataccagagccaaaaaaaagtgaggcaccgttttaagggtatgttttcctaattcgatcttcaaaggaagcacaagcttagggttcgaaatcattatgatgtaatattatgccacataataatacatagatccaatcattttaccagataaccgtcaatataaagcactgacaggacatttgggacttcgggtcaacaggaaggtggtttttcaaactaaactatattatttatggctttgattgtcatttacttttacaacataagggtgatggtaattctgctcttctgccaataaatctaaaaattaattgaaaatgtagtcaaaatccttggcacactttagaaggaagatttttttaattaaaaaagccatattaatcattatataaatgagttatattagtcctgtaaaattaaatctatggtggaaaggaagtcagtgagtgatataatcggatttcagaacacatatcatataaaaagttatgtttctaaataaagtgagtgtgaaagaattcaggatatattatcagtcatctgagttactgccctaagacagcccttctcccaaaacagatatggtttctctgacaaagaagataagtgtgccttctcatatttttattattttcttaactgtcagacataactcatatgtagttaagttgctcagaaggttaaattcggaggaaaaattctacaagtggtttaaatgagccaaatcatttttggttgcgtcatgtttcctccgttgaaaaagtctcgatgacttaaaaaggattgctttgatacttagcttagtgttttacccaaaaagcatactgaccaaaaacaaacaaacaaaaaacccataacaaaacaaacatttaaagatatgtagaccagatcagttttctcctgatgaaagtcacatggaaccacacgcaggttaccttgctttcagcaggtccctttccttgggtgtgaattttatttgttacaataaccgacttggcctagttactcagccatccttcgttcactcttggtagtggacatggcaagatggtgggtaaaaacacgtaaacaagactgctctctcgtggaggtcactttcacatggaaagactggacacgtcaaaacacttcattaacatgatataaaaataatacaacatgtaaagtggtatcggcgcatctaagacaaagcgattcaatgttaaatccctctttgggaaataatttaagattgcagaaaatgtttctgagaaattccaatgtaaacgtccttaaaagtccctactttttagtatttggtattatacttatagattttgtgattttccagatttttcattaaaagttaatatgcataaaactcttgggatggtagcaagtacagagtgaaatctatataaattattattattatcaatatcttttggagtgaacaaattgaacattttttgaataatcttttgcgtagttgactgaatactagttaataggtttctattgttttcttgagttaaatcagaagcagatattttgattgactgtgtaaggtcttgcagcttctatggttttttttaacttgaaaaggtcttcccagactgatacctctttctgtcttgaactctctgttcaactatattctaaagccttaaaatgaagatcttcaattttataactctggatttaaacttttctttcttattcttttttattttacaaaagaaaattttaactctttaggttgattatatttcttgatgaatgtgactgtaccaagaggctttaaaaaaattgagattagaaatcagtttttcttatcttctgaattattcaccatatgatgtgttgcatttgagctttatctatgcttctggtaatatttctgtcttatataattgttaaagtataatgcttctcaccaggaagactatatatatatatatgtttaataatagcctttttaaattttcatgtgttttttcttctcctttgttttctgatttttaaaaaatcagaaaaatgtctgaattgtcactttatctgtagattcaaagagcactttctaatcatgtgttggcattagcacaacaccggggaagatctgattgctgtaagccgttcattcattcagcaaatactgactgaatatgcagtatgttgacctgtttgctgagggcctctctgttccggctgccattctaaagcgagtcaagttttccctgtaacttttattctgcagaagtaacctgtacctttttccattctcttgccattcaccactctcctgacctccctttgcgtaaactggtttaagcctggcgctctaggtccatccaacaacaccggtctattcacactgtagcagagcaaccaagcagttatacaattttcatcttaactactagtaatactatgctataaaaattttgaaacctagattttgagatattgagcaaactaaaatatgtagtatttactatagtgcaagaatacgtctgacgggttaaatgcacgcgttttggaaagtgctcaaacccttcaccagatgacacagttatagcacaacaacagctgaggttattgttatctaatctcctttccctcgttaactttagcacagagaactgaaataattgggtgtgaaggcatcttgataatctaccaaaaaggctcatttttaagcagccaagcgttgctctcttaaacttttgttgtttagtagcataaagtgtaggcaacctgtatgaagtataaatatctggtattaaaaagacccagtgaggcagaagtcgctgactcctctcaataggtggaagaggattctccatgcagccgaaggcttaatgaagcacatttccaccagccaggctgctgcctctgtggtgttacctcttcagaggactcagtgcctctgagaagctggctgtcctcagcgagaagtaagtacagggacttctgtttagaggagactagaatgaatatttatactaataaattttctccaacatagccaaaatctcatttgaatatgtttttctttctgtgcatttaaaacacttgccattcttcatggcatcccatgcttgtactcttagaggatcttcacgagtggcacagctcttggctagaatcctatttttttttttttttttttttttttttttttttttttttgagacggagtctcgctctgtcgcccaggctggagtgcagtggcgggatctcggctcactgcaagctcctcctcccgggttcacgccattctcctgcctcagcctcccgagtagctgggactacaggcgcccgccactacgcccggctaattttttgtattttttagtagagacggggtttcaccgttttagccgggatggtctcgatctcctgacctcgtgatccgcccgcctcggcctcccaaagtgctgggattacaggcgtgagccaccgcgcccggcctagaatcctgtttttgctatagtttgttggactccttgcggctaatccttgcagctatattagtctctgagggatgctgaattgaatagaacatcagaagatttggagcctgacgggtttatgttgcccctgtcctcaaattcaactattccagaaaaaatgtactaggacaaggaacctgaaaagaagaactatttctaacaatggattggatgaactctcccattcaaagcagaggatataattcattataagacttgtaatttactttaaccactgggaaaacatctcagagggaagagagaaaaactgaatttctgattaaatttaaaaaatcaaaaatttaataagtaggcaaccgtataaatgaacagaaaaaaacaaaatatcaccgaaactttcagataatgttctttgttaaaaataagtttccctaaattataatatgaatatataaagagaaattagaaaatataatgagaacattaccaggcctttttgttttctttcttttttattgtgtttttgtttttttgaggtgggaaaatctttgaaagtaagacccttgattggattcaggaaagtgaaagctttctgaatttttgctcaaataatgcttctctaaggtacagaatttaatgctgaatttatgtctacctcacctgtatagggaagaggaaaccactgcttttttggccaaaattcctacttggtaaactagtatatttccgttttgaagaccaaggtgcagtgaagtgtggtggagttccatatggatctgttatgctgcaaacaccaaagtaaaaacccgtctttgctggttccccgtcatttattcagcaaatatcatcttaattgaacttaagctgaaacgtgagttcttatttgccaatactcagaactcaacagttgcagaagtgtttccttttaactgcatgtccatgtcttgagtttttcagaaataatacagaaaaacatattttgaaaacatatttatctgtatttttccacgtgacagtggcagtttaggatttaacaggcatatccataattaaattgttagtttgaggaacttccagaaaattatctaatgcaatcatatatcacaagtcttctttataaaatacaagtgcaactcatttcattatgctatccatgtagttagacataactgagacctttaaaaatattataaatgacttaaaatagaaaatgttagaaacagtacaggcatattacaaaatcatggtttctgaaatctaattactatatgcaatttaaaataattaaacatgattagtctttaagatgaatagaaccaattccaactttagctattatttaattatagcatgctgtacattaaaatcagctggaagatagccaaaataagctttaaaggacagcatgataattaagaattgctatttatcttacttttattagaaaactcaatgctggaatgaatgcaataatgtcaagaaatatgaatttaaataatttcctaaatattttactttctaatcccaaatatcaggatattttaaacttcctcatcaattctactttatatacaaaaattcatacagtattaattagaacttttgctttcaacacagatatcttaaagacaaggaattatgtatttataacttcttaataaaactatgggtacattcttatttttgattgtggcagttttttcataaaaaggctactgaaatcaggcttatttaaaaaatactaataatgttatctaatatagaacagagggtaggaagtctctgtaaacaaacctatatctatatcaagagtgattctaagagaatattctctcccttacccaggtactcaagttgtagggtaacataactagtgtaacgtaactagtgatttccagtcaccttttaggtttacttaggaacattaaaagaaatgctgccattgtagacttcatttcaattatttaatctctttccagttcacgacctttactttcttctggtttcagcaagaaaaacaacttcataagtgtcttacattataatcggctactaatcatcatcaactcaacattagttttaaacagtctgattccataacaaatttgtaatagggatattttctatacattttataatagccatggatagaaaaatagtattatttatatactaaaacattcaagttgttttgtttaaaacatacattgtaaaattttccctcgggaaatttggatttattataggacagttgtagcttttatgaaattgggatcctgaagccatattttcaaatcagaaaaatgaaagcctcattgttgtttttcaaatgttttaagtttccttgataaaaggcagtattaggacttctatttctaggtcaagtctatatttacagtaactaataggaaaatattgaagtctgaggttaccagtacaatgtctgaatgcaaaattctggacactggacaaagtactttagaatcagaggccagcaaagctctggaaggctgtgaacagggacaaatgcaatatggttcagcagacagaaagtcagaagtaagattcagatgtagccaagcagggtgggggacagtgaggggggatgtctagctggacttgaagggcgtatgaaagcagctgtccttgcaggggagatttaaaggaaatgactcttcagggggcactgcatttgcaaaaaaaaaaaaaaaaaaaaaaaaaaatctgatatagtatgttttggaaattccaaaatatttgatattgccagcagaagagttggaaagtggcagaaaataagggtctaaaaatagccataagcgaaagtgcaaagtcttgaaggatagagattatgtctctgaacctggttctcaaaattgttgaattattaactatggagatgcgctgtacagaattgaacttaaaatggtcatctgtgtatagcatgtcatcttaaaaggttactaaaataggaaagaacttgcacaggtataaagtgtgtgccattcctcccgtgggctaagggtcttgtctcacttggtgccactatcaatgcaacaggcacagcagtcgggtgtgccctggatatttctacacctcattcttctaaaagctcccccaagaaaaattaataggaaatcaggtgcttgctgcaggtctttgcactgtgtcaattctaagaaatcctttggcagtgtaaagctttgaaggaaattaaattggagagagattttctctacctttcattcagctcatatagaatcccttacttagctgatatttttgctcatagaattggactcagaactaagtctgttcatttagctttcctttgaatgttaaacataatgaagtacaaggccgtcacctcaccattttatcccctacaacccgcataggcgtacacttatcaccaaacgtttgcacatgtttggctccactgagattcttagtctctatctttatattttgactattttgacatttagaacaaaagtttggaaaactattctcctactgctttagcattctcttatcttagggcttatgaacattgctacatctctgaaacaggcggttcctgcccatatctatcagtgaaaattatacttaaaattctgaagagactcatgtcatccagattttggaggaaaaaggtagcaaataaaaatatacttcttagaagtagatctcagttactacttattttaaatttcacagtagattccatcttttgtagataggggttttgttcaaagtttttgaccaaacatttttattaaatattttcaatagtattataagtgatctgacatttttggtaacaaaacaaccaaagaactgacttgagtaaagctgaaatgttgctgaaccagaatctaatccttactccgtcattttcttaccagggattttgatttgactgaccagtttcaatccacagtaacagctttgttcctaagagactataaatcaaggaaatactcactaccaggcaattcctcctgcaattcggggtctgtgctgttattatgaagcaactgacagcaaacatttgctgcaagtatgagcgcagatttggatgaggtgtgcggtgtttttggtttcactctttatctctgaaacctatctgcttgtgagaaaaattgtgcaagaaaagaagttttactgccacatacctcagctgtcctagaactcaatgcagaggcttcgcttcctttctttccttggattctgagccgggggagcacaatgggggtcttgtgctctgggccagcaaggcatgcagatactcggaaaggaggtgtgaacggcttccaatacctacactgtttgctttacaactaccccaactaaatcaaacaggacaccaagacactcagtccagggtaagcaagtacaaaatccactggctattatgacccacatagagaacagaattcttcaatttaagtgtgtacatagctgtgttaagagttaaataaatcatttacgaggcttaaaaagaaatgcttctcatgtagttctttttcatgtagttctctgaatacaagtcaaagtgcaggtcacgaaagaatccattgttcacaagcgagaaatgttgttggctgtgaggacggttcagaacaagccatcgtagtctgctcaaacagtaaatattggttttaaaaccccaaagcatatcggtcatgttttttatcttccaattgctagaaccaaaattcactgaaacaactctatgtctctgatactattttctagaaatgtgtgtgtatgcgtgtgtgtatgtgtctgtgtatgtttgtttggtaaatccaaatcacacaatcaacgtaaatctttcaggctaagttttgccccagttatttttatgctgtgctttcaaaaaggtcaaaaaagcttacctctgtcagtgtactgggacgctcaggaagccccttctccgcctcggcctcagcgtgcagacatatgccctgggagcccacaatctgttaacaggaagcaggtaaacccgagagcgtccgcctgcgttccagtccagtgcccgtcccagcacacacctgctttttcagacctgccgctcatatgccacagccacgcacaggaccagcgttagcagagtgcaacaccctccgtttggatccctcgttttcagggtaagcagctagggagctgctgagataatattgcagggaaagcttgccttcccaagacaaaaacctttgctgctgcctgatagcagatatgcagcattatcactctgcattccacattctccaatcagctaattggaacggcagtcaacagcctgtccaaaaggcagcttgcaggcctgcgtggctgtgatcattgtatactaacatgcccattgcttctctcttccctgaagagatgtataaaagaggcttcttccagggcgaagctcagcagaatatgccacactgttttccataagtaaaatggctggtcctctcagctctgctgcagacagctcattgggttccactggcttttcgtagccatagcaacaaccaacagacagacttagcaagcatggctgatcatgtgcagcacactcacacagcttgttaatttcttttcatcaaactcatcatttttttgaggagggtagcttctgttatctttctacacatttcaccgatagtgcaagtgctccgatttttctgctctcctgaagaactcttttttatatgagccggggctatgtatgaaatcgaggaagtgaagccctattagtggctatccaggttaataacatgcaaatcacttaagagaccctaactggaagcattgtcaaaacaagccccaccttccagtcatagaatgagtgcagagagctgcaaacgggagagttacactttttgtttttaaatgataatcttagagccacttaattgaaacaaaaccctgtgaattgctatatagggtcagaataataactaaatcaggtagactattttaataagatctttaaatatccatttacttatggctcaacttatctgattactttaagatgctttttatgcaatttaaaatagaatttttaaaaaatcctattgcttctacggcagaaaatgattctttaactcaatcttatttgtaaattaaaaattctttttaaaaaatccgcacctaattaaaaattctttgactttaaacattaccttcaaggcaagaatagttttacttcctcagtaaaatggatcacattccacccgtccataacatttcacctcctctgggaatctaccatgattaatgccatgaacaacgtaaatcttctgcagaacccccaggcttttcttctttttcaggactctatcaccagtcatattctatctgatatatttccaaggcactgtcccatttatttttgtttctagcaatctgtttcaaatagttatgttaacactttggacttgtaaatatagatgttctatttgctaagtagtcattgatttaggattccgtcagtattgcgtttccctacccatgttaacactcctgccttcagtattaattcccaaattttgactgcataggaatcctgtggatgtagatttggggatgcccgctccccttcctccccaaccggattcacattaggtaggtctgagccacccagggtcagcgtatccatggaggacaagtgggtggcgctttcctgcttgggagagtcctcaccgcttcagatcgcctccagccagcctaccttttctcactgaagttcccttccctgaagttattttgcatttgctgttgctgagcgtgcccctgccttcgccctcagcctcccattctactattcactgcccacgtttcagaatcctgcattacacaccatttccttgccctgcagatgctgctactattaaaaaccttctcaatctgactgctcctcgccccagcacctttaacctccatcccaatctgcctcctcttttatcttccaacacctggcccaaatggaccacctcactcatgactctcccaggtggggtctgagcgacctcttctgcgactcccctgtaccggggtccacctctgctattacaggccttgtcacgccctgggacttcttagcagttctccttttatgtctgactcccagactgttctatcaactctctggaagccaatctggtccatgtcttctttgccctccatgcttggaatattctaatttctcaatgcctctaaatgaggacctacgacactgtatgaatagggactgatgactggctggtgtgaaatctgtgttttaatttacttttcaacatcacacatttgttgactcatcacttcagaagaacttcagtgattttgacaaaatgctggcatgttacaaaaggatatcaagaaaactctaggtgcacttgatgttttagggtggcttttcttttcattgtatctctgaaaatgtctttataccctcacacttgattgattggttggcaaggcataagaatctctggccgtggctcacacctttattcccagcactttgggaggctgaggcaggtggatcacttgagcccaggatttgagaccagtctaggcaacagactgcatctctacaaaaaaaaaaaaaatcaaacaaacaaacaattagccaggcatggtggtgcacgcctgtggtcccagctactcgggaggctgaggaaggaggaatgtttgagcctgggaggtcgaggctgcagtgagctgtgatcacatgactgcattccagcttggcaacagagggagactctgtctctgtttttagtagcaaaacaaacaaacaaacaaacaaacaaatatctgaagtcattttcctttggaatttcaaaggccttcatccttcttcttgtatctcctcctcccctatacctccaattcctgctcctccaaagagaactggaagtcccccagtttgcactgaaccggaactgggaagctggcaggaactgagatgaatccctttcccctctttgccccgtggcacgtctcccggcatctctactggccttcacacatcactctgctgccagtctgttcttccaaggctcttggctccttcgcctgctcgaagcccctcccttgtaacttggtgcactgaggcccattggcattgctctgacctcaggccctgccctagcccaggtccctgacgtttattctccttccaaacgtgtttgttttaaaatgtgctagatacagatttccaagagacaaatctgatttttccagcccatctttctgagtcaagtgagataccacctatgtggccagcagctttatacatgggctgccctgtgccttggtccaatcagctatgacaaggacacttggcattatctagttttaaaattttgctaatataataggtgcagagtaatggcccattattgtttgaatgtgtgtttctctaattactgacaaattgaacatcttttcattgttgatggttttcagggttccctcttctgtaaattttctgttcatagcttttgcctgttttctctattgagattgttgtcttagtgtggaattttaaacaacgtggtcataaaggtattttttatatatatttaaacattataattaaatttgttatattattaaaggttattaagatatccactaacatataaagggaaccctataattcacactgctagttgttttggtttttattatgaaatgaaaatacagaatgtgtgtgaaaatctccattcagaaattatgttcagtatgaaagcgtagaataccacaccataatatgattttctaagacaaatatttgtttagaaggattttcaaacaaatatattatcatcaaagaatacatatacacacacatatatatgctctaatagtatacgcacacacatatatatggagagagagagagagctatctatctatctagcttctattttaagttataccgtatgcacacctacacatcaatcaatctacctatctatcatctgtgtatcatctatggaaggcaaacacaaatgtgcaaaatgctaacacctgatgaatcttaaatgagaatattttcagtttattttactattctttgcacttttctataagtttgatttgttttcaagatacaaagttttaaaaaatgaaataaaatgagaataaaaatagtgtttagaatagacacagagttaaggttaagattagttgatgaagacataactatttatcagagttgaaactaaagaagttaataagttatggagtaactaaagtgattactaccattactgttactctgaggaggctactctggtagagagtattggaaacattttgcactttcttgaaacaagtttgctatttccctacatttactgcttccctgtattctgatcttaaaccatttatcctctggttcgtattttgaaatccttattagtctgtttccttaattcaacaaaatcatcactgcttgaagcaataggttcttctctagtcacatcttctgctgcagactccacagctgggacccaccaaaggatctggtccctggcacaacaaagaaacacgtcatatgacttaacttagagactggaattgaagcatggtttatgaggtagcaaagacttttgtaaagcttagattgaattttctaattcctaaaacaaataaaatagaatatcccaaaggttattccaaaaccttgcatatttagttactctcacaatgacgtgaacaatgtcaaaataggacattgatgggaaatgtgacaactgacttaggaggaggattgaagtatctcagtcaaacaaattggatttatttctatgattccaaccccaagaaatatatgctggaaagcagactgacccacaggctactaatcaaatgcgttcatatcccctgaagaagtatgaccctgatcagtatccagaatgacttttataaatcagaggtgcccaaaaccaaaacaaacccagcagagttgagggtttttggaaattcacttatcaaatgaatttaaaatgagaaaatgattatagaagaacaaaaccttgccagagagcaaatgataagaacgtaaacatcagcaataaaaaaccgttcaacaaactggagagaaagccaaacctattaacacaaaaacactgtgtgtagcccattagttgttcctagaaccccctagaaattctgtatactctctaggttaagaggaataaggaaaatgtggcaagaggtacaggaagaagtttcagctagtcctaagtctggagagcccggtctttactggctaataataacaacattgttttaaatatttcaggtttatcaagctttgggtttgcaaatgactatgattgcagcagcttacaggaactactttatcgtaaaatgtgtgttaatatgtgtcagtaccaggtggggaaaaaataatggtgttatccaataataacaaaagaaaaaaaaaaccacccacaattaaccccctcccacagccctgttaaccagtcccaaacatataaatacatcttgctgtagctagagaaaagtactcctggcttttattaaacctgcagtggggagagattctgcaagcaatacagaaaaggctgcacttgctcccaaggaatttgactgtttatacttcataatgataagcttaaaaagcgacctggaaagagagggctggctgctttcatgctcctgtgaggggccacactttgttcttggagaggcactctgaccacattaatagagtgtagctcccatgacctttcccacttagcattgtgtcctgtggcagcagtggcccccaggtacttccgggcaacgtgccaccctacccagtgcagaaaaagcactgggctctgccgtcacggcattgttgaattagtaacgaaacgcaccaggctcagcaaacaaaacctggcaagaaggattttaaaacaaatgcttctggtttcacctgagccactgaaacaaattagaaggtgctgggtgaaactgggcagcttccgtaaactctgaagaagatcatgctaaagccctcagctgccaaatgtgcaaatctcaaaagaagtgaaaattagagggtcaccttgtgtcttctagaagtgcttctgaaatacatgttcagtaagattcattggtcaagataataagatgggcccaagtgatgtattaatacaatcaggtacacgttttaggatccaacggtccaacaacaagtggaaaatactgttgaaaaataaaaatccccaatccgcactggaaatagtagatgttcagttaaaggcctgacagtgacagcacgtgcaggtaggaaaaataaactatgcgtgcttgcagaatattggatgggagctataacccagaatggtaattattttactaagcctacccaggtcagaattcagtgcctatgtgtttgtttgtttgtttgtttttgagatggagtctcgctctgtcgtccaggctggagtgcaatggcacaatcttggctcactgcaatctccgcctcctgggttcaagcgattctcctgcctcagcctcccgagtagctgggattacaggtgtccgccaccacaccaggctaattttttgtatttttagtagaaacggagtttcaccatgttagccaggatggtctccatctcctgaccttgtgatccacctgccttgccctcccaaagtgctgggattacaggcatgagccaccgtgcccagcagcctatatttttaaaagtcagactctggcatcctaattgccagatcattgccttgaactgagaacattcttctggacatttcctgcatcaaaggaagactatttgaaacattccttgtgagaggtcaggagatcgagaccatcctggctaacacggtgaaaccctatctctactaaaaatacaaaaaattagctgggcctggtggtgggcgcctgtagtcccagctacttgggaggctgaggcaggagaatggcatgaacccaggaggcggaggttgcagtgagccgagatcgtgccactgcactccagcctgggtgacagagcgagactctgtctcaaaaaaaaaaaagaaaagaaacattcctt

SEQ ID NO: 608 - DNA, 330767 bp, Homo sapiens
aaacaaaaactcagtggtttggagaaaaagaaattacctaattacctccctcttcaatccagtccttgagtcctactccaatcagacaaacccacacacaaacacatagcctgtcatccatcacctccatctgcttctccttttctgtctgctcagccacatgcttctactgaagactgtgtctatgccaattttccaaagcttcttccgtctcgggccattgctgatacttgaccttttactttccaatctgttctgtccatcaccagtgtttaatatttctatcatgtgcatttaaatgattattagcgttctctttcaggaaagaaccccatcttctctcatttgtcttactcgaaggtgacgcacagaaaacttgataccaagttgttgcttcatgagcactcaggattggccagcttcatttcatgatctgtctaggttccttgctctaaatctttcaccggatcagaaacatgaaacaaagtggtgctttaagttgcacagtctcccccttattgcttgaatttaacgctgccgtcacacaacaatgaatctttcacctggaggtgtggtggtgagtgagttctcactcttagttcccgtaagagcctgttgttaaaaagatcccgtcacctctccatgatctctcttgcttcctctctcagcgtgtgatctctgcacatgccagcttcccttcaccttccactctgagtggaagaagcctgagcctttcacgcgatgcccagtcttccagccagcagaattgtgagccaaatagttttttctttataaatcattcagtctcaggtattcctttatagcaacacaaaataaatttagacaattcctctctgatttttaacttcttcatctataaaatggagataataacacattctttaaggtatctttttaaagcctaaatgaaataatacttaaaatgcttagcagaatgtctgacataaaacaggatattattgattattaattgttatagtaggcagtgaggtggcccccacaaaaagatatgtccatattctaatccccaggttttgtaaccattatcttacacggcaaaagaataactatttgtcttatagggcaaaagatgttattaatctaaggaccttgagaggtggagctatcctggattatcctagtgcaaggtaaatgtgatcacatccatccttatcacagagaggtggaagaaatttagacacagacacacaaagaagaagaagatagacagaagaagagtgggtgatgtgagacatagacagagattgaagtgatgggcccacaagctaaggaattgctacagccaccagaagctggaagaggcaaagaacaaattatctccatgaggtttcagagggagcacagcccttctgacactgatttcaactcagtgaaactgatttcagatttctgacctctagaatttggggaatataaatttatgttcttttaagccaccagacatgtggtactttgttacggtggtaatagaaaactgatacagattttattttgttttgctttgttttgagacagggtctcattctgccacccagactggagtgcaatggcaagatcatgtctcactgcagcctcgacggcctgggctcaagcaatccttctacctcagcctctcaagtagttgggatagtacctgacagtagccaccaggtctggctaattttttatttttttgtagagacagtgttttggcatgttacccaggctggtctcgaactcctggactcaagtgatcctcccacctcagcttcccaaagtgctgagactagaggcatgagccaccaggccaggttcaggttttttatatttgttgtaataaatttctaaaaatgtagaagtggctttgcaattgcatagtgatagaagctggaagaatatgaggaagcatgataacaaaggactacacttctttgaacagactatttgtagaaatatggacattgaaggagattctggtgagagctcagaacaaagtgaggaacaaggtagggaagtcttctatagttttagagaatacatgtgttgtcatagaaagaatattggtagaaatatgaatgttagaagcacggcagaagagggttcagcaccaggaataagcagcatgttattggaaactggaggaaaagggatccttattatatactggcagaaaagttggcttaattgtgtcctacaatttttgtgtcaaaagcaggatttataagcaatgaacttggatatttagctaaggagatgaccaggtctgctgtcaaaaagtgcaacctggtttcttcttgatgcttattgtagaatgcaagagggaataaatggattgaggaaggaactgttaagcagaaagaaatgatgatttaataattttggaaatttacaacctatcaggattaaaaagaaacctaactaatattgagactaaggatcaccgttagaaaaaagaaatgctcttgagagaaagccaaagttgtggctggacaggaatttaataattgcagatgtgtgacttctgaactcactcaaccgtctcaacagaagctaagaagagttgggtttatccaggaaaggcctacggagtatgctgttgtttaattatatgagtccctgtgacaaacatgggagacccacaaggttttggggaatattgtatcagcagaaacactgccagactggcctgaaagggacatacatgggacataatgaaggcagactgtcagacttctgggattttataggcagaaaatgggctgatagaactagttggctacaaacatgtattatcattcaaaaaaaagagaagaatgactctgagtgcagagccttgggtacagagggcaaagctccagacccagagatcatagcttcaagcaacagaaaataattgtcaggtcttgaaacctaaggaaattttccttgctggattttgaactggcttggcatcagtgaccactttgtatcttccattgtctcccttaaaatggcagtgtttataactattaactacacttgcccatcattgtattttggaggcagataactttttttttcgaggttctcatgtccacagatggagagggattttggtgtcctatctattggccctgtcaagttaatatataaaactaacaatcacacatgtatccttcaaagcgaaaggaaaagggagtcagagatagacacaaaacggaggacatacacagagaaggcaatatgaagagagcagcaaagattggaatgatgcaactacaagccaaggaatgctgagggttgatggtgcctaccagaagttaaaagataggcatgcagcagattctcccttacagttttggaggaagtgtgaccttgccaacactttgagtttggacttctggccttcataattatgagaaaatacatttctgttgttttacgcctccaggtttgtagtaatttgttacagcaacctagaaaacaaatacagttctcttagctcttggtaatccccagaaagtagaataggcattagcccagagtaagcataaaatgttactgataatgttatgtcctgatttatagttcatttctgaggatattgtgtgtgctcagtaaatgttttttgacttgaataaaagtcccaaaatgtgcaaataggtgtcacggacatctctaaaatagcctcaaagaacatttctaaaatgtccccctcctcctccctgtcttctaaacactcatttcaagtaaacactgcttcgaaagcaagtttaaaatgcagcttgattgatggctcatcagcagcaaacaatcacattcaaagccgcatatttacatggtcaatacacaaattaaacatgagatttccctgaagtcactctataaacttgttagatcaaaagtcacttatgcacttcatttcggggaaggaggtcacccagcctgcagaacacagattattcatggcatgaagaaattctttgtttcgcagggttaggcttggatcagaattgcggtaaacctcttggctagtagcagaatattgactaaagctctgtcttccaccagtgcagaggagaaagccctgtcaaaacccacaagaaatctttttcttgtttctaatcatctcaaacactgctgaatactttatctctcacaggagcagacttctttgttctcacagttacgaaatgaaggggagggtgagggcaatctgttctcagccagaagcaaatgaggttttgcaagataaccaggggcatagagacttctcccatacctggtaaaacattgtgtctagggatgccccaccccaggcatgttgccttcctctggacctgtgccaagatcccgaacaaacctaaatgggaaactcaaaaccaagcagagaaaataactgaaatccaggaggagttggtttatgaagcccaattagatagcctgaatattgcattcaaaaggtgactaagtcaagacttgaaaaacatcagcataagtcagaaggatgtgagtggtaaaactggcaaggagtagacaaaatgcaatgggaatagtcaatgcatagagaacatattttttaaaaagagattaaatggcagtgtaaagaaaatcttactcttggtaaaacctcagtatctctcttttttaggattgtatttttgggttgctagcttcaggttaaaatatatagaaaatactgtagtattatgaaggccatactaccaaatttttaggaaatattctatgctaggtattacattaaatattttgttaatctctaacatccctacaagatgaagtcagataaagatagaaattaagactgaaagattaaaggacttgtttcacatcatacagttcataattgctggagcaaagataagaattcaggtctacatctttccattagatcatgctactctttagtcaaactctctaaactactcttcaccaacaattaacgttttctctgtaatatcatcagtaggcgaatgagacttgttaccagcactctattcaaatgtatgtggggtgaaataataaagcacttgaattaagggagattttattcaatgttttaggagagattctctcagcatctagtatccctagttacccccttcagcttcctgaggaggattatttctccttgtctctacaggcctaaagaaaggtaaatcagatgtattaaaagtgccttttcaacttatgagaatctgcagtatgcttagttctttgctgggacactgttacaaaaggaataaatgaattactgaagtctctgctctcaggaatttatcatgaagagggacagagtggaacttcacaaaattattaggaagtgcaacacaaaagtcagtttaggtcagagccttccctcattctgattccacattctattgctttgaacatgttcatttgtccgatctggagactaactgtttcttatactctgatggtccccttgggtttacaccggtttccactttttctgctctagtagtaacgtctccttgttaggcattagggcttttgcagaatcctttacaatatgacagaataacatgagtcaattatttatagttaaggtgcattgaaaacatatatttcaaaatgaacatggtgcagaacttgctggatatagggaatgaagagaactaagaggtttgcaaagaagttttgggtgaggaattgagaaagaaatgagagctgtgagaggatgataggttagaagaaaaagggaaaagaagattttacaaagtgttaatttaaattttaaatgaacagttttccttttctgagaaatgcaagttaatggatgtgctgcagtttgcactacttctggctcctgggctgagtgaatgtcactaggattctcctcagaaactctactacatgggtgccagcttacattcaggttacatgtatgtagcactgtctatgtggaagcaccattctaggcactaagtatacaatagtgatcaaggttggtgatatggtttagctgcttccccacccaaatctcacattgaattgtagctcccataatgcccacatgtcatgagagggacctggtggtagcaattgaatcatggggcaggtttttcccatgctgttctcatgatactgtataagtcttatgagatctgatggttttgtaaagggcagttgccctgcacacactgtcttgcctgccaccacgtaagatgtacctctgctcttccttcaccttccaccatgatggtgaggcctccccagccatgtggaactctgagtccattaaacctcttttctttataaattaccaagttttgggtatttattcatagtagtataaaaatagactaacacagctggcatagtctccagccccaaaagaattcaaattccagtgaaaaggcaatgacagaaattatcaccatagtaggactataatttgtgaggacgtatgatgctttctaaatatggcaccgtttattcctcagaccaatcttgtgagattagtgttatcaattctgtctgatagtgaaagaattcaactcagagagtccaggttctgttcagtggagatgcatataatgaacagctgagctgggattcaaaacatagatctgtctgagtccaaaagccttcatcttggcagtggaatatagtcaatggctaagagacaagaaacaatggagagcttagaactaaccctttggagatgctaacattcctgggtttggagaggaaatgctggtcaggggctaaataaggcactcaggatgtcagaaagatgtgggacaaaataatgcaaggtggtataatatttctgaaagctgaagaattgacattatctaataatagggaaaaactcaggatgtagtcaagaatcctttatttttggaaatcctaatattgaaagcatagatttcaggtggatgttgaagtctccaatggccaccaaaactgcagggctctaaaaaggtgttaggttttgagaaaaacttaaatgtgacgcagaccttttattcagcaaaaaaaaaaaaaagttgttgcaaaggtaatcactaaaatggacaggcattttaaaatattaaaacaatgaggtttgttgacaggtatctaatagaggaaagaaaaagccagttgagatggcaatattgaaaacggccacctggcacacaacttcggggggtgccattcatcttgagctctgtttcaaggcatgtgttactcatagatcacaatacgaatggtgccctctagagctgtgcaacgcgcatctgtgcaacgatgttgctgtgagagggagtaatgtctcataaaaatcaacatgaaagaataggaaaaacatagtcttggtatttagaaatgttactgtgtgcccttgcgtacttcattttattacctggacctcaatatatataaaattgaaagaccggactgggtgaattgtattaagagcactaggaacataaattcaaatttgtgctgtatttacaaacctcttttcacaatcacaattacatttaatataataaaatgaatgatggcatgttattatattcatcttattattctcatttttattctttttaattttttttttttttgaaaaatagagacagggttttgctatgttgcccaggctggtttcaaactcctggctttaagcagtcctctcacctgggcctcccacagtgttaggattacaggtgtaaagccacaatacccagcccatcttgttattttcataataaataagcttttagtttttaacctgaagttcagtaagttcagccaacttgtctgtgatcagacaactagggactactggtggccaaaataaaaattcctaatggcaaaccctatgtagaaggggatgatgtctaggaaagagatggaggattggtgatgcattcacattcttcttatgatctatttgcagatgtcttctacgaacatttgtttcccaaaccagagaaacccttattcactcattaaccattgggatttttgttcaaaggcccatgaattattgctactttaaatttgcaagcaaatttataattggatcctgatgtcccagcacccataaatattttataataattgtacaaacaacacttacattaaggttagtgtaaaagccttagtaaaactgtcaaagcaatttaaacagaaaaatatgattaaggtgtactttttacttttttcccaataaatataacttgttttatgatattccaggacatgaacgattaaaatagggagacccccatctctaccaaaaaataggaagaagaagaagaagaagaagaagaagaagaagaagaagaagaagaagaagaagaggaagaacaaggaagaggaggaggaggaagggaggaagaaaagaaaaaatattagcccgtggtggtggcacacacctatagtcccagctatttgggacgctgaggccagaagaccccttgaggccaggagtttgaggctgcagtgagccatgattatgctactgtgctccagcctgtgagacagagtgatatcttatgtcaaaataaataaataagtattggtgaaaatataataggataaaattgcaagccataggaaatggaagtctagcacttacagaggtaagcaatcttatttagttgaaaaagcagcagtacttagcgccaccatacctaactatgaattgctgccaggtccctttaacgtctgtgggttttggaaccagtgatttaacctctgtgtggctccatgtcctcagacctgaattggaggtcatacctatctcactaaactgtgtgacaatttagtacagtaagtatgtgaagtgcctgatagagcatgacaaatggtggtatctgaattgagagtagtcatgttcattaatactaaaagttttacaggacatttttaaactgtgtattcatctattatgtttcaagtgatgtttaatttaagacttttcagtttgacgttattgcaacagagacatgtttcccatatgaccacatatattcctccctaagtgttatatgttgcagactattcttgtaaaaatatgagacagttaatttaaattcatatcattgattatgtatatggagacaaggtttattaaaattggctggttgacttgattatatcaatttgtatttagggatctatggtcgataaattagatctgcgatttcttcctttcctgagtttcacaggctttgatcaataatttagaagcagctttcttttaaaagacatacgctcaacataagcttaactgaacgacatggatgttaataaaacttttctggctttccaagccgtgattttatttaaaactgaatggacataaatcccctctcatttgccaaatataatttaatcatgcgatatgttatggttattaaacgttatatattagagtggggatgatctgggcgtgaatcctagccttactatttactggtgtgtgtcctgacacaagtttgtcagcttctccaagcttctgtctgttcattggtttaatgggcataataatacttaactcagaactttgtctgaataattaaataaagtatatatatatgtaaagttatatatatatgtatttgagacagggtctcactctgtcacccatggagtgcagtggtgcaatcacagctcactgcagcctccacctccccaggctcaagtgattctcccacctcagcctcctgagtagctgggactagaggtgtgtgccaccatgcccaactaattttttttttttttttgtagagatggggttttgccatgttggccaggctggtctcgaacttctgggctcatggaatctgcccacctaggcctcccagaatgctgggattacaggcatgagtcactgtgctcggccaaactatcattctattttttttaaaaaatcatattatctatcatgtagtaaagcctcaataattgttactttcattatggatattattatttgtattgtttcatgagtttgaaatatttaccaaatgtctttagaaaacttctgaaaataaaagccttccaggaaattatttttattttctagttaataaaattttatgtttgaggattttttaaggtaaataaaataaaaacagttattagtttcttttttttttttttggcttagaactcttcaaaaaacaacaacagaaatgggaccatagattcattaaaaaaaaaattgtaacattctttcaaatgttttattgaagtaaaataattacagaaaattgttataaagacattggtaaagccacaaggcagataaaaaggagtttgaatactttgcaaactcctgatcccccaatttatagaagagaaaagataaggttactaagagcagaatacagaggcatataatgttgttgatgttgacatgaatcatgttggcagcttttggagttcaaaatgcttcttgttttcttggcagagatggtaatattgtgaagcaacagtgtattgaaattatgaaataagagtttttcatgcaaatgtgaggaatttgctgaggacaagtaagaagaaggccaattcctattgtgcaaatcctctggtcactggcttcaactaataaggacaagcaaaagcataggaagtcatttccctcctacaaagatcattgcaatgaatgggaactggtgctttctgtggctcacgcccagtgggtctgaggggaaatagaatcaataaaactttaaacatagtaagtgctaaatgaacacttcatgaattgaaagctgactagaaagccagctatgaagacatattctagaaccactggctggggaggaaaaaaagcacaccgaataaagcacaagctgcaataatctctttagttaatatccgacttatttttttttaagtataatgcagtacatttccacagtgcagaattagaaaatgcagaaacgaaaaaaaaatgatttaaatgatagtagtctatgatttatcacctgacgcagccacagtctagctttgtgattgcaagtgacttaattaagtcttattaagtctcacttcactcaaagcatgcaatcataatcccttcttaacgttttgatggggatgaatgagataataggtagcttagcacaaaatctggcacataataattgagtagcaaaatgggtagatttaatgttaaaatactatattttacaaatgtatgtctagtctttgtttcattgtatggataacagatttcagagttcatttcccggatatatacttttataacctgctccctctatttttatcataagtactctcaaacatcaacacaatctctttataaatatcacattgaatggctacataataggctatcataagacttcaccaactttcttcaattataatatcttttattgatagaaatttaggttgtttcctaacctctcataaataaagctacatgaaaatatgtccatcaaatttacattaatgattcctctggtaccttgaacccctactccttccacacacacttctctattttcacctctatccattccactgaggagtatggtagattcagtttttagtcctgtctctgaatgtcattcaactttactgggcctcaatttttctcctgcaaaaagatctccgggtcactctcaagcctaacattctactattttatgtcttgaacttttgcttttataaaggaacaggtatcataaaaagacgattaaaattcaagtcaccaaaccctgtcagtactgcctctaatttatgcgactggatgccaatacctttaccggataccaatacctttaccaatacctcgccttctgagtgtcattcacctgtttactcccatcaaggggcactgttgactcattgggaccctccgtctgtcattttgaaaccccaaggttgccagccatggaggcacccttcccattgaggcacagcttacagtgccaggagctgcctggcccccactttcatctctaacctcctctgaggctgcctttctctgactccccgtgcgctagctacagtgcctttctttaaggctacagtggcctttctttcatcttttgctatgccgactcctttcttgtctcagggctttttcacatctctttgctctgtctgacctgccattctctcgcatctcgttgcaggattacctttttattctttctttggtggcaatgaaaatatcgcctcctcaaagccctcccctgcccacagcataaaaagcagccctccccttccctattctgtaacatagtcccttattgctcagtgactatctagcaatgatcgcagtctgaatttgttaacttatttattcatgaatattttttcttcttttttgtttttatttttgtctctgctctataatgaaagctccatgaaagcagggactatagttgtcctgttcttcattatagcactagtctctactatgctatgtgcctggaattttttttttgtactcaatatttttttttaatacatgaaaaagtattagttggccagatttctgcagaaattctgtaaacaaagaaatcaacgtgaacgcaaacaaaccaaaaaccctaactcagccttgtttaaacctgaataaaataagcaatatcaggagtcttttaatatttgtgaaatgttagctttctccttacattaaacctaaacctcaccatcttgcaaatggccagaacgcctagtaaatcagccttcaccttgacagaggaagaatatagagaaaggatttcaacagaactgaagtgagggtgatcatagcaatcttcagtgtactgagctgatttataggtacagactacttctagattaccgacctgccactgaattccaactaggccccttaaagtattcctgcctgagaaaaacaccccagctctggatgcaccatcaatattaaattccacgagaaaggtggctgtgaaaaacacacacgtcttccacattaatgattcaggtgactatatcaagagcattgccttttacaccgcagccctgcttttcttgaataaagctcatatgttttttgtttaccataggactctcattctttcttttttcaaaaaaaagtagacttagcttgtcttttccaaagtattactttccgcagtttgccaagtcacattggttttggtttatctcattccgtttttattaggttggtgcaaaagtaattgtggtttctgccattactttcaataataacttaaaaaggacaaaaatcaatgttgaacattggccactgtcaaaccaccatacatggtctacctcattaaaatcagaccacagagtctgtaatgaattcttgtttcaggagtttactatcaggcaaggaagattttctgtgttaaggtcaaaaaatttcattcatgctgcaaatcactttgcttccagtcactgtgcaaaagttcatgtctgtttatcaaggatttctggatgcctcctgctatctgtacatgtgccagaatctttgaagagagcattgtttttgtgcagtgaattccagttcaggacagagaacattcctcctcaaaacaaccattttagaagacagccttcagtgtagtatttcttacactgagtactggttgagctttgctgtgtatttctctctctctctcctctctctctgtatgtgtgtgtgtttcttcatcctgaagcgttaccacttagccccagggggaatctgtattattacttgtagatgaaaatgtggtaaagggctattgtgatttcaaaacttccatattttctcagataaagtttccctccagttccccctccccattgttttcactctgagagcctcaagttgggtgccaattaaaactgagagaatattacagtgtcacagaacaactatattaaccacatttgtcaatatgtgccattttcattttaaatgggaaagctcagagggcattttccactggaccatctggaggaagctgatctggcttcctcagccagaggttttaccagttgccaccaataaggaactattttgtgatgtttccagaatttgaaaccctctgccactttgaatccagcttttaaacgtccttttgcaaggcctgccaagagcgaacttgtagagagccaggtttcatttgcaattcaaagagacaaccctatcattgaatgtggtctttaaagggaagggagagagcaaaagtttgaaaagaaggaactcaaggaagagatccttccattttgactagatattgtgaatgtcattcctcttgaattcttattgttcttaaatgctctgctcagtgcctgtcctaggtcccctagcttatgattgtgagtcaaagttgtcagtcaggtcatttaaactcagaagttaccagtgtctttttcaaatttgtgagaatagtgctagctgccccaccaagctagcataaggactaactttttattgatcactggaagcaattctggtttctcaaagaaatcagactagttttgacataaaacagaatttggcaacaaagctttgggcagaagcacgaatacttaacataggagaaagcacagtgcatgcaagtaggtgaaaaagaaggaacttgaaggtaggaaagagggcgtgagatgtccatgtatagggaatggggaatggtgtggggaggggaaatgcaagaagccagattaaggaaattgaagtgtagagtgaatagatcaagctctatctgagaagaagtcacatatgatctttctgtaaatgagtagccaggaagggtgaaaccattccaacaactgttaaggttttacatattttgtttgtttgttttttgagacggggtcttgctatgttgcccaggctggtctccaactccaggactcaagggatcctcctgcctcagcctcccaaagtgctgggattacaggcacatgctactgtacctggcaggttttatatttttaaggatttaatcatgataaacatatattagtggaaaggggaacaacacaacatgtagaaaaggtaatattgggggaggcacatttacaaaaatagtttaattgccaccaaccagataagcaggtgtgacgtggccctacctctaattaccctgatgttagaacctgattattaactgaagtggtgcatttatataatgtgcatataaaaagcagtggactaaggaggagggcatacatctgaggatagtgtctgcccttgttaaagtaaaggggtcctgatccagaccccaagaggatgttcttggatcttgcacaagaaagaattcagggcaagaccataaataatgtgaaagcaagttttttaagaaagtaaaataatgaaagaatgactactccatagggcagagcagcagcatgggctgctcagctgctgatacttagttacttgttgattatatgctaaacaaggggtaggttattcatgagttttcagggaaaggggtggtcaattcccagaactgagggtttctctccctgttagaccatataaggtaacttcctgacattgccgtggcatctgtaactgtcatggtgctggtaggagtgtctcttagcatgctaattcattataattagcgtataatgagcagtgggaatgaccagaggtcactttcatcaccgtcttggttttggtgagttttggctgggcttcttcactgcaacatctggaggaagctgatctggcttcctcagccagaggtttaccagttgccaccaataaggaatcattttgtgatgtttccagattttgtgatgtttcctttactgttttatcctcaaggtctttatgacctatatcttgtgccaacagcctatctcattctgtcactaagaatgcctaacctcctgggaatgcagcccagtgggctcagcctcattttacccagcccctattcaagatagagtcactctggttcgaacaactctgacaccctggcattaaccagtttcaagacttgggcacagacacctcacctctgaacattaggatctttgtctcctgagaaatgtggtatggtggaaagaaagcatttgagtttccacgccaataactggattaatgttatgcctcatacactcaacagctgtgtgacatcagacgatatttccactctctgagtccatttcctcctctttggaataagataataaagtctgttttacaggaaggagtgtgattttaaaaaaagaatatactgaggctggcacaggtaggtgataaataaattaggtgctaaagataatagacggttattaactttctaatgaagggctgaatgacatttgtgcttcctcataacccctagaattttctcattctctggattattgttaaagatagtgcatattcaccataattatacagcacatacttatttcttcacattttcaacgaatgtttttctttggctgtctttaccagtttatttcagaaagagagaaacagcagaatcactgggccacattaaaacaatatgtcaggagaaaaattaattccctaatggggactttctagaatatttcctctgcgtgttcccaccttcacaaatgatgcaagataaagcaccttccgtctatctcaggatgtgattttacaatcccaattatttttactgtcaagaagcattttctccatttctagtcaaaatttgcctccttaatttcaaattgtgccatgctaaataattcactgttctctttgttttgctggagattatgtatatactaaatatgttttcctcccctccacacctctcccccgatcctctctctctctttgtgtggctatttgaaggcacacaaatgtgccttccttaaatcaatagcttctttacaaaaaatatacacatgcttttgcactcagcatttgctatgctcctttgcaactgaaaatgtatggattaattggaatgcaattaacactcctgaaaccaagatcctaggattttaagctttgagaaacagaaaacataatgataaaagtaagagatatgaggtgtaaactaaaaatgaaatcctaagcctcccagctgactaagcagaccccttcttggctgaggagaccccagagaaaactgaaaaactaagtccctggccatgaagatacaagaagtcagactcacctcattataccttctcccttttgggatttagacacaacaactgacctgtattaatgtaaaaatagatatcatgagaatgacaaaatagactctttgtgacaataagatatcaaatgataaacaggacctaaggctgtgcaagacaagggttaagtcatgcctgcaggccatcaatttttcttaccaggtcatttgatcttgtatattgtggcttgctctatgactattttacttccttaacttaaacattcctttctgccaactccaagtttttagacaaagttttgctcctttaatcaactgcaaattaaagaatctctgaatccacctatgacttgtaagtcccccactttaagatatcccacctattcaggccgaactaacgtatagccattatgtattgatttatgtttttgcctgtaactcttgcctcccttaaacttataagaccaaactggactctgcctacctcaaggtttcttggctttgtattttccctgagctgtgatcactcatattgatcactcatatagaactttgcttcttaattcagccaaaactgggttcttgtcacatgaccaggaaaagttaggcatacagacacattgaaaggtgaggggaatggaatttactgggtaaaaaggaaaaaaaagaaaaaaaaatctctctcagcagagcaagaggggttcctgctaacaggcccccatttcacagattgattccaggccacatacaggaaactgaagaggccgggctcctccctgctgcaaacagcctgaacttctcctggctcaaccccgctaccctagtgcgcagactcgtaggagattccccagggtccctccttcttatcttcctcctgcatctatcaatattggttcagaataaacctttaaaaatattttactctgtggtttatgtttttttctgttaatagaggaaataaaaggatgagagtgatcttccaaggttcacccaagttatcagtagagccacattatgtgcctggtccttgatagctcaagggtcactaagacactaagacggtctgtatcaacatttataacgattttctaaggccctgcaagatctaggcaaaaatataatgaataaagagtaaaccatacttactttttcaggcttcccagtacgagaagaaggctcacaccgtttggaaataacttttttaagccggggtttaaattaaagcacgttttgttgttgttgttgtttgtttgttttggttttctggttgattttcagttactaaaaatttttttctgaaatactttttatcattgtggtttttccagatgtttcaattaggattcttgtgattccgatgacaactgaaagagaaataaaaaataagaaaaattatttcctgtaactggaagttgaggattaggacaagtaggcttcaagtttggtggagccaatgactcaacgacgccatcaaaaacttaggatttttcccatctctcaaaagatggagaaatgaatctgatctgttggttagatcctctggctgggggcctggtggttaaagcatttctagggatcctatgcttaaaaagcaatgtcaagaagagaaaaagaggctctctttttaaaaggctaattgattttcacagaaaccttaagcctcactgtccagtgttgagtcatgtgctcattccagaatggatagctggtgaggaacatagcattaccttaaacttacctcagacctgagcttctggctgtgtgggagaagggcagataactcaacaataccgtgggtgtctcaagaaaataacaactggggatggaatactggatggacatccaaccgtatcaaatacagcaggattctttgaattttattttgatatcctcacaaaaaaacataaaaataaatgatgttttgcatattctaaaccaatattggtgaagagcagagactctaactgattgggaggatttttgttaataaaatatccagtagttttcagctcacatttttgtcattatggagttttttgtttattgcttttatttcttcaaaatcagagtcccctgaacataaagctcataacaaaatcagagttccctgggagcatatagctcataacgttcttcagcatcttctaatgcaaacacagtctgagcttggcaactgtttatataaaaaggaatttgttcaggaaatattgtgaaaagtacagggaacagacacagaaatccacccaggctctgtactttagcattaggcttagaagagttgtggttttgcttcattccctgaaataaaatatttggttgattgtttggtagaggagtgtggacgcaggaaaccacagtgtatacctgggagaggaattggggtggataaactctcctccattgaggggaagcctctagctctatattttgcttctaattgacatagcagggcttttttcttcctgcatcaccactgtcctttctgcggttccagtatacatgttggatattggtttacatttctaaacttattgaacgcatgaccctttatcttacccattatttactgtttaactgtcaacttttactgcgtatactcaggcaataagacagaaaatacatcaaaacccttaatatcttcttgaaaagatctgaaattactcttgaaaatgaaaaattaggtctattctggatctctgaaatacaatattgtgctcttatatgtttccatcaaagaaggaaagagacatttatttagtataaatagtaatatgggctagactctgcactgagcattttaaaaatagtatcttatataactcattcaccagctctcagagttagtatcagatactgtttattgtccaccaaatagttatccttctcttttttatttttaacaaaatccatgtgcctgactaaaagcatttactctcttgcctctaggtgcccatggtggtagagttcttaccagcgagacacaattagaaatcttccagggtgtttgggaaaagctattattgccttcctgatacaacgcccacatcctctagctcccattgtgtgcatttaccctcccccatttatgatataattatcctagatagtttctctacatacatctagagccacatcagtgtcacaatttttctttcagccttcaaacatactttagaaaactcaaagagaagaagaaaaatctaatgtatttatttgtatttttgctgaccatgcttttctttcttttctatttttcgaatttccttttttaaaaaattttacttagagaacatcttttagtcactcttttaaagtaggtgtgatgatgacaaattctcttagtttttcatctaatgatgttttgatttcctcttcattcctgaaggatgttttcactggctgtgggtttctgggttgacaaatcttttctttttaagactagaaaactattttgtcatttttttctggcatccatggtttctgaggagaaatctgctgtccttcgaattgttcttttgcctatggataaaaattccattttttttctggcagctttcaagatttttttcttttgtcttcagttttaagaagcttaattatattgcaacttggcatggatttctctgggccttttctgttcagtgtgaaatcagtttcttgggtgtgtaggttgatacctcttgccaaatttgaaagttttcagcccttatttgcttgagtactttttcagctcttatttctcgtttccttccagtactccaacgacgtgaatattggaccttctgttgtagtccaacaggtccctgaaactctgttcacttttgttcagtctcttttctctctgttgtttaaacttggtaatttctactgttccatctttcagggccctgatcttatcctctagctctcctttttgtagccacgcccacccactgaggtttttattcccattatactgttcttcagttctaaaatttccatttaggtcttctttataccttttatttctttactgaagctttctgtttttcatttgtttcacgtacattcatgattactctctgaagcattttttatcttggcagcttcaaaaatcttcatctgataattctaaacatctctggtcatcttgatattggcatttattgattttccttttttcattcagtttgggtcttcctggattttggtatgatgagtgatttttttattgaaacggggacattttcatattatgttttgaggctctagatcttatttaaaccttctgctttagctggctttccctgacataagtccagcatgtctaggaagaggaggatactaacacattcctgccaagtggaggtagaagtctagctttcccacttggtctctgttgacacccaagggggtagggctccccattactgcttggtggaattaagagttccagttccccaaatgttctccactgacaccatggcgccgtgagcttcattacttgccagtggggaataaaagtcctggatcctacttggccttttttggcagcaccccagtggaggtgttgaagcacctggttataggtgggggagggagtctagactttccttgtggcctttactgttggggatgggaccacagttctgtggtattagttggggcagagtggttattatctaaatattttgtatgttgacaggctgcccgtttcctggtcctttggctacagtgaataaacttttgctggggccatttttgtttctaattggcattttcaggttgccaccttcttcagctccaagacatgaggcaaaaaagagaatccagggaactcaccgatgtcattcctggagtcttaattatctagccagtctgtgcgtttctcttcacatctcagagttttctcatgtttgctgttgtttttagctgtactttatgggaggaattggcaaaagcatctttactgtatattgccgggaagcagaaatcactcaagaatatacgtcttaaaaaatcagcctcccaggtgcttctcaggcaaatgttcatgaaccacactttgaggaacattttatagaatatgaaattgaggcccagagagaaaaactcaaaggcaagatgtcacatactcaggttgcacagcagagattctaaactagaaaccacatcacatctcctggcttccatttcaatgccatttcctccttgtggcacaatatcgaactactaagaataccaaaggggattaatgtaccaatttcactgtgattcatggagatcagtttgtagacatgcaggaaatgttaattctctgcaaatacagttattcataccttgatgtcaattgtatcaccctcagcggagacagtttttcagatgtcaccagtgttgtggacaggaagtctgtatttaggcagccttcagaagcccttgaactccctgaagtgaaatctggagggactggaaatggcatgagactgaaggcagcacgagtgcagctaatgaaatatgggcatcctccagtggctgccgttcatttcactggccccatgcacaggttgtaccagatggtgctctcatggtttccatcaatgcagaactgtgatgaagaaggggaggagaaaaatggatgagaaaaataacaccaatctgcacagctgaaaataattatgattacatggctaatgacccagggaattagacaaagccaagcttattggaactcaggccacatgcaggcaaatgtcacaatttaatgacaaaagatgaattgctttatctcctacatagtaactcatgatggggagtggtgattcttctttctgaatcactgtcttagagtaaagtcatgaggagacccacgtaatgagtgtcttctcattttgaaagggaattgaacctagaaaattaaaaaaataaagaaacttcagcaaatatgatatttatattcattttcacctgtaggagtagtaggcagcaacctacaagatattggaggcagtcttgttgccaccaaaatatagattatgtatcctttaaagagaaaggtcaaatcttactcttttgtggtcacttaaaagcatttattgagattctgccatgtacgtggccctgcttaacaacctgtgatagaaagatgaaaaaagatgctgctcctacccagcccagaagagttcacactgtataaatattgattgggggtggatgactgattgcaattccctatagagaccctgtcgaggtttctgaaattctgacttctttccattacagctgtgaaagctgataatcaaatgctggtagttcaagtattcattctttaattcattcactcagtaattctgtaaatcttcattgagtattgattatgtgtcaggcactgtgtgtggcactaggcttaaaatggggaaaaatgttttaatataattatattatgtgattatatgacatattaagctatgatctgtttataaaaagtacataatgcagggggagtcacaatgtttagaaatcagagatgaaatttttgactattagaaaggtttatgcaaaagagattgaattattagttccgacaaatgcattagccagtcagaaaaaaaaagtaaaacaaataccattaatattttggatcttaaaaagcatgtttataaaaatcgcattagggaagtgcatagcttagaagattggcaatgaaagaccaaacattttaagtgcatgtaattggttgacatctagccaaaattgataacaaatgcaactcatccccatctgctgatttatgtaaatgagttggtgatctcatttggtttgctaggagacaggtgtctctattgctgaagcagctactcagttggcacttagccccagtctaaagcaaaagtcttaaatttagctgtggcgtaaggctcagcttaaaatatggtccctaaaatcccaggacaagacagtaaggccagaactgaaaatcactgtaggtttgtgtcctgtctgtccaagggctgtctctgccatgacaagtacattttcaaactgctatgcatgcattgtctactggattcttccagcgtggaagttctgcaggaagagagcacgcaaagaaatttttttctgaatacttttaaacccacatttttttttgcgggggtgatggagtctcactctgttgccaggctggagtgcagtggcgcaatctcggctcaccacatcctctgactcccagattcaagcgattctcctgcctcagcctcccgagtagctgggattacaggcacatgccagtatgcccagctaatttttgtatttttagtagagatggtatttcaccatattggccaggatggtcttctcctgacctcccgatccacccgcctcggcctcccaaagtgctgagatataggcgtgagccaccactcctggcctaagtccacattttaataataccaagactgataagaccttacttctttcaggctctttcatattacagataataagagatgattatagataataagagaatgcatgtatttattaaaagatttgtagggatagcataccacagatagactatcagtgttaggagaaaccctaactgttagtgagcatctattattagtaaacagagaagaacacagactatgaagatagtctgcttgggtttgaatcctctattgttatttattagctgtataaccctgggaaaattgcttaacctttcaggtcctcatttcttccatttgtaaagtggaggtaatagcattacctagctcataaggttgttatgaagactgagataatgcatgtaatgcactaacaagagtgactagaatatagtgagtgttctacacaagttctctcatactactgtgttccagaaaccgtgctcagtaaatggaaaaaaacctacattatttaattctgacatcaactctttgatgcaggcatgacatattgccaccttataggtaaggacactaaacgtcagaatggcgaatggcagggaagaatgaaggtggctttttgagtttggctgatgctctatcaagatctttctattgtaacttgttgcttgagatcacacaggtaagtagtagcataagacagggagtgtaaccaagattcctggttctcagtttaatatgcttttttatacattacagagaattggaatactgtccaatttctgactttgtgcaaaggaaaaatatttacaatttagtaaagaatgctaatttataattccaaatgaaaaatgatgacttaatgcccagggagattaaatttctctttcttccaaaagttactaattgctacttatgtagcaaatattgagctaaatcctggggtcatagtggtaaacaatatgggcaaggtgattactagtgaatttttaataaattttaattactcaggttattttttctttcattcatttcttttatgatttttacaaaattgtgaacttggttctgattctgtaggattttacttataggcacaaattatacttgtccataattattacctagcacttaaaaaatgatcattcaaggcacttaaaggaagaggccactttcattattattttattggacattgctcagtaagatctgtgcacgttcattatccactcacaaatgaatggactatgatgtggttctaggctgacactccatgacctcatgagcttctgaaccaggtagaccataatgaaggcattcattagaggtctgtgaaccagggaggtggcacacattgaagttcccacatcatcattcatactaatctgattaactctcctactctcatttccagagtgcagggatcaggaattttggcaaccatctgggtaacagaagcccctccccaaggatctggtaaatttctgcccatatgttccctgtaaaattgcattgcctgcggctttcttcccatagctcatgtctgcagagatgaccaaccaaccagatcttgtggcaggccccgacagccttccaggaatagggcaatgttacattatcatttctcactgagacatacatgtgacttttattgccatattgataatatgggcattgagaaaatgacaagtacattggatcatgtaaagacattttgtgacacccaacttgcaatacattgttatttttaaaaggactttgcatcataggacatacaaaaagatagtgccactttctatcttacaggacaaaacctgggaagcaggctttcagaacatggagtctgatgtaattctctccaactggagaacctccagggagaaggagacatacgatgctgatttatttggattatacaacaaaggccatttttaataactaaaaactaaggcttgattcatggaattgtgattttaaaacaatagcaatcctggacagggctttcccctgtatgatttccctgtatcccaaggcagctcttggtaggagcattttatacttgtcaacagcgttcatcagctgaaaaataaatgaatcattccctcttttgaataactcaaagaaacatgtgcttagagtcagcatggtaccattttcactggttttcagcctaagctgtgatatttatcaccgtgaatttatcagaatatatatgaagcatgttcaattgtaggaataaatactgaaggtttagttcacttttgagagttggaggaaaagagactgatttctgtaagaacatttctatcttctaaatattcattcatagcctcactattgaaaggaagaaccacaacagagatcgtctgtagagtcattattataatctacctcttctgctcagacaaccagaaactcatgtgtgactagatgagaataggtaagcctggtcttcaggtcacttttgtctcatgacagagaaatacttcatagaaactagattttgtctgccgcagttcaacctggtctaacttgttgaaattctcctcctgatgatatctaaaactacctttggaaatgtacagatatgtgattgtgtgattttctcattggcgccattggtcagaccatagacctctaggggtggctggtacaccatcaggaagaagcagtgtgttacattggcaactatctgtagagatgtggtattgccctttctacatgttcctacctaaaaatgatatgtaaaaactttgcataatttaatttatgattctctcatctaagctatttcctcaattaactaacttcagtctggtaactttaaaaagtaggtttcatgttgtatttcaagttatttcctgtgctctggtattgcattttccttccattgcgccctaatatatagtcagttcctttcaatttattactgtcaatcactgtatgctgatgccctgcatcacataacagagaggaacaaagatttgaacacaagttgtaatttcttcactccgaaaactagatctgttttattctttactgcctagtaccttgtatcatttctggcaaatgctaagagcatcttctgtgatgaatgtttaaggaataaaggatgaatgaatgaacggattgaaatcttgtccctgctctcaaaaacctcacggtcaactttgaggaacgaaatattaaattattagaaactatcatgtaaatttttatttgatcatttcatgttttctattagaaaaacaacaagcattcattctattgttctaggcattaggaagattataaagatgaatgagatacacagtacaggccaggcatggtggctcatgcctcgaatctcagcactttgggagactgaggcaggtggatcacttgaggtcggaagttcgagactagcctgtccaacatggtgaagtcccatctctactaaaaatacaaaacttagccgggcatggtggtgggtgcctatagtcccagctacttgggaggctgaggcaggagaattgcttgaacctgagagacagaggttgcagtgaactgaaattgcaccactgcactccagcctgggtgacagagggagactccatctcaaaaaaaaaaaaaaaaaaaaaaaaaagagagagagagacacacacacaatacataaaatactagtatgaatttattcctttttgtgtgtgtggggggacgcgggtacagagtttcactctgtcacccacgctggagtgcagtggcaccatctcaggtcactgcaacctctgtcttctggttcaaacaattctcctgcctcagcttcccaaatagctgggattacaggcgcatgccaccgtgccggctaatttttgtatctttagtagagactaggtttcgccatgttggccaggtgggtctcggactcctgacctaaaatgatccgcctgccttggcctcgctacgtgctggcattacaggcatgagccactgtgcccagcttagatttaatgatgaatatggcatcagcaaaaaacaatcagaagactggacaggtaccatcattatgcaagtggatgtggaatcaatgattagacacggtttcttcctctaaggaagggaaagtcatcaactaacttgttctttgagtgcagtcattggaacacagactttagaatcaaacagacttgaataaaagcctagattcttacacttagaactatttgatattgggcaaattatagaacctctctcagcttcaattttctatctgtaaagtgagatcatgatgcttaagtgtttaccaggatgaaatgcaataacatattagcagacattacacttctgcccagtttctgatccgcagcgagcacttataaactattactaaaggaagtaggataaaaaagatttgaaaagctttcagaaaggaagtagcatttgcactttctaaaatgatgataggtttggatatgagtaggaaaaggtgtggagaggacagagaaaataagggaaagcattttcaaatgagaaaacagcagtagctgtagagattcaagaaatgctggtaatgtgccaggaagagcaaaaagactggagcatcatagaaatgggaagtggttacacagtgtgaaacacattagaatggctttacaagtttcgagaataaaacatttattgtaccctggagaatttagccactctatttcagagtgtgaactcctaaattaaggagaaaatgaccagatatcaggcaatctgtctccttgaaaaggtaagagcccttggaaaactacttatgcaatcatggaattgttgtgtggcggaaggagaaagttagaaggagagaagaggaagggatgcctaggaaaagatccagtccccagatttttccactgcaggagcattcaccaatcatctgcaaatgcctgtattatgacatgggtgatagaaaatttcttcatctcatcttttgattccggtacaggattttttgcagtacttaagtaatttgatttgaaataatctttctttctgtgcaatgcactttcagccacctcattaattttgatcttatggtcaataaagtttctgttatttctgcaaatttcatatctggttagtctcccggagttcttccctttcttttttccgtttttgcaagtacgaatccatgtcttaatgttcacccattccttccttccaatttccctcaagtcttatttctcctccagaaggtcttttctgcctataccaacccacacatttctcatcctccaatctcctatggattttattaaacttttttctcctttgccctttgcactatatatgtaattcttggattttagataagtaaaaatatatacatccttttgttcatttaaccataacttcctctgcccctcaaaatagtatgtattcaacaaacataaactgagcacctactatatgcaagactgctatatgtgactatagcagtaaagcaaatagccatgctctgtgctctcataggccttaaatacagtaagaaagagaacaaaaataagatataattaaattattggatttctgataatgataaattctcaaggaaattaaccaaatgatatgtttgagagggattgtgaggatgaagccgagtgcattagataggggatttagagaaaactttttgatgagattatgtttgaggtgagatctgagagataaggagtagatcaggcagtgatctaggatcacattacttcagggagagagaacaaatggaaatgccctccagcagattcaggtttacctgttggaggaatagaaagaaaattagtatggctggatcctagtaagcaagtgggcagagacacagaggcagaagggagccggaccatctcagcccttggtgcggagtttggattctgctccaagtgaaatggaaaggtagaggaagcttttaatcagaggatatacataattggagttgagttttaaaaagatcttgttggctattagacagtgaattgtctggagcagggacaagaacagaagcaaaaacattagttaagatgctgtcagtcagtccagactgctgtaacagaacaccacagactgaacagcttaaacaacagaaatgcatttcttaccattcttaaggttggcagtccaagatcagggtgctagcatgattgggttctggtgaggggtctcctcttggtttgcagacagctaccttcttgttgtgtccttacatggcagagaaaaagatcatctctcttgtgtcccttcttatgagggcgctaattccattcctgaagactccatactcatggctcaatcacctcctaaaggccccatagtactgtcatctgaggatgagggtttcaactacgaattttgcaggggacacattcagtccacagcagatgctattggtatagtctagccagaaataatgacgacttgcagtaggattgcagcagtggagttaatatattaaagacacgtatttaaagtaatgaaaggagccgtggcaggacatactgatggagtacaaattgagagtaagaagagtgagattaaggatgagtcttgtggtgacattactagaggggaagaaaaagtttttgaatttactgattagttgtaattaaaaaaatgtttttctaaataaaaattatgatagttctattcaaaagatatacaacttttacaagctatgctaatgtctacaaaatatctctccacttacaaattgttttgttttaacaatccctataatatatatcaggagttggtaaattttttgcaaagagctagatagtaaatactttggactttgtaggccacactatcttcggacagtacatcaatgtaaagctttacatcaatgtgaagtaccaatgaagatttatttacaaaaacaggcataggccatagtttgtcaaactttcatgtatatgatataatagaatgattgcctaagcagaatacataagtgcttctaattcatagaatacctcaaaaacatattcaacttagagatggcaacttcacgagtaattgaaaaatcaggcttatgggatttatggtcttttaaaaagccattttatctttcctcattaggaattcctgtaagcatctgattgtgttcaaatactcatcccaaagatgcatggtatagaatttggaaatctgatatgagccctttgattgaaatatttatctgttctcaaacctcaatagaaaacgaaggtcaaaaggcctttttaaattgggtggcagaggtgggatatttattgttatttttaattcacttcaattatttcaagtgacattttattcttctaatttcttttttaaattacccatccttgaaaagcgtcatctgaatttgacaattactttcctttttcagggaacagagctagtttctgtctgtgtctcatagaaaaatacagcccctatgttctaaaggttattaatatttacaacaagttgtgatgtattgaattaactgcttttatctcgcctttgaagtcctgataacgaaaaggacagaaagatcaataaccacatgatgggtaactaattgcttttgcttccacttgcaacctgccatctcactcagagctcaatccaaactccatttgacaacctcagatattgttttcaaccttagatctcaacagtctggactccaaattgagtactccaaattgagtagaaagacatgcttaaaaacttttcaatcaataattttttatgtgtatgtactactcaataccatccatatgggaaatttattagaagtaattactcagatgactataaagaactggaataatttatttgctaagagggatagtcttctaaacggtatgtaattacttcttttgttatgtttgtcatgatttaattcgctattgtaaagtcaaagcttcacattgaagatgctttcattaagtgcttatttagtaccactactactagctaacaaattttcatcagttgctataggtcatgttctggtccaaaggatttacaaaattaacttactgaatctttacaattccataaagtaagtactccttttttctacattgtgacatagaaaagtgtccatagcttcacggtaatgaatcctgtatttcccacttgccaatttcttgaccttgggcaagttcattcatctcttcgtaccttagtttgcccattcataacttgggaataaaaatcatgcctgcctcatcgagttattaagataaagtaggttaatattttaaaacacttagaagagtgtctgacatatgctaaagatagttatctgtaactaataagataaacctaacttgcctaaagacaaagctagtaaaaacagcatccttctgtacaagatgctatgaggaatacaaagatgaatcaacacggttagaagatctggcatatttattgacaagaacatcttcatggcaatatgcctggtttttactgagtgtgaaataaatctccattcttgtaaagtgagagagaaattatgtcacgaataccagtttatctctacaaatgggtaacaactcattgtggacccgagctgctgacaattaaactgaatgtatgagtcagtcttgcttatgttgctttcatggtttgcactggattacaactgctttcaccttcctcttaagaattcgttggtgaaagcaatcatagtaaggtggtttggatctgtgtccccaccaaatctcatgtggaattgtaatcccctgtgttggaggtgaggccttgttgggggttgggtcatgggggcaatttctcatgaatgggttagcaccatccctgctactgttctcatgatagtgcgcgagctcttgtggtatccttctctctcgcttctgctcccaccatgtgggacatctggctcctcctttgctttctgccatgattggaagcttcctaaggcctctccagaagcagaaggtgctatgcttcctgtatagtctgcagaaccatgagccaattaaacctcttttctttataaattacccagtctcaggtatttctttatagcagtgtgagaacagactaatatacatcagaagttgtttttccaaaattaaatatttaaagttttccgattaaagggcagattaaatttttgttcttaacttttaaaataagaatttcatgccaaacattgagcattcacagtatagttatttatactggttgcgaaggtcatttatatccctgtacttatacctatatctttttatgacccacatcttcaaacatagtatttttttgcattttgatgagtgattaattttaaagatgactaaatgatttttgcaggagtgtacatgcattgctttcccctgttctcatccaatgactctcctcaattttggtcagaaatttacttttcgctatctcttcttacatagacgtgtttaaatatttcattatcttaatttaaacccttaattcattcagttccaaatgtgagctgaaacttatttcttagctaaacgagaaatttacaaaggaaatgaaagataacattgcaaaaatgtccattcctctctccttcttcatcctcctggtatactgcttgtattgaatgttaatactcataagagagaatcccaccgaatccagtgaaccaggagaggtgtgagtttgcatctgtgttaggaatgagactttttcggttgattagcctgctctacccaggctgcaatgctgtgccacttgagaatgtttccttgcaaaggtgctaatgcagaaaaccagccaaaagccttttaaagatttctctgttatgtcccccaaatcccatcctcaaatgtggacaaattgatggtggtagtgttgggagtcaggcctaagagattcaattaagccaggaaacactctctacatagaatgaaatgtttccctgctcctctatattgagaacccagtgcttgacttacatagctattgcctcagaattatttccttcgtattgcaagtcctttaaaagctttctcagataaagccgatttgttctctcagagtcttgtacttttaacgggtttcatgctgttacgaatacccagacagaacttcccgttcaattccctgaatgaaatgttagatcgagacaattaaattccttttgtgagtctttgggaagtaatcttggacgaaagcagtggggaaataattactatagatcagtgggcctctaagtgcagtctccagaccagcaaaatcagtatcacctgcaaacttattagaacatgcaagtgatccagccagaccccaaccttactgaatcggcaactaatggaggtaggggcccagcaatgggatacacccacatttgagaacgtctgctatagagaaatatttcacagagacccatgtccttctgggaagtctgtgaaaaagctgttacatgtggttctgatttttgactcttcagcatgtttccagggtgaagaactattttaatttatactaatccttccaagtcaatcatcttctcagcataaaaccttcctggcattgccatacatcattttctaatgtgatatggccactgcctagtaccaaattatatgagtgattgtctctctcatttccatcaaaatgtatctgctttatttttacatctcctgataatattcagacatctcaatgctttattctttcatattattgtaggttttatttctcctattagatagtgagctttataaattcattggtgcattcagcaaaaaaaaaaaaatgtgtttctctcacattgaagcagaatgtatgggcctaatttggttcccatatctactctacagggcaagtgcattaaggcctctgagctttagttttatcacctttaaaataagggtggcaatatctggaggtaaacacttaacataatgcttagtatatgccagacatcaattttgatctctttatatgaattatgcaactcattctcactgtatacctataaggtagccatcattattattcccattttgtagatgaaggaagtgaggcagagaaaagataacttgctggaggtcatagagctggtatgtggtggagttgagaacccaggcagcctacggcccaataccaggcactgaaccccaatgccaactgctttgtaatctaacgccatagggttgttttgaatatcagtttccatgtacttagcacagggccagacatggcttgtgatatagacatggcttttgatataggatggctatttttaactccttcaagaaatgttcagcctatggaaggagaaaatgtgggaaaataataaaataatataggtatgtattagtaatcctattgctgatgtaacaaattaccctatacttaatggcttaaaataatacatatttattaatttacccttctggaggacagaagttcaaggtgggtttcaatgggttaaattcaaattttcaagaagattgcattttttctcacggctctacagaaaatctgttcccttgcctttttcaatctctagattttgcctgtattccatagcttgtggcccctttccttctgcaaagccagtaatgtcctctctgcaacctctacttccatctcacaccttttctgactctaactctcctgccttcctcttctacttttgagaacacttgtgattacattggacaatccaggataatctcttcatcctgatttataattgaatcacatcttctaagagccttctaagatcatacccccaaggttagaacatggacatctcttgggggccatttttctgcctactaataagtgttttatagatgtatgttctcacatgcacattagagaaagcgtgaggagtggaagtcaggaaggctttttggagaagtgatgctctaatataatgtttagttaggaatagttctttcaacagtgaagcaaggaggaacaaaaaggaattttcaagtcctccaatcctgaagcagccatggcatactcaggttgcagatttagttccagtgattagaagactgggttctggaggtggcagtgtgtggagctaaaactaaaatgagaagcagaggtcaggtaattgatgtcattgtatggcaagctaagggatttggagcttattggttgactatgggcttctttttcaatgagaccctgcagggtacatagacactcagtaaacaccgctgatgaacaaaccatgtaattgaattaatacagactttgatacaacatttggtcagaaaaaataaatctacccatgactctctctgttgtgagagcatgacttgagtaattgtttgatccctcttgtgttccactgagaagtggaagaacttttatcggctgagaactgccctaggcatccttagttacatactccagtaaaagcacttcgagttaaagcagcgatggctttctaaggccaaaatgtgctgtttgaggataaagtataagtcagattagaaactcaaaacctctgatggcacattaatgtgccaacgtggggacattccaccctatactttcactcacattcacagaatgatgcaagagaccctttaatccaaaagtaaacagaactatgtgtgggtgagataaggatgttcacttaatacagtggggtatctgcacaagtatctctgtgcagaggtgcttgtctgagcgcaagctgtgtgctatagccacagaagtaataaataaaatttttacctgtgcctgtagtccagcctattcaggaggctgaggtaggaggattgcttgagcctgggaacttgagcctgcagtgagctctgatcacaccattgcactccagcatgggtgatggactgagactctgccttaaaaaaataaaggaagccccaggagagaggtagacaggccttacaggccttatagacatgggcagagcttcttctccaataattctctcccttttatcattgcattcagtctctccaaacatactcatctcaagcatgtcacaacacattgacattctcatattttgtctcttgtctccaattctgccttttggttgaatcaaggggaatgctggaatttctagagtcgggccatcctagtctcatgtttctacctcagtctctgtaggtaaagcagacagatgggctccccttttcaaagaaaaaaagccaccctgcattcatttgcttattcattgacaaaatattaaccaagttcttactatatacttgtcactttgcaaggtgtcatgagtattgcagtgcaaaagatagaagcagtacccttgttttccctgagagtttccagttaatggggaaggtagaccttgtcaaaataattaagtaaaagaataaactaatgaccaccattgaatgctaactccagggcaggcactattcaaaaggctttaatctctgtagatccccacgaaaaccctatgaaatatagatgattactatttcaaccccttctccaagcttatagagttttaagtgttggagccaggattcagcttagaggatccacccatttctgaagagtgctcataagagaaatacattgtgcccagggagcctgccatcgataaaaatttaacactctttcagaaaatcagaaaaccacagtccaaaatcatggtgattcgttctataggcaggctgcatgttgcgtctcatcaccatggtaatgagatgcattccttgctaacctctctctagacctctgcagatctcccatccccaggggagctccttgaagatcatttatgagaatcagcagtaagcaccagtggcctttcagaacctctcagagagtgcttaatgcagtaattgtttactctgatttgtaatgagagagagtaacacggtgatgttagggactgattaattttcctgaatgtgtttcagagcagaaggcaccttgcagaacaagactcattttctccccctgtagattaccctgtcttgatttttttttgcagccgaaccccactggcacacctcaaagcacagcttgccttagctttgcataatgtaaaattgctgagataaattattatcacatgcaggatcagtgatcacttttttacctctaaattggtgaaagtgttgccatggaatcactaataaaaagaaagaggtccaggggttgctagttcatttagacgatctacagtttgatttcttccccttacaacaggcacacagaaagcagctagcatttaccaggtgcagagtggccattttgaaatagctaggaaggaaaatgaatactgaacacatgtagtgggccagagaatatgtaagatagctatgtttttataaagtagatcaaatgagtgtttggtaaagtggaatttctgagacgtgcgagtatgctcctaggggaaaaaggcttgttttgccaattgggcttttgttagaggccacagggtgtgttgctctggaactgaggctttgtaaattggcccttactagctgctttgtcttgtcttctaaattgcttgaaaatctattaagatatatgacccacataaaagtagcaccagaggctttccgaatcatggtccctggggattggattttactttatcacccattaacgcagaagggatttcatcagtcggcttacccttctctcatccccgtgggttataaaaattccaaagattagcctctctgggatataagcaaagatgtgaatacccagacagctgtttgacaggcagatatgctgggatttacagggatggcagaaacgtgggtcatgggggaagattagatgtggagtttgtggagagggttagtgagatagaagttcaaaatattagataattggactccttattaggaaggtatgaacagacgtttgttattgactttctgaagaggtgtctgggtcccgtttcaccagagcatcctctccaaggcatcgttttttcccatcctggcttctggggctcagtttaccttgctgtggtagcattttaaccaagcatacaaactcaaaatgaaccagatgcttaacatggtgaaagggggctgagtcttgctgtgtctactcaggcaggataaaggagaggtttgaactactagctggtgtatttaattgcctaagccaaaggtcacaaacaggtggcttgctggtcgtcctaaaacatgtttggattggcttgccctgtcttttgaaactcctgaatgaatggccaatatacataaattgggagattccacccaaaatagctagttttctaggtactcttgataataggcttctttgctccctgtgattagacaccctcctgctccatttctttctgttgcttcctggcaccagtgaagtattctttgtgtattattctgaagcacaccaactgcattgttccagcattttctcagtggctgtgtctgaaatatgatgaagggtccctcatgtcctgttttactgtacttgcacacctcccgagattactcacccttgatttcatccctgggtctttctgtgcctcagtgactcaatttgtagtgcactcttggcctcattccctttcccaaggatgctatggggagtataagagaaacaaagggtttgcaagacgccctaagctcccagggacaaatacaccactcagtccaaacttatggcatggttactgtttgtatgggcagtttagatctagcctctgagaggtggccagggtttctttcctgcttcggctgtattctacagagggatcataaggacccaaagcacactctctccctccgccccttttattcccagttctgcgagattggcagccccgtctcttcagccttgcatttattagttgagagatgattgccctccgtttatctgtgactgggttttgcctaaagaggatggcttcctgccaaaatgagatgcatgcctaatgaacttgaatgcctagaagcctgggcctcacagagtccctccatgtcaacctgcagccactgggaaaataaagattccagaaggttaatactgactgagtcaatttcttgactttagttttctatgcacataattcccctcacaggattgtaaattcttattttctctaaacagtgctctaggaattcagatagtctcttgttagtttcatcttttctagtattactatagtcttggtgtagtttttttgtttctttgtttgtttttttagaaaagggcaaatatgtgtgtgtgtagaagtgtggtacagtgggggagttttatattctcttacaatattgaagcaattcttctgtaagaacgaaatgaggttctttgagtttccaatctgggagtgaatgtcaagttcggagtccacaattgtgtctgactcaaaataggaaattgaaaaaacttgaagaaatgatgaccgcagagatttccaagctcaccttggcttcttaatcccagagaagattagatggtaggagtagaatgagtcctgaaaattgagtgatttcaggctgtgtaataccatgttgcgggctttacagaaacacaaatgatggtttgcaaaatacagtggctgccaaaaccaagtgtctgaaagatgacagattgtagcctgtccagttgtgaccctgagatgacaaagccagagtggccacctggcccattgttaactctttgatttacatgtagcaggcttcggctcatctccttagcaataaagtcccaataatgtggtccctgacctcaccctcacactgacaggtgccttttccgccagggcattcgccacacaccaggaagaaaattagtgctctgatgcaaggatttaccaaatgacctctctggggagtgtaaagagttaatgtcattttccaacctgcctaatttactctaagagggtattaatgtcttttgagcgaatcagaagccacgagtgcctggggagacaggactggggggcaaaattaaggaaaatacataaatgttaccccccttttccaaagtatctcattataatacatttacatataactcttttcttagcctacaagtgttttgacattccagcagtctttcaaaatggatcttttcccccctcccctttttctatttgcaacttctatggggtctagcagagccagcactgagaaccagcaaaccaggcttttactcttagttatgctgctatcttttgtccctgagctggtcacttctcagccttttcaactcgaaaacaaatgggttgagttaaattatttctaagggtcctatgctttatgatttaatggtttaaatgttttcaaaaatcaatgtttaaaacacttctttgaattacaacatattttaaatgcatgtagcatcttttctcctcattagggcactatctaaacataaatttatgatatcccctcatagaatacttaaaagcaaatgaagctggtggggtttctgggtcattttatcagcagcaaacacagcataactgtgtcaacctttaaccacagccacatttgacctctgaaaaaggcttgatgactgcagaactggccacccatgaccttctaactccattcaccttcaccctgtcctaattggtgatcccagtgcttctcagaaatccttggagcttaaatacatccaggcaggcaggtggggtctttaaaggatggctatcatcacagtacacaaggttttctcctcaaagcatgaaactccacaagcagttccaatatcgtgagtgagatcaggatcaaagaaccaagagaagggcttcttctctaggagaagattatttattttgttattccaaaagtgggcaatactttctgaaaattttgttctgtgtccaaaatttatataatctagttttctatagttgataatgcagctgcgctttaacatgctagtcataagccaggtgtgaacactcaatgtaaatgaattacgttcatgtaaaattaaaaattgagttcctcagttaccctagccacatttcaagtactcagtagtcacatgtgacacaaggctaccacattgtccagcgaagatcagtaacattcctgctgtcacagaaatgtctactggacagatctggaagaaagtggataaatgttcaaaccttcaggagctatttgttgtttccccttccatcattctttcaaaatatattaacttaaaaggagtaggccagaggctgaaaaaatcatgcagagtgctttcaatacattgtttaatttctctctttgaggtaagtgcattgtatctttttacagaaaagaaaactgagtcccaagatcacatacttggtcagtgcagagctgggatgtgtaaacagtctttcagattctaaagtctgtgttaatcttggataaaaattatttctggaatttttttatctagaaattgtaggaaaacagtaagtttctggactcaattatcatcacgatcatcatgattaccatcctcatcatcatttgtaagaagtgagtgagattttgtttttatattttggaaaggattctactttacaacaggaacctaggattttaatggctagatcacttcaaagccaggctaagacagagaacaggacaaggggaaagaaagaaagaaaacaaaagaagtaagataaaataaaggcaaacatgcatacgtaactcaaatgtttgcattttacttgtgcatttgtaatcactttgttttgagggctatagacttcatttagttccctatagagctagcatccttccagaccttgcaggtaaatataagagtgaggtacttgatatgcggtgtgtttcttctctgtgaatcaattcagctgagaagcaaagaactgcacttcagacttcaggcgttttattccttggcaacccactgtagtgatattacaaacattgaacctgttagactaatggaagtaaatgttgtaaaagctgtgaaagtcactggaaaatattcactcatttgtgcaaggataatttaccaagtacccactatgtgtgaggcactgtgctacacaccagctcgaaaaaaggtgacattaaaatacaaccccttcacctgaggggcaaattattggatatgggctgttacataagcaactctaaaatagtataatacaatcagcagtgtaggtaaatgttttatatccagctccttaggaaaaaaaagcagtatttgtctcatttgctatcgtcatggtgtaaataaatactcccactatgatcaatatcaggttaccaacataatgtcactaaatgtggagttggaaagagattgcttattgtaagcagtacaagccagatccagcgcactgtataatgtattatttatgttatatcatattatctgatatagtatatcatattatctatatacatatataaatatacatggatataatatatacaaaatataataaatgtaatataatttaaaatcatctaataccatgttaagaagatatagcctattggttaagagtttaggtttgggaggcctcacacctgtaatgtcagcactttgagagactgaggtgggagaatcacttgagcccagatgttcgagaccagcttgggcaacatagggagaacttgtttctaaaaaaacaaaaacattagcaggcaggatggtgcacacctgtggtcccatcttcttgtgccattgcacttcagtctgagtgacagagtgagactctgccttgttaaaagaaaaaaaaagttaaggttttgatatcagaccaatgtgactttaaattgcgaccattatactcattatactttatactcattataatcagtcagggattatactgactggctgagttctttaagcctctgttgtctcatctattcaatgggagaaaagctagtagcttcttgcctaggactgttgtaagggtcagcacagaaatgcttagttcagtccctgatccatagttaagtatttgctgatgtacaagtgagtaaatgagtcaatgtcaattggcagcatcgctggagtatgaagtaaatcgctgtaagaacctagaagaggacgaaattcagctcatggtaaatcagcaaaggcttcacatgaggaaacgtttgaaatgggccttgatggctaagtagaatcttaccaggcacatagagaaaagaggctcattccagatagatgcagtagtgggagcaattctatttgttgtagtggtggtggcagtttttctttaagaggtatatagtgccttagtctgatatgcctccttcttttcctaaaaactgctaggagctgctacacatctgcttctgctgttaggcaatgaatgccatcttccctaatacccactgagccccccagagataacagccatgcatcccttttcactaggtctttgtgagtacttctgtgaagaacatgctgactttttgccaatagcttttgtttactgaagccccagaaactggtgagagagatgtattaatgatggggcctaatctctattgtattttactgaaattccatttcagccacagaaatgccgaatgcctgccggtgaaatgtaatttcttgaagtatcacttattaaaggaaagcatatttcatctctccatgtctgaggtttattcaaacaaaggaaatgggttgttaccaaggaaagcataactcaaaatcccaattatgactgttaaaccacatgtgaaattacttttaataattaaaagtggctcttgccactccgcaatcctagttcaatattaggtctggtgccattttaaggaaagctaataatctccagtaaatccccttgaccttaattgtcttcacatccacccttcaatgacctttatcgctttgatggttaaaatctaaaataaatgatactaacagatctaatgtgcaactgcatcatgttcctttattttatgcatttgttatggttccattatacattttctccaaagaggcaagagtgttttgaaaaaaaactcttattacatgtattttttaattcaatttttaaagcagagagaagaaaatgtcaataagaaaagtgtcatttgggagaggaggtaaaacaatggaaggaaaaagaaactgaaaagggatggcagtacagaagaaagtcagtaattataaacttcactggcaaaatacaaatgtagcatccaaccgtaaagcctaagagagcaactaaagctatttctagaagcaacaaatttatgtaagtatttgcatcttgaataataatttcttttacaaaatattctaagatttggaaagcctgtagcctcaaggacagagtatatcttggctgcttaccacagcagtccattttgatatctatattttatatttaggaatattcttggattcacatttataacttgtttcttagagattgcacatgcagtgtagatattgtagatttaattgtttctcatattttaaacagttgatgttacttttgtttcattgtggtctacatttctgccattttgcgtaacgataccttattcttctttggaaaagttgctctgctctactatgcatttctttaatcaggcatttatttattcattcaaaaaaggtttcccaagcattgtattatgtgttgtaactgtatttgttgcttaaaatatacagaagacgtgtatatcatctgtccttttaaagagagtgtagggtgaagaaaggtggaagagagacatcatggcgactgataaactaaagaatgatataggcatatgtactgattttatggaaatatgtcatttatcagcatatctcgaaaactctgcctggttgagggagccatggaggaagtaaaatggtttccttcaggctcgttctgtgttttacatgaacgcaacctcgtaaggcagcactgagagtcaggacattgtccctgagacctggtcaatactgcttagggctggctgaagaacctctgtccatggttccaaaaacagccatcaattctctcttccaggagtcacacccacacacccatatacacatccaaaaatgcacacccattcaagcaactacgtatccattaaccttggtaaatgctttcttgcttgaaacaaattatttccctttttttccctatcactcttagaatgaaattgaaattcctaggagatttgtcttattccaagctttccctttacacagccctccaaccacactggcctccttcctatgtctcaaacaagccaggcttgtgtccatttaaggctttagcacaagctctctgtttgccttagtacatttccagagagcatcaaatgcttcaatccttcttgtcactgaactctcagttttaaacgtctcttgaggaggaatttgcttaatgatcttataaaaactatcccagtttcaccacccagtgagtctttatcatggtttcccttttaatggcaaatatttgtatgtaacaatttattattttattatttatattagtttattttctgtcttcttcaccagaatataaggtcaataaaagaaggaactttatctctagtattaatcctaaaaaccaattcattgtaaatatcaatgagatcttagccgtcatgggagccaggctccaaatggcccagtgatcctctccttctgctcttcatgttctggggtagtcagtcctttaaggctgacctctaaccaatgtgatagtatggaaattacaatgcatgacttctaacgctaggtcataagagaaattgtctacctctgttttgggttgctcactctgggtaaagccagccaccttgtcatgaagacactcaagcaactcatgaagtggcccccatggggaagaactgaggattcctgccagcaaccagcagcatgtgagtgaacatcttggaaactgattctccagccactctcaaggcttcagatgctacagccctggttgatattttgagcacaatgtcgtaagaggcccggagccaaaactaccctactaggctgctcctgaattcttgacacacagaatctgttggggacaatgagtgttttatctaagccactaagtttgggggccagttgctatgcaacaacagataagtagtatgcctatgctgcactaactgctaggtcttgctgggcacacagtaggcagtcaatatttgctgatatttaagtgaataaaggggtgttgaggaaaactccatttcatttagctgcatttaaataaagatgaattatagcttcactgcaagatacaggaagtagccaaatttttaagtgtattttacaaaagatgcctatgaagaaatcaatatcacaaacctgaatactcgattcaagctctggcagctttcttatttaactcccagttgatttgttttcacagagtaaattaccagaagggcatttgtctcattctctctttactaaaaggtctttaacttctatttgcaggtgtttttgccttctaatctttctcttcattgtttctccagattttgtcacgataacagatgtactttttgtattctttcaaatcctgccattttgcttaagaagaaaaaagatttaaatcaaattgtggttcatttgtgatactctccacagacatttataactgacaactgaatgcatcagttactttaaacagcctgactacagtcattcataacaaaacaaagaggagtgactagcataggactaactgatgagcagttctgtggagttgaggaaggttgtaatactttacatctacaacttaagatttcacagaagtctctgagacatatttacattacagattatgattcaaattttaaagcacaaggcaacattgtttggcccagctacttgattatgacttcttttcaatgtgctgttcccctgtaaacatcatggttgacgtttcaggcatttgcttcttctctctaccaaggacttgttttcattaacattgatgaacagctttcattttatctgtgtgtattctacaaaaagcaaaccttgtttgaaatttgtttcatattggaagaatttacttcatctcatagtcacagtgggcctttagctgccaatttaaaatgaagagacactttgcaaagtgtaagttattttattttaatgacattttatactcacgattcacatttttgtgcaggtaaaataggatatcattaagatcaccatcattgtgatatcttgcagagttaaattctctggctgggaaatgtttaagcctcagtagtttttgaccacaaattcacatttcaaaagaaaatatattcagggttcagaaaacagcaggtgcaaagggagttatagctatctcttttaactattaggaggaaaactaaaattggcaacaatagacttgtcattctctgcacttttattcttaatgataattatatgatgaaggaatacacattagcaatggcaatagagatatcaaattgtatagcattattgccaccattctaggaatagaaaagcagagtaagaagaaaaagaggcattagtgttatttatcattgatgagatgtggaaacatgagattcgcattttgcaatgcacagtgacattaaactctaatctagtgcagagttcctcagtagcaacattactgacatcttgggttggagaattcttcattgtggggacctgtcttatccaacataggatgtatagccacatccctggactctgcccactagacgttggtagcatcactgtagtccttactacccaaaatgtctcaagactttgccagatgtcccctaagggccactgctcttgtgtaccagataagtaaaaacatgggacattgagaagtggaagatctacactatctttaccgaaaagacccccatacatgggtgtattagttcattctcaccctgttataaagaaatatctgagactgggtaatttataaagaaaataggtttaattggctcatggttcctcaggctgtacgggaagcaatggcagcctctgctctgcttctgaggaggcttcagaaaacttagaatcatagtggaaggcaaaggggaggccagtactttacatggctggaacagaaggaagaaagagagcggaaggggctgtactcttttaaacaatcagctctcatcataactcaattacttgttaacactcatcaacagcactgaggggttggtgctgagtctttcatgaaggaccacctccatgatccaatcgcctcccaccaggccccacttccaacgttaggtattacaacttgacaggtgatgtggacggggacacagacccaaaccatgccaaagggtaactggcaccattgacccagatagtagcagagactcacacagctggaaggggctttgggagatatataggccatctttattttatgaatggaactctgcaactctgcaaggagcatagatttgttcagagtcacacagctgggttgtgtcaggcttgaaacttgatgttgtactacttgcatgctgttttttcttcttaactgaagatagctcatcctctgcaaatcttgtatttaaatcttctttattttctggaaaatgggttgggtttgcattatattagcccacgggaatgaccaattgtgcggcaaagaaaaaacaccgttctcatgctgaacaattgtctattccttctgggataggctgcagagaaaaagtagcactctcctctaggcaattgtctattcccactattcaagatggtgaatagtgggaaatctagatgttggattttgtgctacgttaaataactcctataagtatactaatgatatgagtttaaagactacaactttgacagatgcatgttcaatataaatgatgcaaaatccagtcattgcttgggttcaaatttcagttcaaatcactagctgcataaccatgggctaattaggtaacttctctgagcctgattcttcaaatctgggggcaaaatgagttatagcctaactcataaggttgctatatgtatgaaatgaaataatgcatatagttgagcacaatttctagtatatagaaagcactatctaaatgtaagtgctgttgctgctgctattgttgttataagtactattattgaatttaataactcaaaagagctaactctgcatagagagatgtgcagaatgcacgacaaaaagactttaaaaaataaagatgtatgaattaataggaagacttctcaatcatggctagaattaagatagacaatgtggagatgtgtaagaatttttattccaagaaaagggctttaagatataagatatctacagaattgttacagtttaaattagacataattacagaagatagttttaatgtgatgctgaaatatgacaagttaacacaagtctgtgtatgtgaatttgaaaagtatatgatttttatggcttttaaaaattttattcattgaataattcctaaatgccaggcaacgcccttctccatggctgacagcctgaccaacttgagttgataatgagactcaaatagaatgcaaattgcctgatattgtcgccttcaccaattcaacaatcatcccaatcctgggactctgaaatattaataaaatctaataaaggactccaacatgccctacagatggaaaagaaatgaaaaaatgtcatgccttctctgtgaatgctttgaaatgaaaaatcaaatgatcggtgggagagagacacaggaccaacaactgacggactgtggaatattttcagaagttttctattactccagatctattgctgataattttaaaaagacaatattgtcaatttcatgtaatcatgtgtcactgtacatatgggaatatctaggtgcataacgtggttgccttactatactacattggtatccacttgagagttcttggctcttgatttttatgcgaaaacatagacccagtgttttcaatttgattccttagcatgtcatcgggaagccttgatactttgcaataaactgccaaaataccatactgcacttatatgtacacaaaggcacaatgtattatttaatattgtttttaaaaagaaaaatatatagttaccatggtattggaatgagcaacaattgagatcctgctgttcagtgggtaaaatgccctgcttcacacataataaatagcaaaccctcattgtttgtcatcttgtagctcattgtcctgataatttctcaagtggaagtaaattaatccatccccccctttaaaggatatagtaggctggaatagaaagagcagtgggtttgaagttaaaagagcctaatctaatccacttgccagctatgtgaacttgaataaggcgtagtttttgaatctgtaaaatagaagtaaaaccatcgatcctgcctgcctccctgtgagacgcacgctgagaatcaaatgtgattgcacatatggactgttttgtaaaataggaagcatggtacaaaggtaaagtactattgggtggggcaagggacatctacattgtctgtcactagggtgcagacatgtctgagcatgtctactggatgttggatcaatcctctcaggagtctatttgcataagagacatagtgtctgcttgagtagaagttataataagagaggactgtgtcaggcatgccactctggagccagcaaaattaaaaaatatatatttagtcacttgagaaaagaaattattttgaaaccactagcaacagctctcattagatttatcttctggccccacattttagcctcgtgtaatagtctcatagaaggagggcaggggaaggagctctaaggaaaaactagtacagcatgtaaggtattagggtagaagcagcaactcttagagactatgtatagaaagtgaaactgtaaatgcagagagaggcatttttctcatgtgttgcaatggaacatcattcagctttgacaactcagatgttccagtttatcattgacacggtggtacctggcagaacacatcttcccaggttattacaaagaatcttggcaagcatctgtgcaagaccctggcaggtgccaaatctatctgatgtagcgcagttcccacgtaggcaggctccgcatctcacagcaacctctgctttagtagaacagccctgacatccaggttcaggctatctgtagctatgtctctgctatatggacctgccttttcttattgaaatctattatttgtggtagacatctgatccaggcagagaaaataaggtttgcttaagttacatttaaaagtaatctaattcgaatttttgagtaaagatgttgtaggaaaatacaggttcttgtcacacaatcagaaaagattaggctcatggacacacagaagggtgagaaaaatggaatttattgggcaaaaaaaaggaaaagagaaaaactctcagcagagtgagagggaagcctgtgaactggctcctgccccaccacataggagctcaagaggctgggttcccggcagggagcttgcatggccccaccccatcctctgagtgtgcaggtgggcattattcagaaagaatcagttgggaaagggtggacttcatctggagccagcagtccagtttttcaaccttcaggctgttttaggcttgaagttgaggttttgcagggagtccttggcctcctcttgcatctatcaaagatagagagattgaaagtcaccaaagtgtcctcacgttaatattagggctccagagtgcagagtcttgttactaaatttcttggggcatgcccaattgttcagttattctcttcgttctcagtacaatgctggcattcttctaatataaatttcatttaaaataattaatttgaattttgtctgatcaaaagaagtttaatacctgtgggaagaggactttacaggtaattagacattgacttggcaagtcggaggaaaagtcagcgtaatatgaatcacttatgacaatttctgtcatttaacagcctgcagtcatgtctttcaatgtagtacaccatgatggttaattttatgtcgacttggctgggccacattgcccagatgtttggtcaaacattatcctggatgtttctttgaaggcgtttttttggatgagattcacattcatatcagtggactctgagtaaggcagattgccctccataatggaggcacaatggtgggcctcatccaatcagttgaaggcctgaatagaacaaagactaccctcccctgaataacaaggaattcttccatcacactgcctgtgtcctcagacttcaactcttccctggtctctagcctgctcactccttctcctggagatttttaacttgcacctctacaatcctgtgagccaattccttagaataaaatctttatttctctctctctctctctctctctctccctttctctctctctcttctctctctctctctgtgtgtgtgtgtgtgtgtgtgtgtgtgtgtttactctctctcttgctcgctgtctctcggtttgtgggtttgtttctctggagagccctgaataatacatacattgttacctaacaagttggcagagttatccagcacctccaaaatatcagttctcagcctctttgttgtaagtttggtgaggatcaacaggcaacaacggagtcagagtattaaaaataaatagtagattttataaaaccctcaggctctcttatctgtactgcagactggaatgtgatctcttcatgagtgagtgtgcacccatatgcatttccaatttctatagtaacaaattaccagaaatgtattggtttcatgttactgctctggagaccagaattctaaaatttttctgcaaggctttgtttcttctggaatctctaggggagaatctgtttcttctctttccagcttctagaggccacctccattcactggctcatggccccttcctggtgtcattctgacatctacttctgtcatcacatcttcttttttgactctgacccccttgcctccctcttataaggtccctctgtgatcacattgaacccatatgaataacccaggattagctccctatctcaagatccttaacttcctcacatctccaaagtccctgtattagaagcgtttaaaccagaacaactccatcttgaataggagctgggtaaaataaggctgagacctactgggctgcatccccagacggttaaggcattctcagtcacaggatgagataggaggtcggcacaagatacaggtcataagaccttgctgataaaacaggttgcaaagaagccagctaaaacccaccaaaaccaagatggtgacaagagtaacctctggtcatcctcactgctacactcccatcagcgctatgacagtttgcaaatgccatggcaaccttaggaaattaccctatgtggtctaaaaaaggggggacatgaataatccaccccttgtttagcatatcatcaagaaataaccataaaaatgggcaactagcagccctcagttctgctgtgccatttttttattcctttattttcctaataaacttactttcattttactctatggactcaccctgaattctttcttgcataagatccaagaaccctcttttggagtctgaattaggacccctttcctgcaacacctatgccatgcaaagttaacaacccacatactgtggattaggatatgggttgcccccctttgaaatatggggtcattattttgcctgccacagtgccccatataaaacggtggtcctccatggatattatggctcagaaaaaaaattgaggactacttttttctggaaggcaaagaagagagaatccattaatttttttgtcctatatcgtgttcaaaatttagacccaaaagcttcctctctcctaatttaggatgacagaagtaatgaaaaaatatcaaaagacagaagaaatatttctaagagtgtagattactaattactaagaataagtacatgaacacaagaaacagagcctctgttcatgtggaaactaaattgttagtaaagggagagaaataataaacaccataaattgggatacatttcgagggtggaactgacagaatttgtcggtaaattagacatggagagtaagaggaagggaaagattatggctccagtcttactcaagcatctatatgcaaggcacagcaccagggactacaaacaccctgatggtaaggtggagatcaaatcacccttcaataatcaaagtttatcagggtcttgctatgaacaggagcaaatcagccaatggccaatgcatgtttgaagagatgcttaaactcactgctcatcacagtaatgtaaattaaaattatgagacaatttttttcataaaattggaaagaaaataaatagtaaaaattaacagtatgatgaaggtgcctgaaaggctatctcagtcattagctgtgtttcaaaagagacatcaaatcttatattattgaagttgtagggaagcagatactttccacttatttttggagagattggagattggttttagcttttcagagaaaaatatgtttctatgtctcttaaaattaagaaaaaaaatccattaaggaggctcagccattacacatttaaatatgaaagaaaattacggaggtgtacaaagagtagattcagagggttcactagagtatcatttataatagaaaaaaatcagaccaaatttaaacagtttttaagagaatattgattaaatggactgtctgtatccatataacaaatattcttaataaaaaggagttaaaacacataggtgagcaaaaatagacttagtattatataacttatgcccagagtctttacaaaacaaaactacatacatccttttgttcacatataagtaggatatgagttctgttaaggatggaaagccacagagagcattttccttacctatattccttaattattgtaaaatgatattgtatcaatgttgcatttgtataattgaaaattaaaatgatgacaaaaataaaaaggagttgagtggttcagtaggaacaatggatagcaaagacttactgtgctgcacggctttacatttttgccaaagcttcgctcactgggtaagcccccaattctcctgatcatttgttgcttttcctgttgatgtgaaaatcaggcattttttcagacaaaaggcagtagaacatctttgaaatgaaaagcgacataatggcgcaatacttaagggttttattcaactataagatcaatataaatcaacactatgatgaggtttcttgcaatgcctgccttcatcactaactacattaaaagagacatcgaatcttaaaaaagggaagaaagagaactctactccatgctgcttacacagtatctgcagtgttatatcaaggtgtgcacactatatttgaatcatgtgcaaagaaagaaagcatggctattaaagggcttgaaacaatgtcctatggttaatagtgaaatgaacagggaggcatttaaccaggagaaaaaagtactcaaatgacatatgatggttgactttaagcattttaagactgctacatagaggacaaaaggagctcattctgttgacttgcaaaatacagaaactaagaactactgtttcacaaaacactgacatgtacattgtttctcattcttgtgagatattattgtcctgtttgacagctgtgtcagagaccaaaaaagtttgtgtttcctttttccataatgttatctctgagaagtggccaccagccagggactacattccctagccccactgagctgtggccccacgattgtgttccagtgaatggaacagtagtggaaaaattgggacccacttccacaggcgacacatttacacacacacacacacatctcctatgcaaatgctttcatatgctttttctctttcggttagcgagaatgaagaagagttgtagtacaaactaggaaaccaaagctaattataatggaggctccatcagcctggatccttgatggactgcaaggaagagggcagccctaccaacttgttaatccactttgtagtattatatactaataattcaacttctattgaggccgagccattatacactttgaagtctattgtcaaagcagttaattcattgaacagattcagaaagtaaaactcagcaggtaagtgttgagtctgaaaacaattacactatcaagaggttcaattaaactcaaacccaggccatcttattctgcatccaaaaccttttctcttgtaccatcctgctatacaacagaagtagaatcaatgttataaataaaaaggacagagattatggctcaacataaaagaactctgtaacaggcctattcttgcatttctttaagaggcaatgtgttctccatcgcaagaggtgttcgaaaggaaacattagagaaagaatccaacagcggatgagtgtcagaggtagatgatttaatatttcttacgacctcagattccatgattctgtgcacacttgaagcactcagatgatgtttattacacaaacactatgtactcagtagcaatttgggagccctgtggtctccttaacaaggtataatgggagtgctaggaactgagccagaaaaaaaaatgaatgagaactttcactagaacaaggtccaacaaatgtttcatttggaaaggttggtaagattgagattgacaaggaacttgattaaaaacatataaatgattctttgaacaaataaaattcttggataattcattgactatggaagagcttacacaaatataagaacccatgcttatgactatttgttgatctcactgcgataatgttcacctccagaggaccaggagaccatgagtaaggaggtaaaatgtcagagcagatttctttggttgataatgggtggggtgacatggggatgagggctgtaggaggcagatggtgatttcaagtttgagtagcttgtcaagaggttcttataacacatacggggttgggtttgagctagaaaaatagcaagttcatttgttctcacaactcctaccctccagtaaagctgactatggctgccacttctgcttccactttgtttcctagagggcaaaaccaaaaaagaatagaagaggaagaaagagggtattgaggtatgcataaagtagacgtagctcaagttcaggtgactaagatttttgacttaaacagttattggcgtttgtctagacctcccccaataaagagatagatgccaaaactttgagttatttatgccagtgctatatcaaaattctgaagtgatttattcattcaacaaaaactttgtaaccccttactgtgtgtcagacactgatgtaagtaatggagaagcagtaatgagaacaaaacaaatcactgccactgccttcccagagcttacatttcactggtgaaaagagacaataaactaaataagtaaaagaatgcattttgagtaatactgataaatgcagaaaaggaatgtaaatcaggacatgttggtggaaattttagaaaagctagctaggaaacgctgtactgagaattggggttctgaataaattcgggaaggcattgatatagtgagccagacagagagttgaggaggctccttgcaagtagaggaaacaacaaagcccaaggcattaagctgttcctggcataaaagagctgatatgtctggagcagagggcactagaaaaaaaaaagatactagaaagattgcaggaatcagaattaacaaagcctgaaggtcagagtaagaccttttagtctggctgcaacgagaaccctggagaagcttaagcaaaagattgacaggctctaacttacttgttaaatgaattactctagctactgtgtcaaataaatttggtaaaggtggaagcagggagattaattggatcattgcaatatctaggcatagtggtttggtctgggatggtggctataggaccagtgagaatgagatgaattctgaatatgtttgaagttagaactgagaggatttgctgatagactaaatatagagtccccatgtgatttttcttgtgtctattagagtctgagaggcactgaatgagtctgagagagagagaaagggctaaggatctatagaatgcttgacagggagcagtaagggctaacttgagattagggatgaattttaagtaagatcaatcaggatgttttgtgtcttcttcagacaccttcgacagtgctagaggaggcactgaatacatagaaaggtaaatttaaccagggttttggttttgccatgagagtgagagaagcaatgcagttgcaagaaagttgactataatcatagataagctgtaaattatagtagtaactgagcacaaagtataagcagagtaggaagggaagagaaaacatggttggtgggagtcagtaaaagacagtgaaaaattgcttggattgatgcattagacagcaatgcaggggttgaagtgctactggaatttgggcatacaaggagacagctagagaacagtatgcgatgcgcagttgataaagaacaagattaaatacatggcaatgatatggtgtgcctgagacagagtgaagagcaaggtcactggagaagaaggggccaagaaaataaaaggagggcattggaaggatcatctgagaggctacggaaattataaaaaattacaacactggtaatgttgaagtgacagtgtatcaggagaaaacaatctctaaagaaaaagagataggctgggcatggtggatcacacctgtaatcccagcactttgggaggccgagtggggtggatcacgaggtcaggagatggaaccatcctggctagcatggtgaaacctcacctctattaaaaatatataaaattagccaggcgtggtggcggtagcctgtagtcccagctacttgggaggctgaggcaggagaatggcatgaacccggaaggcggaggttgcagtgagccaagattgtgccactgcactccagcctgggggacagagtgagactccctctcaaaaaaaaaaaaaaaaaaaaaaaaaaagaaagagagataatgacctgagaatggatgaaaaataaggaagaatgttgggtgatatgtagtcaaatgagatgggattcaatgctgactgtttatgctttggacaggaatggtctagaagtgtcagtggagagagataggacatctgtcctgccaccagatgccatgataccataggagagaaaagaaccactcactaagagtgctgcagagaaagatttgccattagaggagaaaggattttgtgtgagcaagaagtgaatgtttgctgatgaggttgagaatatcagttgactgagaattgacatagagctccatatggccccatgaaaggttattaaagatggggagggagagataagggtcagaaaaggcaatgggaattaggggtggggatctggaggatgagcaacaatatgaagcacctggacaccttgtgacattcagcctaaacagggaaaggggcatgatgactagctccagtggtctcaaggcagatggaataaagaggcttctagtattgagggggaaaagggatgaagaaggcccttgccagaaagaagaattccgtggttcccacttagccaatgccattggagacaacacaccctgctgaaggatgatcttcctctgaggttgtagacacctgcttggcctttgctgaatggagcttttttagagttgggttttctttttagcataggcactctccaggcctacgcatatagcagcctgcaagtggggtgttatcacaaaggcatatttaactcagtgtaactaactgatagtggaacatcagaaaaaaggaagaacatcagaaagagagaaatatacccaaataaactaattgcaaggaataaaatatgggtttagttgacagatatgttggtcagtgtgcaaaaaaaaaggtagaatagtccattataatagtttattatacctgccagcttccttgttttggccatttgtttactctccgtttttgacacctgcctcaattacttgttgtgactctgtcgattctgatgttgcaataaacctaaacattatgactaaaactaaatattttgtgctttttttcttctttgcctcatactaaactcagccagaagctgaacactctcatgagagttcccagtatgatggagaaaagaaaaaaatatgacaagcactgcttgtcaatagagaagcaaaatagaacatgccttttttggggggccagaagtgccacctttagatgttaaatatcatcccttcggtcaaaaaagatgctgaaaatctttctaactctttcaaactgtgctttcatcaaactgtcaggacttccatagatagctgaaattccaaatcaaaaacctagcaagcagtttcatcgtctgtgttcaaatctcagtgggactttatagcactttccttgggagcaaaattcatgtgtctgaagctcagcttacatttcatgttgaaaaattgcaatgaatacaatgaagtttcttactgctacataaaattgaagcaccaaagagaacagtgtgtatttcacaatgtttgatatagtatttgatcataacttgagggaatcaatgaaccttcaagaagaaactcttggggatcctcatgcagcaaattcaatcatttgttcatcaactcattacatttctattgtacactagccatgtgctgggctcatcctaaggaactaaacaggctcttaaaatgacggtctgtaggcgtaaaaccttttccattttaataagtaaatataagaaaaatacaactcatgaactaggtatttcccaggtttaattcagaacatcatagtgtcaaaaattgtagttactaattgtgcatcaaaacaacaatgccaaaaaaagagataacaatcttttttgttcttgaaaaactagcagattaatgtattttgctacttagatattatcagaagtatcgaccagactactttaagcaacaaaatgacaacaaaaaatcaaagagtatattggcgaacggaactgagaaattcagtacacagaacttcaggcacagcttgatccagaaaatcagcattctttttctcttcctaaacttctcagcctttctctccacagtgtcttatccttattttccccaactattagtacatttcttttaagaaaatctggaagaaagcttctgagaactcctggctcaaatcatcacaaattagaatacaacattaagaaaaaagtgtattccctctcacctgctgccatcatctacatatcaatctcaggaaagatgctaatttcacctctgtgagttatcttcttaactttagaccaatcacttttcccaggggatgagatattagctaagccaaagactttgtagccagaagtggccaatggactgtgattgatatctcttcagaagcaagggagtagttagtacccccaaaaggaatgatgatgaggagaaaataaaagcaacatatattcactatgcccaacctggcaacaagaattgaagtaacctatatatctaacagatgaaattatttatggtacagctaaacagcagactgctatgcagatactataattatcttgcaaaaatatgtcatatcatgaaaaatgttcacaacacatggttaggtttaaaaagtagcttattaaacagtagatctaatagaatactatttggataacacttttgtattacaagatgaaaaatctatatattattatgtatgcagagaaaaaatactataaggaaatacactgaaatgctaattgtggccatcctttggaggcaatgttatagggatattttgttgttagttgtgcataattatgttaactactttttcataataaaatgtattacttttgaaatcaaagaaagaaaaaactatcatgtggaaatatacacctaggagtttggatttatttccaaaggaaaatgtcgtggtgatagattccttgcaataattttcatagacacacaacacgagtgtgtattagttcctcctgaggtagaatcacaaagtatttgctcttaggctcttgatctgagccctgaggaatcacattttcagttttattccaggcatgtttcagaaatggcaagatgagatgaaagaaagattagagtcatgtctaaaaattggctttactagggcaagtaagtccttcctgtatagtgaattgtcattttgaactgtaagacatttttttgaagaattctttaaccacaaaaacaaagattttctttttgtcgttttatagtctcaatttcagcaaaatatagtgcatataataacaaacagatggaggaaacaaaacaacaaaatattcagtgttaggccagcactgattaaagcttaatattttgtctgggggtctaaaataatcttttcagagaaagtagttgtcaaggcagctggtgtaaaactgtttattctttttgtcatcttgtagagatgttaaagcttccctattgcagtataatgcttttaaatccataaacgatccaaggttttaaaagatgtacatatattagatctgaatttgttcgaattatttataaagtggagagatggttagcattaatgaaatgatcctttcagtccttgcaaattgttcccatacctctttctcatactgaaatatttactgagtttctgtgatgtcactgagttggttgctatgggaaacccatacaagatcaggaagtgttcttatttgtagtaagttcattctattcaaattaggtatcctttggaataggaaacgttttcagccattgtacattattgaacttttattttgtctaccgtgtacaaagtacctgtgagatggggatacaaaggtaatgaagttatttttatacatatgaaggtaattatatttttaaaagaattactatgtaatgcaatgtagctaagataataatgcaaaaaaaacttgctatatgagattggaggaaggaatttgaaatgcatttagctgcaagtaacacaaaagtcaaactacactgacttagttaaacagattttttttttcttatgtaagaattggagatatagtaattaaggaccagttcaatagcttagtgctgccagaaatgatgcctccacttttctcttggccttttcctaagacttagctcctctgaatttcaagatggctactagaaatcatatccacattgaaggcagagagaagacagaggaaatgaagtagaaacaaatggatcttttccctttatcaagaaagcaagaattttctcaaaaatcccagcagacctttcacttacatcatgtagtggatatgtttcccttcccaagtctttttagtcaatactggggcaaccagtgtcatgaagttgtgaccgaatagcagcccatttagcttcattgtgtatctaacagtttctgcccaggcatcatgaacacagcttataggaaacctgtggaaatctgccacttatggacaaactggagctatgaaaaattaacaacctatgagaacagtccttggccagtggagaagagaagccaataagtaaattctcgaccttttcatttcttgggcagatgatagtgaggctttgtctatacagtccctcaaataataccagtgtaatgggaccccacttgccaacaatgatgatgattttaaaaattcacaatttgcaggttccataattttctgtttctttcttagaaaaagaactgtgtgagtgagaacttatttatgatctctgagatttcttcccaagaatgttttctgcacacaaatccttttctcgggctctactttctaaagaaattcagactatgacacttctcattggccaggcctgttttatatgactgctctttatttcaagggaagctatcagactgagtatctagttgcaaacatttttatctaatcaggaagtagaagtaagaggtattgagagaagatttaacagagcaggttatgcttaaataggtctttgtagattaactaggagttttcaagaagtgaagggataaggaagcttttacaaattgtctatgtgaaaggatcagcatgaccagcactggagagaagtgaaagtataaggcttatgcaacaaatgacaagctggcagaaattccatttgactcaaactatgagtgaaagaaagaacagaatcataagcaccaacaaaatgagtctggacaaatagaggcaggtctcattggatgggtcttgtggcttttccataacctttcccctttagacaatcttgaatctttaacaaagaggtggttattcacttaatacatatttatttcttgcccacaaaagacatgtctttatctagccaccaagaatacagtaatgaccgaaaagcacaattactttcttcttggagcttacacaataaacacaccaaacgaataattcgataaataagtaatacaatgacaatcagtgataaatgctataaagacacaaaaaaatcaggctatgagaactgagaatgatagaaagccaattttaaacacagtaagcaggaaggaatgccccgagaatgtggcatttaggtgaagggctgaactaaacagggaaagaattatgtgggtatctacaggaaaaccattttcaagagaggggacatcaaatccaagggctctgagacagggccaagctttttgtgcttggagaggaccaagaaggcagggtaagtgggaaaaacaatgatgaggatgagtgttaagaggaaatgtcatgaaagcaatgtggagactggacacacagggctttgtaggtcaatggtgaggtgcttggattttattctaagtgtgttgggaagagactggataattttgggcagggggtaatgtgatataattagatatttgagagattgctgtggctgctgggtgaagaactgagtaacacagaggtggtgtaaaaatgaagcggaaagaacaattaggacagccagtagtataggtgataaaccatggtagcttggtaaaggatactaacaatgtagatgctgagtaatgaatattttaaagataggcttgcaagaacttgccaataatctgtatggagtatgagacaaagagatagttggtgatagcaactaaaatatgattccacaatgaaacagggctttaagggctctctatatattgacaagtcgtcatgacaacctcatgaagtgtcactattattaacatcctcattgtacacacgagaaacatgaggtacagggaaattagtgagttgctaaggccatgctgctagtacttaaaacggcaggttttaaagccatgcatctagctccaaagtcatcatctcaaccacaacactatttcgagatgcctactaaatatcaatggcaacatggagtagtcagttgtatacaccaaagtggaactcaggagagaagtcaaggtcaatgatacaaacttatgaatcatcagactatagatgttaaaaccatgggacaggatgaaatctcctagggcagaggttggcaaacttattctgtaaagtccagatagtaaatattttaggctctgagggccatattgtctccattgaaactactcaactatgccattgtagcttgaaagtaaccatagataatagtaaatgaatgggtgtggctgtgttctaacacaactctctttacaaaaacaggcagtaggggaagatctgccctctactcctagtttcccctcgtggtttcaaggaataaaggtggttagagaagtgacagggagttggaactctctacgttactgatgggagagggctgcaaagaaatcatcaaaggagactgaggaagggaagtgacagagggaggaagaaaaccctcagaaagaacaccaagaaaagaaaagatatttatcacaagaggccaagagtgtggccagagggtagaatcacagaatgagagaagtaaaagggactttagtcttttgttcaaagattctaatttttgtaaataagaaaactgaggctcaataggagaaaatgattttcccaaagtcatttcaagaatacaatacatttttctaaggcatccacgttatgatgtttctaaggcatactcaaatattatatattttagcttaaaatataaaacaaaattttgccaataatagcatcaccctgaatgagcacctgaacactgcattctggttcaacaaatactggctgcacaactgctttgtgtctacaagagcatctggctctggagccacggagattaaagatgcagtgcctgtcttcaagttacttgtagtctaaaaggagaagtggaaaaagaaacagataattgcaataacttaagatatgtttttcaggaaatcctagccaggtgctatggactgaattgtgttgccctcagaattcatatgttgaagtcctaacacccaatgtaatggtatttggagatgagggttagatgaagtcaggagggtggagccctcatggtaagttaagtggctttgtaagatgaagacagaaagattgatcttccatgtgaggacatagtgagaaacagcttggccatctgcaagccagggagagtgctctccctagggactgaattgaccagagccttgatcttggtcttcccaggctccagaactatgataaataaatgtctgttgtttaaaccacccagtctatggcattttgttatagcaacgtaagctgactcatacaccaggtgagccttgagagcacagggaaggaaaacctaaccttgtctgagcattagggacaatttcctggaggagaggatacctgaaatacctcctccaaactgtgtcagtgcctttccagtatattcctatattctctaggcttttcttcatcacaacacacattcttcctaattaagtgactttgtgtttatctatctctccaccccctcttcccacaagttcctcgaagtcagggcatgattgtttatggccacctttgcgtgccctttgcaaaatacagagtcagtattcaataagctacagtttattgaatgaacgaaggcatgaaaatttgacttggtaaccccaatgaacaaatgaaggataaattggaggtacccaggcaaagaaagaagaattttgatacaaaaaaacaaaacagcttaaagaaagacatgaacctaggaagcaagtggtgcattcaggaaatgacaggtagacctgaataatctgaagtagaaagttgaggactgagaaacgtttacagcgtgcttataatctatcaagaaatactctgatactctgacttattgactatattaactccagtaatgctcataacaaccttttgatataagttgtattataactccattttacagaaggggcaactgagacaaacaggtgttgagaaatttgctcaagattacacaaccaagatgtagtgaagctgggagaggaacccagacaatcagcctctggagtcctttctgtgtacatggacttgagagagcactaatgaccaccttacgcagacctataaggccaggctaaggagcttgaatttttgtaagtagcctactggaagccatttagttatgatagctacctggtttgctttcatttaaagtaagatttgagaggtgtaagactggagttgcaaattttcagctgagacatatcaggaagccaggaattataaatgaggagacagatttcataagtatttgtggggtaaaattgacagggctttatgccagcagagggtgaagaatgcagaaataagatgagtcaagggatgatacttaggatgatggcttaggtgacaaggtggatggtgaggccattaactgagacagggaatccaggaagaaaaagtgacaggggaagatgatacatttagatttccctatgttaatttcaaggtgcctgggggcaatcacatgcagatctccaaaaggcagttgaatattgaagtctgagactcagggacaggcctctgttagatttaaaaagtcgagtcatcagcacgtaggtggtagttaacacatgagagcaatgagttttttattgtaaaatttatgtgcacgaatattacctaccagtgtgtgtgcacaactttggaagcccaattatcaaaagccttcctctgaggccttctcaattagctgaatctgcaaaatatattacaagatgctaaagtagctctattggtttcagcctctaaatgtgtccccaaagtcctcagcaggaaagaagtaacagagtttgcttttacaaatgcacttaaaaaagcaaaaataaaataagataaatataaataaaacatctccccttccaaacataaatggtgtccaaggagaagttgaattctgatggttttcttccatgtataaaattaggccacctcagtttgccccaactctatatttttggttgtcacttataaaacctttgtatgtggcattgcaagagggccttgaggagtttcttacaagggcagacttaattaacgtttccagctgtgtgcaacttctcaagccccaggcagtgaagaggagcatactaaataggaggccaacctgtctatctccattcaagtttgataacttttttctttttaatatttttttacattttttttctactatgtctaagaattagctcaaggtttaataacccttgatctcagctcaggaaagtgttgaatttgggtaaaaacaaaaagtaatgttgaaacccttcatcacccttccatgattcatttctttttcagacattttccaaattttgggctccagtcgattcttgtgtattacgctgtgagcaagacttgcatgtcgtcacagagaacggggcactatccctgataaagattgtgggagttggcttcctacagcatcgatcacatggctttaacccacgagcaagatggctgaagctgaagaatgggctggatcacaaaaatagattttctgtctgaggtttaatatgctttctttctttctttctttctttctttttttttctgaagactgagtctagctctgtcacccaggctggagtgcagtggcactatctcagctcactgcaacctccacctctgggttcaagtgattctcctgcctcagcctcccgaatagctgggattacaggcacctgccaccatgcccagctaattgttgtatttttagtagagacggggtttcactgtgttggccaggctggtctcaaactcccgacctcgtgatccacctgccttggcctcccaaagtgctgggattacaagcttcagccaccgtgcccggccatttaatacactttcatcattatactcagtttccagaagggcttcttggagttaaggaacatgggtttggaaatcaagagatgggtttgaggcctgatgtaatggtgatttgagtgtgattttgaataagccattttttccattaaggatctccattttgtctttggtaaatcaagaacagtgcaacacaccagacttactgctactgagtcatttagttaccgctgcagagcaaaccgtccccaaaatcaggggctttacacaactatttcttgttagagttcacgcaattgcaggtcagctgaggtctcttgttagatttggcttggctggggtagctatgtgagacaactccgattcgtctctcattaatctcctggaaccaatgggctagcctgagaaatgtccttctcctggtggtagctaaaacataagatcacaacagaaacacaagacagctcttgaggtctaggcacagatcaggcatatattcactctggtcttattctattggccaatgtgagttacatcgttcaaatcagagtcactgcaagggcacaaggcaaaggacatatgtcccagcatgcataccaggaggggtggagaattggagccacccctaatgtacaacatttaggacaacagttaaaatacaaaagtactttgcaatcaaatttcaaagaagttcagttaatcaaatttatgtactcatcttttacctaaagtttcagcatttgtaaagtctctaactgttcagatctacactgtttaattagctgttctaattgtttcagaagtacaatattttttcatgacaaccaccaccaccacagaacaccttgcatttacatgaaccaacaaaaatccttgttattagaacaaaaaggttttttttttttttaagtaggccgatacaagatggtcaaaggatatacaaagacaatgtttgcattttctttgtctgttagtaaattacctggctgacccctgcttctgaagaaacagcacttttcttattctgtccacatttgaagagaggagatcattgatacttacttgcccactctaatcacaaatgcgataggtctaattctctccactttgggatccctgcatcattccggagacaggcactgtacctggaccggcatggttaaacatcactcagacatcagtgcaccctcccatagcttttatctctgagctgagctctctgtgcacaaagtgcttgtgaaaggacagaatgtcaaagacaggaacaggttgtgcatttctaaagatagctggagagagtttaagcagcatgtatatttctatccttattcacagcttgtgtatcaagcttcatagttagttataagcattttattttaattaaagagacaaacaatgacccagtgagagaatttctttattttgaattttgtattttcttcctgctctctcagcctgccattctgacggtggagaaatggatatgggcagttcagccacctcacaccatcacactctcttttgagagcggtcttggaaaccagccagattgcattgttgtccttctgtcaattacaagtgtgccagacacccaaagcattggggaggaagtgcaattattagaagctacccaagagactatcccaatgtcatccctgacttgccaggtgacctttagaaaatcaaatgtgtaaaagagggatgataaattgttctctaggccaatcatgcaaatgagtagaaacaccaaaggagaaaaaagttagggaaaggagaattccaaagaaaccaatttttgttcatggaagaactgtcttctaatacaaagagaaccattcccaaataatgggtaaaatccttcccccagatattggtcataatttaccaacctactcctgttcatgtctgttaatcccaaatgccttcttcctgccaaaacccatgtatctaacacctattttttcatttttggtgaagcgttaatggttttataaaataacttctaagattctttaccccaatgccagaaaagcctttattttcccttggacatagggctgtggggatgagagtgagaacataaatgggaaagcagaaaaatctatttatttattattcatgtgtctatggatatagcaactctattggcctggttgtggtctgacactgaagggattatattttcagagcaaatattaaagggagaaattattcttagtcatcaaaggattggccttctaagaatgtgtcccagtaagaaatactttgagctacataaagagttgggtaaaaagaaagccatcatgaattgaacaccaactatacacccaccactttctttgacatcttatatatgtatcatttagtgagaaacaaaattacttagaagttaaaatcaaatgcaaaatgaaagtcactggctaaaattctctaccatggacagagccaatctgggcctccttgtatattgttcttgaaggaccttggataagttaaaattaaatgaaatattggacattatcaacaaggcattctcttagaatgatatgtgtcttgcatgttgccagattgtgatgataattttatatgtcaacttaactaagaaaaggaatgcccagatagctgataaaatgttatttttgggtgtgtgtgtgagggtgtttccagagaagatcagtattttactcagtagactgagtaaacacagttctccctcaccaatgtgggcagccatcatcttatccatcgagggtccaaatggaacaaaaaggtagaggaagggccaattatttctctctcttcttgagttgggatagccatgttctcctgcccttggacatcagagcccctggttcttgggcctttgaactcagagactcaccccagagctgcctctcatccatcccctactgctcctccctggttctcaggcttttggccttggacaggcagttacaccattagctcccttaactctcaaacctttggactttggctgaattacactattggctttcctggttttccagcatagagacagcatatcttaaaatttcctggactccataaccgttgtgagccaattctcataataaatctcctcttatatttctgttatcccattggttacgtttccctgaagaacactgattaatatactgaccttcactctttacatttgtatactaaaatattgtaactcaattttgaagctaaccacctggagttagtgttagactccccatagattaaaagacacgatccccaacgagactgccctcacttcagatgtgaacagcaagttagagggtccccaggctacctgtacttttgatcaactggctacaaaactgggatgttcccatgtcccctcccccagctttaatactatttaatactttaatgctagaatgactcacagtattcaggaaggtgtcataattacagttttattttaaaggatacaatgtaggactagctagagggagagacacatagatgaggtcttcgagtgtcaaatattcagaacttctatgcacttttctcatgggatcagagcacatcacccactcaggacgtcagtgtgttcatcagccatgaagttccagtaagctttggtgtccagggtttttactgggttttcattacataggcaagtggattgaaccaaatctctagccacttctagcttcccaagctcaaagcctctctaatcacatggttgcctttttttggtaaccagtccctaacctgaatcatctgctttgcataaactcaagtgtgatccaaggcacacatgaataacaaagaaactcctatcacttgggaaatttcaaggattcagagtctcgccttcaggaaccaggggcaaaggccagccatattcttcttatatgatgtatacttaaatttacatatatgcataaatgtatgtgtatcaattatatatgtattatattgtgatatatacactatatataatatataaatgcatgtatatataaatgtatatgtacaaataaacataaagccatctaatgtccatgtgtttttgtatctccttcatgtacctatacagcagtcccctctttcctgcaatggttatgtgctaagacccccagagggtgcctaaaactggatatagtattaaacactgtatatactggatacagtattaaacactgtataaactggatacagtattaaacactgtatatactggatacagtattaaacactgtatatactggatacagtattaaacactgtataaaatggatatagtattaaacactgtataaactggatatagtattaaacactgtataaactggatatagtattaaacactgtatatactggatatagtattaaacactgtataaaatggatatagtattaaacactgtatatactggatatagtattaaacactgtataaactggatatagtattaaacactgtataaactggatatagtattaaacactgtatatactggatatagtattaaacactgtataaaatggatatagtattaaacactgtatatactggatatagtattaaacactgtataaactggatatagtattaaacactgtataaactggatatagtattaaacactgtatatactggatatagtattaaacactgtataaaatggatatagtattaaacactgtataaactggatatagtattaaacactgtataaactggatacagtattaaacactgtatatactggatacagtattaaacactgtataaactggatacagtattaaacactgtataaactggatatagtattaaacactgtatatactggatatagtattaaacactgtatatactggatatagtattaaacactgtatatactggatatagtattaaacactgtatatactggatatagtattaaacactgtatatactggatatagtattaaacactgtataaactggatatagtattaaacactgtatatactggatatagtattaaacactgtatatactggatatagtattaaacactgtataaaatggatatagtattaaacactgtataaactggatatagtattaaacactgtataaactggatacagtattaaacactgtatatactggatacagtattaaacactgtataaactggatacagtattaaacactgtataaactggatatagtattaaacactgtatatactggatatagtattaaacactgtatatactggatatagtattaaacactgtatatactggatatagtattaaacactgtatatactggatatagtattaaacactgtatatactggatatagtattaaacactgtataaactggatatagtattaaacactgtatatactggatatagtattaaacactgtatatactggatatagtattaaacactgtatatactggatatagtattaaacactgtatatactggatatagtattaaacactgtatatactatgcactattttttcttcttctttatattttcttggatagattttttcttcacatacatcttagcaactgtagcatacgattttttttcttgtcaagaatttttacctttttactttaaggaagcactttaaggattctatttggcatattcaaattgacagcattacaactcttgcactttggggccattattaagtcaaataagagttacttgaacacaagcactgtgataatgagacagtcagtctgataactgacacagctactaactctccagtgtcaggtagagtatacagtggggatgtgctggacaaagggaggattcaaatcccaggcagaaggacctggatggttggagatttcatcatgctactcaaaatggcacacaatttaaatcttttaaatagtttatatttgaaattttctatttaatatttttagaccatggctgactgcaggtaactgaaactgcagaaagtgaaactatgaataaggggacactactgtatataaaacttgaccctagtaataaattatcaggaagaataaaaaagaaagcagtgaagttatcaaagaagaaacaagcctaatcaacaaacacaaatagtactacaatttttccatcagctggaacaaatgctaggcagtgtttcaacagtcccactccatccaaattcagttatttgctagaaggacccagaatacccaaaagcagtttgttctcatggctaaagtttattataacaaattatacggagtaacaatggtagggaaaacatatgcatcaggcagattccatagatgttgggaataggtttagagtccttcttcatctcaggccacacagaacaggctttttctccaacagccatgggaagattccctggaatgtctctgcccagggaagcccagtgaagtgtcagggcctgaaatgttcacggaggctggtcacattagtacactcttctgtgccaccagagagggcgactgaaactcaggactccaataataaaatcaggttcatgtcatcaattttgatgtttgtgcaaagcaattctgtcgagttagtatggcatggtctattgcttcagatatatacagcaaaatcataaatcattaacataaagaatcttccacatactatcttcccagggttttgccatggttaattatggttctaggttccaatggcgacatgcaaggagcaagctaccagattttctgtgttaactcctcagaaagaattaacactattgcaacctatgaactcctgaaatgcgtagacagcatgaaagccctaaaattctaagcaggtgagatcgaaaatctagctggatttgaacaagatagggaccaatatatgaaggtaagtgtctcacatcattaataagagaaactggaataaattagcctctaaagaagacatgaagaaaaatcaacccatgatctcctcttagttgatgaattacacacagtttcaaccaatgcaataaattcttttgctcttgttattctgaaggattgtatagcaagctctcttgctacctcgctttaaaaactccggtggtctccattacaccttgattactggcaatccaatgctgcataattttccttcagcctctccctctaacattttttagtgtccctgttaccctcactgactacatcctgcctcactaccttctctcagcttcccacacatgccaagcttgtttcccaccgaggtgcccacgggataactcttctctttgcccttctttatggccttttcttggttggcctctccttatctcaaagatttcaactaaaataccacttctgagaaatcttctctaataactcagtcaaaagtagccccatttctaaagctttctctatcattttacccagttttatttacttttgtgcctgaaagtcacctaacacttcctcactttacatatgtctatttatttatttatttatttatttattttatgactaaaatgtaagctctctgtgagcagatactttgtctaagctgcttcccactttaattcctattgccagcatttggctcagaataggtgttctgtaaatatatgttgaaataacaaattaagagtcctgtaaagtctgattttaaagttgattgtaaggtctctagcccagggctactgagagcattttagtccatgtatcagacttatcccataatctgagtgattccaagtgtcataatgagataattgaatcgatgtggctcaacaagtggtccacagaacaattgaattagaattacatgttgtctggataaaaatggaattatacgaattgttcttcctgaaatttttatttagtaccttaaactgcagctcagaagtttgcattttaatgtgtttttcagtgattcttaagttcactaaaacagaagctctgactaaaatcacagtgatgattgtctataggggcagtggcacagtaagtaaactgcctaggatgcataacatctaaatatatgacagtttttggttatggcaatcaaaataacaaacagaaggagattcttcaaaaataagtttattcaggaacgagcattgcaataggaatacgcatgggtgttttcagggaggcaaaagaagataaggatttttaaaggtaaaatgatgagggccacataagtgtttctgaaatagttatccctggctacaagcatgaataaccaggattgcctcagtctaaggcaggacaggcagttgctgggcagatgtccttgcagaagtattttttatgtcggtttgcagtggccttgtgcacagtcgtggttttggcagaatctttcatgatagctcttgttatcaggcaatcatgtgtgagaaccctcccttcatggccttcttagacaccattttgtcaggatttgacccaagtgactccattttaattctgacaagtttcacagctctgagcgagaatgaccatgaagcggatcttttttttttttttttaaagtattacttgatttttgaaggtcatagggcgcagtgtagtcctgcctctgactcttactagatgtgaaaagttgaatttttaagcattctaaattccaatttcatcttctgtgtagcaagagtagaaatatctaacttgcagcatactattttttaattttttttaacttttaagtgcaggggtacatatacagctttgttacataggtaaatttgtgccacaggggtttgttgtgcagattattttgtcacccagatattaagccaagtatttattggttatctttcctgatcctctccctccttgtacctaggcctcagtgtgtgttgttctcctcaatgtgcccatgtgttctcatcatttagttcccatttataagcgtgaacatgcggtatttggtattctgtttctgtgttagttaggataatggcctccagctccattcatgttcctgcaaaggacatgatcttgttcttttttatggatgcatagtattccatggtgtgtatgtaccaaattttctttctccagtctactattcgtggtcatttaggttgattctgtgtctttgctattgtgaatagtgctacaatgaacatacatatgcatgtgtctttatgatggaataatttatattcctttggatatatagccagtattgggattactgggttgaatggtagttctgcttttagctctttgaggaattgccatattgttttccacaaaggttgaactaatttatactcttgccaacagtgtataagaattctttttttctttgcaacctcaccagcatctgttatattttgactttttaataatagccattctgactggtgtgagatggtatctcattgtggttttgatttgtatttctctaatgatcagtgatgttgagcttttttcatatgcttgttggccacatgtatgttgtcttttgaaaagtgtctgttcatgtcctttgcccactttttaatgtaatagtttgtttttttcttgtaaatttgttaagctccttatagatgctggatattagaactttggcagatgcatagtttacttgcagcatattttaaaagataaatgagataatgcaaaagacttagcacaatgcctaataaaaagtagcttgtggaatggtaattttaaaatgacaaggttttgttagtatgatttcaagtgggcagaaaccaaagaccttctaaataggcttactaagtagacagaaagctcaggggaaatgatacaaataaagacagaagctctcccattgcttgcaaaacacacgtgagggcttttatactgagggcaacataactattcagacttcttatctggctgtctttcttattagactttcttatgttactttattcttattatttatgaatactaacatcatttgggtcaaaaaccacacctttgtggtgtccatttcatagtacttatcacattgtactgcagaatctttcaccctcactaaacatcctaaggtagagaagttgtccatttgtgtttatatctacagcatgtgttacagtgtttgacacatactagatatacactacaaatttgttaaatgaagaatgaataatgctcaaagaaacatttggtctggactgtcttctgatctgactggggactccactagaaagccatgttcttgagaaattagtaatgatagcctttctttttcattttaggaggtttcatcctctcaggattaaactccttccaaattaagaataatgacttaaacccatgataagaacttaatgtaagtcacttttctctaccctagaagtaaatacttttaaattcagaaatccaccaggcatttttccatgcactgatgagtgccatgatagtaaattaaatagcagaaatagctgccttcatggatctatcattttagaaacaaaagaaaggacattgtgttcttagaaccagctcatctttctttctgcctcattccctacctctctctctatctttatagtagttgaaaatgccaaaatgtaggattacattttgtcctttagacattctcaacatttgaaacttgtatgtaagaaacaagtgaagaaatgatcattaaaagaagagagaaaatattgagtaacctttgtttaaatttccacaaagcctcaggtttcattgcaatataaaagccactgaagtaatgcttgtttgatttgcttagcaggagcacaacacgaaaattccttgagcagggaagacagctggtttgccaaatctgcacatttggctgtacaactggctctattggtagcttcaggctagcaatattttttactgacaatttacatgctgctccagcccaaggtatctgaaatgaagtctttgcataaacacagttagaaaagaacttggctcccaaccctggtcagaactctgctttaaaaaaggaattcacactgatccatggtaatgtgataaggttgagccttttcagcagagatttgctatgcaaggccccttgttttatatggcattatgtaaaacataatgtcaataatccatattgtctgtcttaataccattattcacataacagtattgtgcctacctcagccgctttgtaatccgggaaccccacacgcacattaaaacagagataactgtggaggaacacggttgcatacaagttgtgttgttctggcagggagttactcctctgctcctctcagaaaaagcattttaattccttgggatttttttttaagattaaataacatcattttctgggatctccaaatttccagctgcttataaggctgatttcatcaaactaattaaaatttctttgtggctaatcactttagggcttagttaacttctggagaatacatgaatataattgtaattttatctgattttactctaacatggaattaaataagcatattttaaaccatatataagaatggtatatgctgtcttagggcttgcattccattttgttgaacaattgattatccatattatccttaggtcccagggtacaatgtgtaaatacatcacagcaagatataaagtgaactagaaaaataattgaattacatagaaattctctagggtggtagcaatctattatatccattaaaattcagagattgttaaagcaatccgaattatcaaaactatctttaaattgggagaatagcaaattgttttgggggaggttctgataccaaagattttatcatttataaaaacttggaacaatcacagacctaaataaaaattagaagtacagtaacagaactttctcctgaaccatttgagggtaaattgccaaccaaatgccatgttaccacctagtagcctataaacaaagacattccctccatcacctcagcacacccatcagagtcaggaaattagaactgaaaaattactgccatctagtcctcagatctcattcaagtttcatcaattgtctcaatattgccctttatagctaaaggatccaattcagaatcacaagctgcatttagctgtgatgtgtctttaatatcattgagtttgaccttgacacttttgaagatcacagcctggttatttttaaaaccatccttcaatctgagttcatgcaatggtgcttcatggttagatttagatgatgtgtctttagaaagagtatcactgaagtgatgctgtgttcttctcattgaatcctgacatacgttgtgatttccatgggtttatttctatttgttcattttggccacttgatttagttggtgccttccaattttccccaatgtaaagttactttttccccttataattaatatttattttattgggagatacttaaaattgtataaatagctcattcttcataaaactttcaatgaattcttttacttacatttgcatggactcatgtttcctgttttatccaattgtttaaaatctattgctatgctcatttattttcatgctatatggtctcagatttggccaatgagaattccttctgtctggcttctttaccctcttgaccatgttttttttagtgctttcatattttctggcataatgagatgttttaggattactttgcactttccctttctcagccatggatttaaccatttcttcatggagctccagaatgatatttggaagccaagatctgtgtgctaaatgtgcttattggtattggagtgttcccatttgcaggcccttgagtgaaaacagctatgcaatacacgaatgcatacacaaaatacattcatgtttttatctacatttattcgcatctctgtcacatatacattgaaaaacatgagttcacagcaatacctgtaatttcaatccaacatcctagagttccatctagtttttcccctttccatatttgtatatccatgtctctgatagtgagaaaactatatcccattatttttaattgatttgcttatttgatcaatccctctgcatctaatatcctgcctttgctgttaccttctctccaacatgaatgccctccatgccctactctgacgccatgattggtgtccctgtatgtgaacatggtcatcaccctagttggccctactatctccatcagaccacccttctgcactgatggccttctgaacccagccaggcttcaacattccctgcagaatttcctgctacatagacatcctggggcaccttcactagaaaaatgtggctccctcccattactgccacagatgtttactttgttttattctacataaggattaagattaaattgatatacaggaaaagaaacaggaaaggagggacaagggaaggggagggaaagggagaatgaatgaggaagggctaagacatcctttcaaatccaatttatcccaatatattattatatattggcaatatacaacagaatgtcataatgcactcacatttaaacatgatcatgtgtaaaatttctataaccttggatgctcccatatgtccctaaaaaagatcaaatacgtgtttttcttgagcttgtaacattaatgagtatttaacttactcacattgcttttattttgccagctcagtgtcaagaattcatttagatggcagacatcaatgtgcactttaacactaaaccatgaaaatatatactcactagagtaagtccaagccattattcagagacattttaattcccatagttcatgttgatatctatctcaaaaatatcaggaaacaagtcttcatttttgcaacattggtttgttgtcataggtaaaaaataataattaagagcaaacagatactgccataatttaaagtaatatgatttattttcaatggacactagcatgttataaagcaatttacaacatcaaacaaagccataatgtttcagaatgggtcatttagcatattatattatggcactttacttattatagctttgaaactattatgaaattttctcagccagcacttttttctttgcaagaatccttgtttttttaatgttgttcttttttttttttttgcatttccagtgaattgaatctgtttcaatatttaatcactgtctgagtttagcaggtataaaagatttatggttttatctcattattaatatatttacatagcgcttttttctttattagtgcctaggctgaataaataataataataataaaataggtaagaaaaggagaggtgtcattttctgtttaattctcctagattgttgaatgagatttttggatgaaacatacatcaattttagaatataattagatttgaatgtgattagtgccaacttcatgctgtctaaaaaagagtttatttaatcaattataactgtttcttacgaagtcaagttcttgatttgtgatttcattttattgtgttcggagacccttgctaaatatgtcattaggagacaaaagctcaaatccctcggccttcttactacagtaatgtttcattttaatttaaattcaactcataaaacatctctgtccttttataaacaaggtgaaaagataagttcaattcagcctactgaaagcatgttcctagaattaaaatactggcaaagtattttagtcttcctctcaacacatctggcaagttttttagtttagttttgttttgttttattttgtttttttgagatggagttgcccaggctggagtgcagtggcacgatctcagctcactgcaacctctgcctccttggttcaagctgattctcctgcctcagcctccctaggagcaggactacaggcacatgccaccacgcccagctattttttgtattttttagtagagactgggtttggacatgttcgtcaggctggtattgaacacctgacctcaagtgaccctcccgcctcagcctcccaaagtgctgggattgtaggcatgagccactgtgcccggccatatctggtaagtttgaaaaaaaaaacccagtcacggagcccattcagttacctctggccctctgctgtccccatcacagctacttggaatacttgggttactttttgattcataagcgatatctcatcatagtcccgaattaaccagctgttactgatggaggcttaaaatcacgtttagcaaacctctacctttctcaacaatcattgaaacagctgtctccaaatctgcatacatatcccctatatacttcgtggttattgttccattttgaagggttgtcattttaaaactaaaaactaaaagacattttttttctctaattctttgccccccaaatcttctaaacgtgtgtaaaacattttagccataccacagacttcatttggtatttgtattgtggctggtattagtgcacaagaaatgaaatactatctgagaaagtgttttgtaaaacataggactttgctactctttagaaatgggtgaggatttgaggtgagtgagattgtggtattcatgcagttggtagactcaaatcatgctggctccctgctgaggaatcctgggtcctgattcagctaggttgcccagctactttccctcttctcacttcaatgttctctcaggacccgaggagaaactgaaccttatttccaatctttcttgtctcttccaccagatgcttgcttaaattcaccaacactatgacctattttctcgggaccttctttcctaaagctacagtagagtattccctgatgttgtattaaaggatgctaacaagtgaatggatgcaactgtattaatggggtcagatgcaaagagacaccaccttaaatgacataagggaccctaatagtggccgtttcaggccaggtagaccaacacttggaagacaacatacttctgaaagactcaactttgctgccaataatgaaagccagtccaaataggaaagatctttctacacaaaaactaatagtgttcttgttcaacagaacacagttgtgtgcccagctgagtcaggagagccagaacgcctaggttcgactcctgacttcgaaaaaactctttcgctcttctgtgcctcaacctcctcatctgagaaatggagaatcaataaattagacgtgtaaggacaatgtcagaagctattatttttaatggcagaataacgtatttgttttaaaaaagggtgggggacgggattaggacaagacccaatacacaaatcctggccatctacgacaattggtgaggtgttggcaaggttgcttttctcctcagcgccctagcatttttcatgtgtaaaactggaactatcatgatacctccttcatagggttactagaagattaaggaaatacatataagaatatcatcatctgtcccatagtaagagcatgacaaacattagctgtcacaatagaaacacctgaattcaaatagtattattgtactttattaatcaaggtacccaaatctatataaggtagagaataacaataaatatttctactgaatgcattacactatttcttttagcccctgctttttacttgctttttgaacaaagtaaaaataaatcaagtaaataactctctttttaatataaaaggcattacaccaagagcaatatggataaggaaaaaaacaggtgaattcattcaaaatgcattaacttcagaattggttctgaaagggctaattgtaaaagtctctttttacatgtgttgtgttcacaggtggtaaacactgcactaataaaaaaggaccccgtgcgaagcaccgtggatgccttgccagaacgagtttgtgtggccatactaacagctgaagcattaagttctcatatcgggttagaaagcaacttttctcccaattaaggagccaaagaatatttctgtttcctgaaagtaaattatgacccataaattaggaatttcaatgaaatatttaccattgacatgaacaaaaatttattttatttttattttaaattcattttagtggtagactggaacacgaaagacagacactcgtgatttgaaggcttccgttcgcagtgtatacattacatttgctgctggactcaggacaataaaaataatttcctgttgctgctgctggtactctactacaactattcatatttcttccacctagtattgattaatcttttatgatggactagctaggcactttacatgtattaacacatttgattatcacaacaaccctatcatggagactctattattaatctcattttaaagataaaaagactaaaggaccaaaacattgaataccttttccaaaggcctccagaagaaaacatcagatagtctgactcaagagtattcttatgctgtaccacatctctatattaaacttgaggcattctgaaaaaaattgaatattgttcctattgaattttttttctctcttattccttctaactggacaagaacctatactttcaagtgttgtatgtgtgtatgtgtgtgtgtaaaatttatagctcgagacaatgatgtctattttctatttaatggtatgtgaaatcagctggctgtcttgatctagtagccgagacacaggtgctcatattacaaaataaatagtggcaaaaattgaatggacatttacggtagcaggcactgggaagagagaaagaaaggtgaagacactgtaaattgaatgacttcaccttagcagaggtctctgttgtctggcatcatgagttcatggaataagtctgctcttgcttgctagaaggttgtctctatctttcttaatgaatgacttgatagatttcttaatgaatgacttgatagttgtacaaaacgtgcaaaaatttgtcctcgtctcaaaaacaaaaagaatggcaagatagagatggaggatgagatagcatcttttggaaactatcagcacctaattagtcctgaacaaaggtagttgtgaggtccaaaccctcttgtgccctgtttttctacaccctcatggtaattggtatgactttcacaaattacagaaaaagacacccatttgacaagggaactgaaggtggtgaagacatactggcaggctacagcatttcaacccaggggttaattctgaaactctctcaccatcaatgtaaaatttttcatctatgaattcccacgtacaaagaaaaggaaagggaaaggaaacagccttcttagccagggcaatttattagcattgctcaggtccgtgcaagaatgtaaactaggacttttgtgaaacgtcttgtaatatattcaaatcagttcttccaaatcctcatgttctttttgagctgatttagttgcacttcgctcctgggaaaacccaggaagagggtttgtgaactgcatacatctgtaatccaaatgatagcaatttactgcgaaatgtttgacaaatattggcaggctgattatttaccaaagctattcctgcttttggataaaaaggggacaatttattgattaaattgggagataaagacttcattacactgctattattaaaatctgagaaaccacctgtttcttgcatcttaatctcatccaagattcttgttaagagtaaaaagaaattgtaatcaagctgccacaaaggggaaatgaatcgttctatatgtgctcactctgtaagttatgaattttgttaattcatgatagctaattacatacatacatgcaaaagtttcttagttataaaactctgtatgtaatttccaaaagccaccattgcctctattttcaatccattctcactaaatggtattataatagctagtacatgttaagtacacaggacatgccatgaaaaagcttgacagaaattaattgatttaatcctccaaacagctccatttaaagagtaatattattacctccacttttacaaaggataagactgaggtacagggtagttaagaaacttgtccaaggtcacacagaagtaattaccagaagggaggctgggactccaagctttcattctgaactttagcaaaatgggttaggctctcaacaaatatttaaaatgagctcaactactattttctaaatgtggaatgacaattatgaaattcattactttggaccccatttagacctcctctgtaaacataactcgtttttttaaaaaaattcatataactatattttcatccggttattgcctatacaatgacttctcaaagacatagcagaaaaaacagctgaattttataagaatgtttaagtttcacaaatgtgtaggaatagcagagggtcgatatttagacagccattctcactcctttttttcctaaatagttacttcttaagtagacgttggtctcttttaagctaacaactagaatgattcaagaaaaatgctagtgaagcactatcaggaatttcttaatgataccatatcatactaggaaggtaattcagaaatgagctgccttcattgtccatcatgccccacttaatccctaacatttttgacagaagtatttagccaatgtgaacacttcctcgtagtatggcccattccttctttgaacagttttaattattttaagatatctcttacatgaaaccaagtactgctttcttcaaaccccacatattcttctctttctttagtgtgtgtgggactggtgaccactaacccaaagaatccagcaaaggtgatgagatgtttcttctgtggctatgctatataggattgcaaaatctgtcttgctgggagacaggctcccttactggcattaaagaagcaagctgccatgttgtgagatgtcctgcagaggggacagcatggtggcctttagtcaatagcccacaagagactaaggtcctctgtccaacaggctgcaaggaactgaattttgtcaacaaacacatgagcttggaagcagatccttcccctttgaaatctaagactcccattttggctaacaatttcattgcagcctgtgaaagatcatgacatagaagatgcagttaagctgtccctggattcccgaacgacagaaactgtgagacaataaatgagtgctgtttttagtatctaaatttgtgatgattttgttaggcagcaatagataactaaaaactacgtatcacagtttgaatgctaattctccttaagaggcttcattaaaaataataaaattctattattagttgtatcacaacaacaatagaggcagccctttattgagtatctactatgtgccagacactctcacttcactagattctttccccctccttccacccccttttctttttttaaagtttcgggattcatgtgcaggatatgcaggtttgttatatgggtaaacttgtgccatggtggcttgctgcacctatcaacccatcaccgaggtgttaagcttggcatgcattagctagttttcctgatgctctcccccacccacccgcccccaacagaccccagagtgtgttgttcccctccctgtgtccgtgtgttctcatttttcagctcccacttataagtgagaacatggggtgtttggttttctgttcctgtgtttgtttgctgagtataatggcttccagctctatctatgtccctgcaaaggacaagatctcattcctttttatggctgcataatattccattgtgtatatgtaccacattttctttatccagtctatcactgatgggcatttcggttgattccatgtcattgctattgtgaatggtgctgcagtgaacatatgcttgcatgtatctttataacagaatgatttatattcctttggttgtatgcccagtaatgggattgctggattgaatggtatttctgtctttaggtttttgaggagtcaccacactgtcttccacaatggttgaactaattcacattctgacacaacagtgtaaaagtgttcctttttctctgcaacctcgccagcatctgttgttttctgactttttaataattgccattgtgactggcgacttcactagattctatacacaaatcatctcatttgttttcataagaaccttaaagaaaaggcattattagtatttctagtttaagaaactgatggtcagagaacacaagtaactcaaggtcatacgactagagtgtaaggaaactgcaattaaagccaagccttttcactgtgccttgctgctgcctaattcattggttgaaataaaccaaaacaaaaataaaaatttggatttaattttttaaaaaccaggactgggcccagtggcgtacatctgtaatcccagtgttttgggaggctgaggaaggtggatcgcctgagctcaggagggcgaagtgacagtgagccatgatggcaacaccaccctccagcctcagtgacagagtaagaccttttctctcaaaaacagcaacagcagttattaatatttaatgttattaaagtgtttctctttggcaaacatggttctaggcctcagacagccattggcatatcacagtcacgggatggcacatcatatatttggatttggatggtttacctctcattagtaccatcccacccctatgcctcaccacgtcttatctgcagtagactcaactttcccagtacttcaaccactttcaccatttcatgtagaatgttttcttttctactttttttttctttattgggggaggggatggggtttactttgtcacccagcttggagtgcagtggtgccatcactgctcactgcagccttaacctcccaggctcaagcaatcctcttgcctcagcctcagctgggtctacaggcatgcacctggctacttaaaaaaaaaaaaaggtaggctggtcttgaactactggcctcaagcatttctcccaccttggcctcccaaagtactgggattacaggcatgaaccaccacaatcagtctacgatgttttcttgaattgcttttgctttcattttggcttcttctcagtatttctgtaacttttactttttatatctctttaacaatgtggtatcttaaccaaaacataaaattgaaatactatatgcaaaactgataaaaataaaagaacttgataatattggctgggcatggtggctcacccctgtaatcccagctactcaggaggctgaggcaggagagtcacttgaacccgggaggcggagattgcagtgagccgagattgcgccaccgcactccagcctaggtgacagagtgagactccatctaaacaaaaaacaaaacagaacaaacaaacccccccccccaaaaaaaagaacttgtcaatatcacaatgaatattattttccttttagaaactgacatatctaattgacaatataactgagtgaggaaagtgaatatgaataataggattaatatgcttcatacaactaatatgtataacttaattgtttttaactctaaaaagcaataaataatatattctaaaacacattttaaactgacaaaaggtgatctttattaggacaaaaataaaaatctcaatatagtctccaaaagagaaatgatatagacttaaaattgaataaagtggtaataaagttagacaattaaaaactgaagaatcatcaaatatcatgccttgaaagattataataaacacacacttctaaataagtcttgaaaaaatgaaacacatttatatgtgtgtgtgtgtgtttatataaacgaagtttctaattatttggaaatgtaaagtattaagagcactacaacaccccttgtagaaagaagccaaggttgcatcaagaaaaacatttataatgttaagagcaaacacagataagagaaaaaatttaaaaataacataagtataaagtaactttagaaaggtaggagtgcaacaaaagaaaatgaaccgagtgggtgcattaataaaggtaaaagtgtagattaatcacactatataaaatggaatgcccccacaagaatatgagacaccatctgccatcgataaggacaaagtatgtcccttcagggtctaaatttgctggagcctttggtcacatttttgttagatcccaggatattgttgttctatatgttgtaaacagaaacaaccatagtgaatcttcaattggtatttttttttgtcgtattttaacaccaacatacggggaaagcttagaaacaagtgtcctgtctgttaatgaattttaaacctcagggatttcagttgttaaagaccttcctttattatcagccatgaaaattagtattcagaaagaattttgaaaaccaattattcttaagtttgataatcatgaattgggggatgaatttttaacaatcattgtcccaaagatattaccacaaatacattggtgctattaaatacttttatgtatctatttcccttctcaaaaggccttcctttaagccacttttcctacagagacatttcactttaacatgaaagtcatagtgtgtctcctctagaatattcgcagatgattgtcttcatttatcaggaacacatatttaaacagtttgcactatttcagttttccttgtgaagcagaagtattcatcataccagttgaggcttatattaccctgtagcaaagcgatttatcatatccctacatcagcaacttctttgattattaaaattctcttgcagaggtacacttagttgcacacaagctgctgtctaatgaattttctttattatttgacctgaagttcagggaatctgcatattaagacatattattcaaaagcagtgatagagcatgcagaaccagattaattaaactcatagctggaaatactttagcagaatttaatacttggcatatgtaagcgaacaaccctcaggaaataccagtgtgaatcattttttctcctttagaaacaatttttatttcctaaatttggtctgctataaaatggtaatttgtgaagctccagaattattggttcaattttgaatagtaattataactaagggtatgtgtaattgactcaagttactaatgaccacccttttcctaattattcaatattatttcagttaatatttattaagcattcttttgtcagcctgacactgtgctggtttctttcagagatgtcaaagaggtttacacatttcttctggcttcaaggagtttgtaatctaactggagagggaagactcatccattgaaactatatgggcatctaatttctcctccatgtgatatctctaatagccagccaggtttagatttattatccaaaaaacatgatttcaggtttccaaaggtagccaaaaggatcacacctcaatgttcaattcttttcaagcttctgcttgcatcatggtggctaacaacctattggacaagacaagtgacacagtcatgcccagatttgaggggtagagaaataaactgcacctcttgatgatggaatggcaaaaggtcctgcataaagagataatgtatccatctttgagagcctcccattacaattaaaccagaatttctggagtggaataaggacagagaattttttaaaaagcattttaggtgactccagtatgtaaccaatttgagggccagctgttttgaccagttcttctcaaactctggtgtgcatcagaatcacctggtaatcttgttaaactacagatttgtgaacccatccccagggacactgattcaacatctgtggagttagggactgacactttgcagcgctaacaagctcccaggtgatgctgatgctacaggtgctttatctacattttgattagcattaatttaaaccacggtgcaaagttaattatatgtatgatatgtaataagtttctattcatttggctgagttcctgtgaacagtttgtcaattttacaagttggaaaagttaaatctcccacatcatacacagggaccaatcttatcatatgaccaggaaaatggggagaagtccttcatcagcagttcaaagttaagtatttgagcatcataggacacttgatactgtccctgcattaatctcctgccttgtttcttgtaactcacttcctgggctcccgctatgcatcttttttcatcctactactgcactatggctgttttattcttggtacacccgatccatccctctgttcccaaatgggaattgagatcttgccttgttctccacactgatttaaagaactaagccttcccagcagctttctgccactagattttatacatccaacctgccaacttcatattgtatttgccttctggttttttctctttgtgctggttgttttcctttggctctccccagacccacactcctgccttgtctgctctattcctgcctcagaggttgatctcttatataatatattgcatcactggggatttcttgctgcctggtttcctgtacacaagtggttctcagagtaaagttcctggaccaccagcagcattaccatcacttggaaacttttttcattagaactgcaaattttgctggacatggtggcttatgcttgtaatcctagcactttgagaggctgaagcaggagaattgcttgaggccaggagttcaagaccagcctgggcaacatagcaagatccccatctctacaaaaaaaaaaaaaaaggaaaagaaaaaaaagaaaattaaatagaactaaaaattttggggcaccacgtcaaggctagtaaatcagaaactctgtaggtgaggcccagcaatctatatttcaaccagtctttctgaggactctgatgcatgctaaagtttgaaaaccactgacataggatatagctgatgccagtcactggcaggtctatgtacagacagagagagtagaaggtctgtttctccccttgattccttcctgctctgggctgcattttcttacagagtttgcatgcctccacaacttaaagctcttaccaggcagcctttcctccaaaattgcatttcactctggtctccaataatattatttcctcctctccatgcttcaagcttaagagttgtaacagcttcctgccattgctatggtctaggcctcaacatccgtttttgttttctttaacttacgtacatatcagtaaatattctcattcttaatgtctcctaaacttttgattacattctgtttcctgctggcaccctcaggtactgctgcccgtgaatttccttttcctagccttctttatcctgagtcctctcacccaagatctagctcagatcatgatgattaataaagttgggataaatgttacttacataaaggtgtggtttcttataaaggcaatcttgagagcatgaaagcattacagttcatgaagccaggaaaacagagcccttcctagagttcctaaaatctcattgcacaggcagcctgtcagtgagtacacacacatgctatgatacacatgtactgtgtgtgtgtgatgtatgtgttgtgtataagtgtgcataagggaaaaaatgagcatcaagattttccggcaaaataagtaacgaaaccctgttaatctcctggcagctgcttcagatgtcagaatacatttgtcaaaaaaacaatagaatctggtttgaacagctcttctgtttgggaaaaaaaagaaaaagtgaaacttagcaagaatgtgaactagatcataaacccaactgggtactaatgaagatggtatgcttccaatttcagtggtctttcctggtcaacgatgttgtgcttgtttttgttgttccttttgttttatttttattttttcttttctttttatttaaatgtatttatttacttattttgagacagggtctcactctgtcacctaggcaggagtgcagtggcttaattatggctcactgcagccttgacctcctgggctcaagcaatcctcccacctcagcctcccgagtagctgtgtctgagtagctgagactgtagttagctagcatgcccagctaatttttaattttttgtagagacaggttctcactatgttactcaggctggtcttgaactcctgagctcaagtgatcctcttgccttggcattccaaagtgctgggaaaataggcatgagccactgcatctggccttgtttcatttttaatcttttctgtgtgaaagccctcagtagtggtcagaggtaataaaaaatactcacacagcagataatttcccttgaggcaggccaccagtggcaaaaatgaacttggcaccacatgtaagaaatggtcttaaacacacccaatttaactgtgagcttgactttagcttaggattgaggtaagaaagagctgtagctacacaaagatggtcttctaaactttctacaatcatgccagttgtcgtggctcatgcctgtaatctcagcacgttgggaggccaaggcgggtagatcacttgaactcaggagtttgagaggaacctgggcaaagtggtaaaaccttgactctaccaaaaatacaaaaaattagcacagtggcatgtgcgtgtggttacaactactcaagaggctgagatgagaggatcgcttgagcctgggaagcagaggtggtagtgagctgagacggtgccactacactccagcctgggcgatagagcaagaccgcatctcaaaaaaaatcaataaaatttatataatcaaaactttttttttctgatacacagcaccaatgcttccaaggataaagaccttttctcctaagaatattaaacaaagttgttacgattatgattcccatttcataggtgggaaaaatttgaaggcagacaaggaaagctctagcagcaaacatctagcaggaaatgcagaggaaaggaaattactctcacagtatgtaagggaatcatcttttacagacttgcatatgctttttctgaacaatctgtgtgtttttgtttagttttttaattaaccagggtctttattttagcgttactctacacatgtttcttatgatgatgtatttttaaaatttattttaattgtggtaaaaatcacagaatataaaatgtatcatcttatctgtttttaagtaatgttaaacatattcacactgttgtgcacccaatttccagaactattccaattttcagaaaactgagatcccatatgtgtccccaccatatgtttttaaagcacatatcaaatatcttcttttaaaaaattcatattttatgttcttgaatgtttaactttatcatgtattataaataacctaccagaattaatgcggattttaaataaatatttctctctactaagatgctttttttaaataagtattctttgaactttaactctgtgggactccatgtctacaatggtgagaaaagcagacatatttttcaaatggtggggcaaaatgtgtcatgcagtgaggctaacaacattgaaaataatgatgatgatcacactgactggcacaacactataaataataatcaggacgagcaatgctttagatcccagggttctcaaggggtattatgaaatggtgcctcttaagtccacccctcaaatttataattgaacatatcaaggacagactttgtccgttcattttaatagtatactcacctgctctagagacctggtccctcataacctagccccgatcctcagaatattagggttgccttcagcagatccactttgcaaagctatggagctgaacttctgtctgggaccgggggagtcgaattgtaggagacgttaacttcacacaggcatctaatggagcccaagaatatcaacacaattctcaaatgactctccccatttgctactaaagacctgcagtgcttctcatatcaccatggataatcattacttgcttccccagcccacatatcagccacttattattatttttttaaagacaaaacaacaacaacaaaacctgacctttgagatgtttaagagcgtagatactagagtgagacttccaggtttccattttgactctcatacttgtgtgatcttgtgcaagttatttaatctcagtatcccaatctagactactaattaagctagttcttatatataaagattgtggaataatttctgggtcactgtgtaggtcttgtaaacactacataagtattttctactagaggctcagggatttggtgaaccccataccaagttatagtcagtgccctgctgtaattcgtcatattccttaattctagtttatgcccagctgcactctctcctcatgcctaaatttacaaagctttttattccacctgcacaaaattgcagtgagtagacagaaaaactcttagcaagtgaaaatattcttgagatcaaggagttctaagcagaggggcagatgcatttcaaaatcagaacactgttcataggaagggaattggagggacaacctggttaccaagatcaagatagtaaaggattactttgcatctattctttttctggttactggatcacagatacccagaaagaaagcctttgcactttgacgttttgatctctttctgtagctatatccactacatgccaactgttaccagacactttcttctgcatatcattcatgatccttatctacagtaaataatcttcaagatttctcccaatatttctctaattttagtaactctttatatagcgaaaggctgtcacagcacccatgacttccatatgtccatattaatagcattttagtcttcagatatgaatttaaaagtcacatcctctagaaagcttttgctaacccccccagccttggttaggtctggttactatacattcttaccacttgcatcctatacctctttttttattacactgaacactcttgtatgattcattgtatttcttttccattagactctaagctccatgagggtgtcatgattctgtcttactgatttcttcttgtgcctaggacagttctaactccagtcttatttccaagcacttaaagtataccctgattctcttacaatgtcagaattttcatatttcttcctattattttttcttttgtgttttattactacttaatgttcctgactctagagttgttatgtaagccagtctagactgtggttaatgttatgaggaaacacaacatgaattcaggaagttcttatagaatgttacctgcgaaagctccagtggctttggtgattaaactgtaatctcagttaaacatcttactttccattgtgggaaacttgctttggcaagattcaaacagaatgaacataaattctaataaaatatgttaatgggacttcatgggactcattagtccagctcccttgcctcacttaaatctacagtacctgttaattcctaccagcttctcttatagttttaaaggtatccatggactcttatcttaaactatatagatttgttatgcaccacccccaaaattctccaaggtttatgctcttgatttaaatagaagatttttacaaggcaataatttctacaaagatgtaattttataaatgctttatccccatcttttaagagctttccataaaattaaaaataagaaaatgattattgttgttatccttggtgaataaaccatgtaactgttctctttaactttttaaaaataaaagcactgacaataaagttaacaatgggcatttactaagcactaagatacatatgagctttatatttttaacatataaatttcacaataattgtgcgaagtatttgctattattcctatttataaattaagaaattggtctgcataaaagaaaaactcatccaatatgaattaattggtaaatgaataaatttgaattcaaaaccaggtctttctgcatccagggcccgtgtaccttcagtaagtactacctcaagtgtataaaaattatttaaagttaaaaaaagaaaacctttgctttactcccttgtaaaaactcatgaattacacaaacgcaggaacttgatgttagctgagcatgcacacactctgagcaaagaaatagggttcacgatcaagctgtggtttctatggtgtcttttcacagaatggaagagacaaccacagagtttttatgctgtctttatgtagggcctgatatagtcccatcatttaatttttttccattactattctgaacttagaaggctgagaacataaacaaatacagctgttttaaaaaggcaacaggctttttctccctccatctccccacccctgcttcaagatttgaaatgttaaattaataataggtgaagaaaattaaaactcttaattatagtaaggtaaggcaacaaccaagaaaaataaatgcatgggctatcccggtgaagaagttaaccattttgctaaatgcgaaataaaactataatgaaataaagaaatgttgagtaacaaaacacttaatataatagttaatgttagaagtcataatggttaggaatttattgaactgcaagaagcaggaaagccaatcacagaatagcttaaaacagttgttctgaagatggctgatgttagaattacccagagaacacttaaagttaccaattccctggccccagcccttctctctttctgatgaaattgatctttttgagagccccatataagtatcttttgtcagttgatgtattagttatctattgctgcataacaaattactccaaaacataggaatttagaacaacaacatttattaccttacacaatttgtaggtcaggaatctaggtgcagcctaactggccccctctgggttaggctctctcacaagacactaatcaaggtaacagccggggctgacatcctctctaggttgaactgggggagaatctgcttctaagttcattcctatgattgttgggtagcctcaatccctgtgggctgttggccaaagacaccagtgttttgtgccatataaatctctccatatccagaaagcaggtcacaacatgacaactggtctcccttaaaataaatgaacaagagagggctcccgaaatggaagacatcatcatttgtaatctaaatcttggaaatgacatcccattactttagaaatgttctattcagtagaagtaagtcaccagatctaacctactctcaagggaaggagattacaaaatgatctgaataccaagaagtgaggaaccttgaggaacatcttagagattgcttgccacagccaggaatgtgaattggcttaaatgaagagaggtttatttttctcacgtaacaaaaagcctaaaagaggtatagtagctgaacattttctggactgccagtcactgttggcatttgataggaaggagagggaatatgggagaaagagaaggtctatgcctcttctttttattaggaaagcaaatatatttttctaagtccctctggaagacttttgtttatgtgacatgggtcataactggatcacttgggatccctcaactaaaaatggaggtggatggtgagtgtttatctccaaccttagattaggagcagcaaggaagcctgagattgagaatgacttgagaatagtgcccatcaatgacctgtgcacaccatgcctccatttccttgtatcttactctttactgtatctcaatttaagtttgcaaattgaagcataaatcgatgccagtttactaaatttaatatacagctaatttcaagatcatatttctcatggcttcaactttatcacagcacgctcatgaaccagaaagtagcaaacacctttgagcagcagaaaaagttgtaatcaagtccatgtagttaaatttacagaaaatttctcagatcttaatcttcagttttatttattcccttttagttcacaatccagacaggattgatgattaattcatctcactgcttgtacatttgtctcagtttttccctaaaagggtatggtcaacattttagcatttcataaaagggctgtcataatctggccacaacttgcccccgacgtcttcttctatgctcgctccttccagtaactcaagatttctgaacacacatcctcttctctacctccctgcttcctctctgccttcaatgtccttcccgactcatctttcaaggtctacctcgtatcatacaatcttagatgtctatagggaccagggaaataatgtaaatgagaggaatgtgctggcgattgcatattaaacacatggaaatcatacttgcaacaagggatatatgctccatcctgcttttcttaatattttctctgttcttggtcattcctttgtcttctcattccgatagagacataatgatccactttctaaattctaaattctgatagagacaaaattatttcacttttgtgttaagaaagtgaaaatgatttacatccatttttaatcatgaccatatagaaaatggctacaataccatcatatctcctcctccctcctccatcttcttctccttctccttcttcttcctcccagggtgttgctctgttgccgaggctggagtgcaatggtatgatcataactcactgcagcttcacctcctgggctcaagagatccttctgcctcagcctcctgagtagctgagactgtaggcatgcaccaccacaactggataattttgtttattttttatagagaagggatcttactatgttgccggggctggtctcaaactcctggactcaagcaagcctcctgcctctgcctgccagagtgctgagattataggcatgagccaacttacctggcaaccatcatatcttttatctctctctttaaaaaatgtctagcagtaattagaaatccagattttaatgtaaagtgtccaattttaaaatcatggtgtttgtatatacaaatttactttttaaattattttcatggaggaagggaacattctgcatgtcacattaaatacatctggagtctggagcatgcctgctgactgcgagctagatcaaaatagttccctctttggagtcttttctaaaagcccaggttggttagttacttcctccactgttttccaggaatagcaaagatgacctccaagaggaacattttgtataccaatttacacatgtggtttacatgtgagtccttacctggactgagatacttgagaacagagtttgcagattatgactgtgttctcagtttaacacatcgagtctaccccatagttcccaccctgtaaatgcttgttgcattaatgcatctcagatgaacacgtgaatctcataaagaaatgtagctgatgtggagtggacatgatctaattagagaacaagaaagctttgacttagcagcaaaatatgtgaagaagaaatgtcctggtttgtcctcttggacaggattattggatagaggcccaaatttattcatttaacgagtgtgtgtgctggaggcccaagatgaatcaagcagttctagacactgaggattcagaaaacaagaaaacagagaaaaaaaaaacttgatgggaggggacaaataagaaataaaagcaacaaataaagcaaatcatattttcaattattctgatgtttgttttggagaaacagtgaaaaaaaggacagagaagaagttgtcaagaacctgaggaatggaggcatgtgcaagtttaaataagctagccatgttaagtgtctgtgagcaggagggcatttgagtaaaactctgaaagaatgaaagagccagccagactgataactggaggaaagtgctccagtcaggtggaacagcaagttgaaatcctgaggcacaaggatgcctattcaaggaatagcaaggcggctgggatggctagaaagaagagaatgagagagacagatggagagggcatgaggttagagacatcctagcaggattggagggagagagtgcaaccatctcttagggcccattttgtgacaactttaacttttattccaacttagatggaagccattggaagagcaggagagtgacatgatctaacaaattttaaagggattgccttggtgactctattgacgctagactgaatggagactagagtgggacaggatgaccacctagacagtgatagaaataacgcaagcaagtacaatgacagcttggaccagggtcatgatcacagagacaaagaggctgatagagaactgggattccaacctcattaggttcctaaaataagttaaaatcttccttgcaaagcaataggatcacaacctgacctgtcagctcagtataagaatatcttctttgtgatctttctagttttaatactgccaacatgataattaattgcctaatcacctgctgttttcttgtcaaggggatttttctgatttttctcctataatatattgtctgctttgaagccagggtgatcttttcataatgcaaatctgataatgtgtcccctttttaaagcagtttaatatcttctcatttcatggagggtaaagcaaaattccatatcatgacccacaggacacttttggatctggattctcactgtgatgccaaaatcttcacaatctgtgctccagcaaatctgcctgttcagttccttttatgcaccagcgttctctcacaccaggggtttacctatcctattccttctgcctgagtttctttttgctgccttcttcacctcgttaatttcttctcatccttttcatgttagctcagtgctctaagtgctactctctctgggactctttctctaagatttctgactattgggtactcccctattgtaggctctagccatacctgcacctctccctgcatatgtcacagttacagttttttaatacacttgggtgatgactgaactgatgctacctcttcctgtcaccagctccgcccccccacccaaactagactgtaaaattcttggaagtaagagccatgccttcttttcttcatcatttattcccagcatgtagcaccatatctagcacatatatgttggatggatggacggatggattcatggatgcatggatggatggatggatggatgcatactacgactggcttaaaattttagcattattcatcctactatttctcacaatttagtgtaatttgtattctcagaagcatgaatagaaaacaattgcaagtgttggttgtcccaaatgtgctgctgtaaagctgggctacaaaggcagtcattttgccctgtctggggataaataggcatagtttgagtaatggcaattagagccagaattcaactggtgaatcacattgaccaccacttgagtaaacccatggactgtaattatgtctagtccttatttggaagcctggggaataatgcttttgtttgcagtgtttctccctggcacagtctgtgagcccagaatgaaaagattattatctttaaccagaatctcatgttctttgattttcatcaagcttttcacattttcatgttaagaaagtgaaaaggatttacatccaagattgattcaatgacatttttgtaactgattgccttttaaaaaattatattccagagcttcaagtaaaagcagtcttgcaataatttcataaggcaagaatgcattacttctttacttctaaaaacaaattgatgctattgtacatattttaactaaaataattttatacacactaagatcaaagatgttatctaaaagggctaaaacgagattccaccatagaccttacaacttaaaaaaatcctgtcaatatttgattacccaactgaagaatgatgtcttattttttagcattcctcataaatcctatttcttaattttcctataaacaggctggtgtgttttgctatcaagcaatttaagtgtacatttttatgggatttggggtcattgttgaaaccacgctaataaactgcaaaggcagttgatgcagataaaccttagaacaataaatataagaacaaagggagaagaaaataatgtgcatctgctgaaggggaagataccgccgaatactaatgaggaaagtggtctgggagttgatgtagaaaacctctaaagcatgcagcttaatgtgcaactgcggcaaaagggcatggagaatgctagattgtatggctggggaaagacaatataaatcagatttggcatcgttaatccaagctccagtattaatgtcacctaaagaattgttctctatgttgctcttggtcaagagaggtgcaaagaatgcatttaatgttgaaattgtgtagtaaaggggcagctccaggaatgtagtggtctgaggttagcaactagaggaaaaagaagactcacaacctggctagtagctgtggactaagatgagcattgctgccctttctttttatatgggccattgagagttaagtaagccagagatatcatcgagttaatataaaactggaccctaggccacttgggctgggctcaatgaagacttccactttctagaaaactctgagatttctgccctgtcagcgtgcccaacctttcctcagaggatactttgctgtcttttctcacaagtatttcttactttttaatctgcgtaaaatctataaggtacacttagacctgtgtatatgcatttgctgaagtgttcccaccactacgaccactaaaatacagtcctttcttaccttttttacctttttttttttgagacggagtcttgctctgtcgcccagattgcagactaatgcagtggcacaacctcagctgatggcacactccacctctgaggttcaagcaattctcctgcctcagtctcccaagtagctgcaactacaggcatgcatcaccatgcccagataatttttgtatttttagtagagatggggttttaccacgttggccaggctggcctcgaactgctgacctgaagtgatccactcgcttcggcctcccaaagtgctaggattacaggtgtgagctaccgtgtccagcccctaccttaattctattcatcctgaattcaacgtaatttggaattgaaaaactgtgagtaaaactgcaagaaactccaggaagttgtatgcattcatccacatgagtctactgtctacacacttatacacagacacagagacacacacacatgcttatatatacacacaaacatatagtctgtttctggatgtgtatatataaatatatatgagtgtgtgtcatatatatttactccaaaacaagtctccttcaccattttgtagataaaaacttcaaatgagtgtaaattcaaaagtaaatacaaatttaaggcaatttttaagtctaattttccctacttgcagggccagtttttgcaatataaaaaaattggatttatttagcttgatttgtttttgacaaatcagaattggctgtttataataccttgatatccactctgtacttggaaatcgattttttgaccaattggtatgaggtgtctctgaatctttctgggaatgttactctctcacctttgcaaatctgagttgacggtgctgcagtgtgctccagagaagcacactgcaggtggtgagaagtaaaagattcagccattggactggttgtcttgtctatacagagccagaaccatcaacaggtaaccataaatctctcctggggaatttcagcacataaacttttcctagagtctccagactgtgtttatactttgtagatattatgcaaaacatcacagcactggatgtagtagtacaggatgcatttgagagcggtgtgcacaacatatacagttgacccttgaagaacgttagggttaagggtgctgacccttccatgcaataaaaaatgagcatataacttctgactctccaaaacttaactacttatataacttactgttgaccaaaagctttgccaattacataaacagttgattaacacatattttgtatgtcttatgtattatgtgctgcattcttacagtaagtaagctagagaaaagaaatattattaagaaaattataagaaagacaaaatatagttgctattcattaagtggtgtgggatccttataaagtctttttttttctttttttttaaacaaagtctcgcactgtcacccaggctggagtgcagcgcagtggtatagtggtgtgatctcggatcactgcaaactccatctcccaggttcaagccattctggtacctcagcctcccaggtagctgggattataggtgtgtgccaccattcccagctaatttttgtatttgtagcagggatggggttttaccaagctggccaggctggtctcgaactcctggcctcaagtcatccactcacctcagcctcccaatgtgctgggattacaggcatgagccacctcacccagctcattataaagtcatcatcctcatcatcttcactttaagtacgctgaagaaaaggagaaagaggaggggttggtcttggtgtcgcagaggtggcagagacctaaggatatttgtatataagtgaatctgcacagttgaaaccagtgttgcacaagagtcaactgtatagatacgtttaaaatagtctttagaattttgatatcatgaaagtcattattgatttcttatgcaaagacagagataattttaccccacctggaagcaaattttaaaagttcaatttttacatttataaaatccttaagtgtcataaggtatactctgggacactgtgttaatatagcagtttattcagttttaaaaatctgaaccagaactttttcataaagttcactgcatataggactttcttttcatgctcttacttgccaagtgaatgaccttgaattgtgcccagctccagccttgcgaagcaaaggtactaacagatatcaaacgaacactgaggtgataaactataagatcctatttgaaaattcaaagggtggttcttaccatttttctctgacattagaggaggcatgtcacaatctgaaagtagacctttggtctttaaacagtagctatgaaataagatagaacatattcctaccaacttagcaaaatgtatttttattttgatatatgacagcactttcccgggtcgtatttcacactgggctgcaggaatattgcctggattgtattaatgtgatcattaatttgatttaaaactaattctgttcttttaagcttataatttaaatttaaggtaaaataccaaagaaatttcttttccttatagatataacttcaaatgtgtctgtgcattttgtagaattggagttacaaattacagatttgcagaacattattaaagaaccatttaaatgtataagatattaaaaatcccattagttcagggtatatattttcctgactaaattaaataaattctatccaaatcctattttattcagcaagtagagccatcaagagagagcactatggagtctgatgacctggattgaacccaggtgtggtaattgcatatctgtgtttccttgagtgaaccacttattcattcccagcctcagtttcttcttctgaaaagtgtgaaaaatctaagcatttaccccactggttaactgtgtgctgcacataataggttctccataaaaggtagctacaattatcacatttttttctattgcatgcaaccctatcttctgttaatctgcatttaccatttgtttctgcctattttcttacaattctgcattttatacttctttctgtgtactcgttaggatcctccaacctacagtacaaactgtattactaattggcactatataatttactatattactaatatttaactagtactatttaatttaataattactaatcccttcctcacaacgcttaagtcacgatagtcaataattatttattgaacccaagcttagctattgaaatgtgtaggtagattgtgaccagattcaaatgttaacctataaagaactggtagttttaggatattttcctccctttttgaagaacattgcacactttccctggctgtaagggtagaatgtgaactaggctgggctaattgtatataaaatctgccttaagtgtagatagtgtcagcaataagaatttgaaccacaatcagatcaatcagggatttcccaaattttctaatggacttagcaaaaagcctaatggacttactctcatctttaaaatatgaacaataatacatccacttcataaaattgctttgattagtaaaagagtattaaagaacttggaaatgtcctggcatgaagtaatttcttatagctgaatacctgctgttattttattggtattactattggtatcatcttttttcatgggttgctaagatgggagaatatgggtctgtagctgaatatgggtctctcgtcttctcacctattgcatggggaatgtctgaacaaacaatgatagcaagcaaaaaaatatatatatatttaaatatatatataaaattaggaatgaagaaagagactgtagccaacagatactgctggtgcctgtggatccaaccatgcccaaaggccagaacatactattggaatctccaaatatatgatacaataaatttccattaaaatagtgtgagccgaattttttgttatttgcaatacaaatagtatgattgaataatctttccactataccatgtagccatcaaatgaggaattccctggtaaaattaattaatttgaatgacaaatttgatcttcaagactgaatttttctgcatgtacatgtgtggtatttcttttgggagaattatccaaataattttttttttttttttgagatggagtctcgttctgtcgcccaggctggagggcagtggcccgatctcggctcactgcaagctccgcctcctgggttcaagtgattctcctgcctcagcctcctgagtagctgggactacaggggtgtgccaccacatctggctatttttttgtatttttggtagagatggggtttctttctttctttctttctttctttctttctttctttctttctttctttctttctttctttctttcttttttttttttgagactgattctcgctcttgttgcccaggctggagtgcaatggcacgatctcggctcactgcaacctctgcctactgggtccaagcaattctcctgcctcagtctcccaagtagctgggattacaggtgcccaccaccacacccagctaatttttgtattgttagtagagacagggtttcaccatactggccaggctggtcttaaacacctgaccttgtgatctgcctgcttcagcctcccaaagttctgggattacaggcgtgagccaccccgcctggccgatcatttcttaattaaatgcttgaccctgtctgcatagccataatgaattaagaatggaaatgatgctgaaatagaagaaaatttggaatcattactattgttccacctaattaggacactcataacgaccaatgaagaatctgcagtgatttcattagaatgatttgatattctagatgtccacactcagtgtaaacaaaggaaacaggagcttctttgcaaaaacacgcataggggagtaagaaagatacataattgcaagtcttaatatctctggtctaaggatgaggacgtaagagagctttgggtgtaaaattatgatttttgtcttctgcatattgcatagcttggaatattaaacagttgaaaataaactttcattttacctttagttatttgagaattttagaataaagtaagtatgttgagaagcttcctatgtgaacaattttcttaataatttcttcataaagtttgctatattttagcttgaatttatgttcatgagaggtataaaaaatatttactataagtaatttatatgtcaacaatacaccttgtttcacttagcattcatacatgttatgaatctttcgttcaaacttaattttaccaggtaaatatataagagatctttaaatagtaatatttatattccatatctttattcaagaataatattttgctcaacatacatatttgtgtaatgccaaaaatttattctccaaacatctctcataataatgcttaatatgtaatacaatgtaatactcaatataagacagtctctaataatcaatacttaatataatccacaacaataataatctgttggtgcctgtactataaaaaggtaatacttagaaaaggtcagttagctaaattttctccaaaattacaaagtatttgaaaattaattattacaatattacatgtcataaagtaagtaaatagctattttttctagtgatttttattttattaaataagtgtgtatatacatataactgtgtatattatatatatacatatatacactttatatacctatacttattggatttatatacctatatacttacagatatataaagtatatacttatgtgtatatatgtatatatttatatgtatgtacttatgtgtatatctgtatatatttatatgtatatacttatatacttatttatatttataaataagtgtgtgtatatatatatataccttataagtgtgtgtgtgtatatatacatacacctctatatatacatacacctctatatatagagagagaaaggtgtatatatacttattaggtatatgtatatactacttttgtgggtatatctatacctacaaaaataaatgcagaaatatgcctctgactagaatagcttgagaggtgttgtgaaatatcaccttgaactaattctttcacatgaaaataagcatgaagtatgtttccatttatttgttaagaaatagtctgaatttagcttgtggatcctaggttaatacatttcctaaaacatttaagagcttgtatttttcacttcttttggcactgattctcctctgtcttcattttacgttattctttcccatttatgcttttttcctgaggttggttctctatttctctctccctatatcattttctcttaagacagttggtggcatgtgaagatgggatttaactattagcacaatcttgcctttccatggcagcctttcccctaaggaactggctttcctttgaaattggctttagatctgacagggcttctgcagtttcacattactgctagtccaatagagaaaatgaaaccaagaaatttgatcaggttaccctagggcaaaataaaaggttggtttggggaaatgcttaatttccatgatccagcagggatttaccagcctgattctcctgagaaaatcagaatctggttttccatttatccatccagcttttccaaattaccatctctaggtggtttcaaagataagaaactggaatggattctaaatgttgaattcaatttctgatatggagttatcttaaaacatgggtcagaacagcaagcccctctcccctctcccttaccccaactactaccaccaaataatctatgtcttttagaggtctttagtagatttactcaagaaaaagattcaaggaaactgaaataaatgcttcagagtcagggaccatgttagccaaaggttaagaatcagagactaggttaattgaggaacgactttcaagatcttatattctttttatctttcttgcttcatagaggggaatgttgggcaatgggctgtttcattaagcaataaggagaaaataatctgacacccattccttgcatcattaaacatcagatgaactaatatgcatagactcttgctattactgcacaaagcctttgaaaatggtcaacatccactgccatgctttctctgctgtatttttaaatattctatatctgatgagtaataaattcgagactagtttaattttataaaggaactagatgtgtccattctccatcatttgtacaaccttgtaatatacacatgtggaaaattgggggcaacattgcttcctttctttgcacggaacacggaacaatttaaatttgtcactctcatttacttattgcagagaaaaataaggagcatgtcttttgaggcttagctttgcatttcagactatacaggcaaatgtgggggtgtcacaacaaatgcaggtgaagagggggtactaattaagaaccatcattcaatatcatttctacattagattaagaaaaatacattagaatgctccatcttatttttctcaagaggtcagaatccaagctactaaactcattagaacaaacataatcactttttattcatttcaccacagttcaatctaaaattaggtctcatttgacttttaccaacatgccttctaaatgcatcataagcatttcttcattttgaagaagttaatacaataggccacatacatctttgcccatattcatttttttgtcaaatcaagacagttccttagaagtgtaaagattttttctttggttctagggaataatttttcttctatagacttcccagaatacacctggggaaaagaagttttgattcacaaagtgagtcttgagctcttgctaagatactgagaacaccacagaaagggtgaaattcaaactgtatgtatgcaagtatagttctggtattttaactaaatcaatttggacaaccccttagacattttttgttacttcactgatgacaaaataagtctttcatcacagtcagcctcttatgtgtatgactgctgcctcatgtgtaatttacttctaaagattgaaaatatcttaattaatgacccaaacttaataataatattgacttaaaaacaatgctgtttctgcacaagtgaggtgaagttcagagtacaaataacagaatagttaggaaagaaaaactgcttgtatattttgtactaagattgattggctctaagttatttgggtgactacctcagttatccactttacttggaacagatatggtttaagtcatggcaataaaataaatgtcataactttaaaaataaataaacacaattaaccgatgttgcagatatttcattcatacaatatttagtttccaatttgttcatatagatatataaaaacaagaaactacagtagtttatataaagaataactttaaaaaatccgctcacatgtaaaaagaaaaaaagcatatcatatttgaaatcatgtaattctaactccctacataagaagagagaaattagcatgagtgaaagcacaacacgaatttaaatgttgagtactagttcgtttcccttctattttaaataaatggacattcattataacatatgataacatggcggtccgcttgcttaaagtcgatgataaccgtcattttccatttgatttgtgcatacgttttgagtagtacaattgtcccttggtatccatggaggattggctcagagatctcttgtggataccaaaatctgcagatactcaagttcctgacgtaaaatgctgtagtatgtatgtgcatataacctgtgcacatcctctcataatgtaaatcatctctagattacttatagtacctgacacaatgtaaatgctatttaaggccgggcgcggtggctcacgcctgtaatcccagcattttgggaggccgaggcaggaggatcacgaggtcaagagatcaagaccattgtggccaacatggtgaaaccccgtctctaataaaaatacaaaaattagctgggcatggtggcacacagctgtactcccagctactcgggaggctgaggtgggagaatcacttgaacccaggaggtggaggttgcagtgagccgagatcgcgccactgcactccagcttagcgacagagcgagactccgtctcaaacaaaaaaagaaaaaaaaaattgtttctgtatagacatattttttccaatattttctatttgtagttgattgaacccatggaagctgaactcaccaatagagagggtcagttgtatacaaatatgcagaacacactaagtattagacaccatatatgttacaaaggtgaccgagacctgattctcctcaagtggagatgagccaccagctacaatatggcagagactaaaatgatcattttagtctccatcatacaccatttattggcagcttacggagttggtgttcccttgttttgcaacgtagttttctttatatccttggaagttcataagtgagagattcacaactagaaaaggtttctgtatgaatatgcagaggtaataaactgtgtcttttaaagtacctgaatcagagcagacagactaagattcaagtaagttttcagctatgtgactttcagtaaaacactcgaactctctaagattcatttggtacgtctgcaaaatgagaaaaataagcgtagatatcatggatgcatgtgaggattaaatgaggtaatatgtcaagcatttagcacagcacctaatacaataatcattacaataataataacacaaaataaactactattagtattaatgaaactcaagttgccatgtaagttccaaggaaaatttctgtggaatgcatttggggatcagaagcattctagtagagaattaaaggatttgttgatttaaaacagaccaagaagacaacacaagtgtttcaggagaaaggagtggaaaaattaaatgctgagtgttaacaaaacaaggcgtgatcttgagagaataaatgtacagtcaagcattgcttaatgacaagatacactctgagaaatgcctccttaagcagtttcattcttgtgcaacatctccgaatgtgcttacactgtcttggatggcatagcctaccacacacctaggctatatggtacagcctattgctcctaggttacaaactgtacaacatgttactacactgactactgcaggcaactgtaaacccatggtatgcatctgtgtttctaagcatatttaaacacagagacggtacagtaaaaatacagtattatactcttatgataccaccgtcatatatgcagtctacataccgaaacgtggtgttggtgggacatgatgacagtcaaatttgaatgaaagcaaatattaggatgtgagactagaagcacaatttgaaacataaacttctcggttcttaaatgacaggcctaaaagtctttattggtctttatttcatagagcaattgaaatctttgctaatttttgaagttagtaagatgtattgaatatataggaaagtagatatgagaagaaaatttagaagactgttactaaagtcgagacaaaggccatgagctagggggcactagaaataggaatgaaggaagagaaatgagagataattataggataaacttaaccagacctaacaaataaatatataaggccatgcaaaggaaatcatccagggtcaaatgctggatgattcttgatgcctgtcatggggctgaattgtgttcccccaaaatttatatgtaaagtttgacgctagccctaaccccagaacctcagaatgtgactgtctttgcagataggatcattaaagaggtgactgagttaaaataagctcattacagtgggtgctaattcgatataactggtatctttatgagagaaggaggttagaacatggacaggcacagagggaagatcatgtaaagacacagagagaagataaccacctacaagtaaaggtgagaggtgtccaaagaaaccaaccttgacaacatttgatcttggaacgccagcctccaaactgtgagaaaacaaatttcttttgtttaagccacccagtctggtattttgttatggcagccctaagaaatcaatagagtgttattcacagaaacggagaaaataaaagtggagcatatttagatagacacaggtaattagtataatcacaggcaggttgacatgactcaggctttataaattaagataataatggtttcctaatgatctggtgcttatgttgaaaacattaaaagtataatgctataattttattttggggagaacacacaccttgtatattatattcatcagataattaatgttagctaccataaaaagaaattctgcccctctctcaatctcaatggcttcacgaaataaaaacttattttttgtttatatgaattcactataaacatccaagttggttcctccttttttaagagttaactcgaagagctttctctctttttttcttgtagtgctttttcctttgcttctagccacatggatggaaagagaggtaacttgaagaatggttttaaggctatgcttggaagtgacacatatttcttcctcccatattctattggctggaactcagtcacataattctacccagatgcaaggcatcctgggaagtctagtttagctgtgtccccgggaataagaagataatagaatattaatttacacatgtaaactttgccttttgggctaccagacttttagtgtgcagaattatacataatggggaaagggaaaagagtagctaattcgatatagggtatatttctatgaaggtaattcagaagaccatctggatttagaaatttcttctcaacaatataaagatgcttagcaatccctaaggtccagaacaggctttgagaaactttttctgtaaaggagtagaaaataaatattttgagcttttgatgccacatggtctctgtggaaaccactgaactcttgttactgcagcacaaaagcatctaaagacaatatgtaaataaatgagcatggccttccaataaaactttatttacaaaattaaaaaaaaaggcaaaccagatttggcttacaggccatggtgtgccaacccttttcacagcatattaggtaatttgtcattttgcaagtatttcatgcttgtgctcaggtaattgtgcatgggcagcgagcctagctaactgccagcaccatcaacagtggctttgcccattatcctcagcaaactaaagcaggaacagaaaaccaaacactgcatgttctcacttacaagtgggagctgaacaatgagaacacatgaacacagggaggggaacaaaacacactggggcctgtcaggggagggtggcattgtgggggagtggggagcatcgggaaaagtagctaatgcatgccgggcttaatacctaggtgatgggttgataggtacagcaaatcaccatgacacatgcttacctatgtaacagaactgcacatccttggccaggtgtggtggctcattacacacctgtaatgccagcactttgggaggccaaggtaggcagaggtcaggagtttgagacacatctgtccaacatggcaaaaccctgtctctactaaaaatacaaaaattagcttggcatggggccacatgcctgtaatcccaggtactcgggaggctgaggcaggagaatcacttgaaccctggaagaggaagttgcagtgagcaaaaatcacaccactacactgcactctagcctgggcgacagagtgagactccatctcaaacaaacaaacaaacaaaaacctgcacattttgcacatgtatcatgggacttaaaaaaaaagaaaaagtggcattgctctttgccatgctctaatttacttggtcaaagtacatggagtatcatttgccaagagaaaaaaaaacaaaaacaaaaacaaaaaataccctaagttactttgtaaaaactgaccttaaaatcaaagataactacttcagttgattatgaaagtaaagaagaagtgaggagcccaagaaaatggtagaatatagctaggagatgtcacagttaatttcttttattttgatttgtctcagaagaagggtgttttttcttgcctgtaaagataacttttcttgatttcatgatttcttaaatccagaggaatcttttaatcaacctaatttttagctgtcacctccattctgtccttctacactggccaatctcttttacattgtagtacattgtaggtgtcttctcatgatatttctgtctctagtttttccgatctgccaaactgcacaacaaagcacgtgtgaatcagacagataggagtttgagttctccagtctttcactctttaaccttgtgactcagaaacttcactttacatccctcaatcctcaagtgttcattcctaaaagttggcaaaggcacaatattaaactcaaagatttgtttggttttgtctagattaaatgagttaacctatatacagaccactaaactcagtgtttggaacctagttaagagcttgatattagtttattagtattttaatttttcagtaattctatcctcaatgcaatatgattactagaacccaagttgtaccaacatttctctcactaatgtcaccaatggctttgtggggtgggggggctataaaggtttttattcatttaatattgttaaacatcacttcctcagcatacttctttgctatactgttcacgtcactgtactctgctgtttatctcctacctttatgacacttctttcttcatataatttgatggtttcctttctctgactcctaaatgaaatgcacagagcttatttctgtacaaccttgctccccacactcactctcattagaactctttctttgcagggaatctcaacaacccctgagaacaagtcaaacacattccttacgttctgttttaagctctcacatttgcgactctttatctgctatttccatgggtgtatatctcacccatgacaaagtatactccaaaccaaactgatgacgtttgaaacgtgaatagtcttgctaagttaccatcattgttcccatttcccaggcttgaaacttttgtcattttctaccctcctgcatcttcttctcttgtatttattcagttctcaaatcctgcccttccgtcaaaatatctgcccttccctcatctccttgataaggtccttagatctcatgcctgaattaatttctgccctaaaagtctatttttccttccacccacctacctattcatccattcattcaatgagtattaatgctctaccatgggccaagcatcctgaggtctctactatgaaaaatacgtgaaatatcaatccactcctagcttttcagggtatatattctcttggacgacagtggacattgataatgcacacatgctatggaatcaaatagtcttctgttaaagtcttggatcctttatttcctacaaccttagacgattgacttaacctccccatgactcattttctcatgtgtaaaatttggatagtaatggtacatccttgatagatattttgtgactatgaattaggtggtggcacatctaagccttcacactgtgtcaaatatctaataaaccctcaataaatattaaccattataattattaccaataaaagcagaaaggaacattgtcatgacaaggctatgtgtgattaaaagccaacatgagaattatctagagtagcagtgattcaaggaaactgaggtgagctgtgacccttctggggccagttcaatgaacaacccaacacaaagacaggtttcatttatgagtggtgctgggtgagactgtatatgggggttgatggcttctaataataagccaggacctgtcaacttcctcctgttcacaatgtggagaccgtttagattttggagttgaaaaataatgtgataaaatcaggtttttttttgtttgtttgtttttttgagatggagtctctctctgtcacccagactggagtgtggtggtgtgatctcagctcacagcaagctccacctcccaggttcacaccattctcctgcctgagcctcgagtagctgggactacaggtgcccaccaccatgcccggctaatgtttttgtattttttagtagagacggagtttcactgtgttagccaggatggtctcgatctcctgacctcgtgatccgcccgcctcggcctcccaaagtgctgggattacaggctttagccaccacgcacggccaataaaatcagttttaaaacaacttgaaatcatagagcaaccccttattcctttatgcatgctttgcctgccctctgttaaggtcaattgcataatatttttcccatttaaatattgcatttttccaagtggaataagaatgactaggtgttattttgaggataggagatattcagcaaatacttgatcatttattgaaatataactgttttgattgagcacagaagtaaggaatttttgaatcacttccttttgtgaaggtgcatttattttgccactttattccatggctacattctgtaccattagactcaggttaatttatcgttaaaaatgcctgtggtgttttgtttcaatgtctacaaatgtcaaccaagtcatctctaatactttaaaagtaaattaaactccaaatcaactgattatgattctgaggtgcagtcttcacaatgattaggaacttgattatttagtagaattgtgcataggtgtgaacatcaccactcttttctgcactgtgagaagaaattacttcatataaatggaagcatcttatttggctctatgtggtggttttgatggtttttgaccaaacactatgattatagaggtcaatgagctatttaaaataggttctgtctcagaataaaatacattttgttcataactttgccagctactatgtcaagcctatatttactaagggccttcatgaaatgtctgtttggaagaatcagtctgtaatggcagtgatgtgtcaaggaaagaccaaacagccttagtgaatgcattttacctggtgtgggttgcacgtacctgtaacaggaaagattcctttgtctttgggcagtacagttaggctggcagggtggtggaggattctgcctgtgctttccagctcatagcaggatgttcacttttatttacttcctgagtacccttcaagcggtactgttatcagagctgcatttgagatgaaagggatccctattatggcccaaactgaaactctccacaggacacctctgttaggaaggcaggaattctttccaactttagacactgaaaggaactattgcttctttgtgatatgcaaggtattttatattttttactttgatattttaatgcttattactctaatctcagaggaaattttaaaacatactaatgttccatttattccaaatatgtataaaataatttattctttttcaaagagagacactgtgtttaccatctgcagattaggtatgcattatgtatgtacataagcacttatgaacgaatggatgaatgatgatttaggtggtattataggctcttcctttctcctaacataatttgcataaacagtggtctcagaaatacatttcccctgattctttatttgcagagcccaggaaatgcttgcaaagtctgaggttcacaaaatggatctggttggtagttgtgtgcctgtgtatatcttcccatttcttttaaattcttaatgacttttatgtaagtttactttaccactttgatcccagaataccacatattttatggcagggctatttattacttaaagaatgtaaaataaaggtataaaaatgtcttctaggtgaggcatttttagtatatattctgtgtttactttttttttcttttttctctttccattacttctgcctatttatggaagcaatgttttaggcttgttcttttctgactttactaatgcacttttctgactttaatatgcaccaaagttgccctgtttaacagctttctctgtatccttttactaacgttcagtgtcttgggaaccaagcgcaaaacaaagtcatccatcttgaactaatatacgagcttacacctactgacagtagtaaatacaaaattggtgatgctctccaccactggaattccatttaactaccaattcccaaggagactaattcatttaccaacggatatgaacaaaaccacactcactatttcagagagcatattgtattttccctctttcagataattctaacgaggggctgttccacctcacatcttcgatcacatggtggtgagaaaaccctataacttaaaggagaggagtttattacagtaagtataaaacagaacaaaacagctgggcttccacagcactttatgggaaacgtcttctgacccttctataaacaattcctttggtaaagtccccattttatgttggtttgctctgtcattggcgtagagttatggcttgagtaaattcttgttgagggtttcaaggttggcatgggaatgcctttcttttcgagatcttatagtagatgtgtgtaattcatcaattgtggaacatatgccatgctttattcacaaactttgagagaagttaattgccagctatcaccttcaaaatctggcaccagaaattgatatctaaatcatttgagtaaaaattagtttgtaaggctttgccagttactcctagcaaatatattagcttatccaaatgaaaataattttagtgtggttttatgattttcaaaagcttgttatttatgcttcatttcatatcttggtaagcattataggatttcactatatctaaattttggagtgggtgtgagaattaaagacataactaaattgctggagaaagtcaggttataaaaatttaatttgtattttatttgagtagcatttaaaggaaaaatgtgttttctatatgtacattagacttttgatattttatgtgtgttataaagcataatatcctccatatatttactttgtaaagaaaaaaaggttatgaatataacacaaacttatttattcctgttctctttttaaattgaactgttaacaattaccaatgccttgaaaactcacaagagtgcattaggcaatatactttcacaattaattggttattagatcattaacaaaattttaaatgttttttcttctgcttatggtacccaactgttgcataaaagaacagctatgacacgttatttgatgaaatgccagttttaaaaaaccttttttagtttaaaataattgtgtctagtcctcacctaataatcagctgaaagttgttaacttttatatttgagtctaattttgagaataaaaatataagctgcaggaaagtgtattttttcattagataaagcaaataacacatgtttcatgtataagaattttggttgattaccctgtgtgtaagatattcttcaattaatcagttccagctgtttccacaagaaacaatttttctttgggcatgtgtaatagaaaaaaacacatcaagttgggcataatgtgttttttttgtatttcctcttaagcaattcattcaaatttagataaatttcaagttattttattttgaagtaggcaagctatatttatttcactttgtttcaaatgcaaatggttaagtgttttgcattctcatcagtaaagagtcctatgactaaatcataatttaatgatctcttcctaaagagatgatgcaaaatttagatctgaggaaaggattcttatttttatctatttaggctgatctttctataaaatctctgcgggcttcctttgttgttcaaatcataaagatgaaatccatattgtgaaagataatgtattttattatagaaatatggattattgaaataagtcttcacatatgaaatgatattttatgcattgtgataatgtgctttttctctggagttaggaaattgtctcagttttatcagaaacaagagttaggcctttttatttaaactatcatatataatttaggtaaactgaaagaaaaaatattttatatttagcaacatcttttccattttcagtgttctttacttctttataaagatctgagtttctatctggtataatgtcctttcagccttaaaaatgacttttagtgtgtcttacatatagtgtaattctaatgatgataatcctcttagttttcatttatctgaaaatatctttattttacctaaatatttgaatattttcactagataaagaattctgggttgacgccgggcatggtggctcacgcctgtaatcccagcactttgggaggccgaggcgggtggatcacgaggtcaggagatcgagaccatcctggctaacacggtgaaaccccgtctctactaaaaacacaaaaaattagccgggtgtggtggcgggcgcctgtagtcccagctactcgggaggctgaggcgggagaatggcgggaacccggggggcggagcttgcagtgagccaagatggcgccaccgcactccagcctgggcgacagagccagactctgtctcaaaagaaaaagaattctgggttgacaagatttttttgtttgtttttctttcagaacttttaacttgctataaacagtatgtaatgtgttgtttttctctctggctgttttcaaggtttttttatttttattttttggcagcttgattattatgtttattatgtacttaggtggggctttcttagtatcatccttctgaaggtttgctgggatccttgaatctattaatgcctgattttcaccaaatttgataaattttctgccatatttctccaatatatttttatgcctcatctctctttcttctgtggaaaattcaattacacacatgtaaaacgttttgaggctctatacaattccactcccaacccccatccccaatcttttctctctctgtttttaaggctagaatatgtctatggatctagcctcaagtatgccagttcttttctctgttatctcaaatttgctgttaagctaagtgaaaattttaatttctgatattattttttcaatcctagaatagctttctggttcttttttaagaattctatttttctgtttaggtttctcaattttaggttcattttgaaaaatattaatatattattttattccttaagcacaattacaagtgtgctttaaattccttgttttctaagtccagtgtttagtaggtcatctcaggggtcatctccgttgtcttctctttgagtatggaacacattgtccggttttatcatatgttgagtcattttgaattgttttctggtcattgtagagatttcagaatctgtcatgtgctccaaattatattaacttctgttttgactaccaggcagtaaatgtagcagaaatcaaactatagtgtcctttaaagtggatggttgctgaaatctcaattcaattcttttaacctcagcagagctgtttggagactgtcttgctgtcttagttctggctgctgtaacagaatactataagccaggtggcttataaacaacagaaatgtatttctcaaggttctggaggctgggaagtccaaaatcaaggtactggaggatttgttttttggtgagggccagtttcctggtttataggcagccacgttctcccagtgtcctcacataatggaaggggtgaaggagttctctgggacttctttcatgaaggcactaatcccagtcatatgggccccactatcctgatctgatcactccccaaagggttcatctccaaacaccatctcattaaagattaagtttcaacatataagttagggggcaggcacatatattcagtctatagcacccactgatgcatgtttcagaggatagccagggattgggcatcatttacacatagaatatggggctttctccttgactgatttctcctcaacattttccagttgctctgttgcccaagctccgtcccttgcttcttcaagccaataactgcaactttactttcctcgttttatccacctagaatgggcagactgggtcttgatcttccctaaaagctgtaaaataggaaacttacccagtgttgttcccttcttccagttgtctgcccccttcactatctgcctgttttggattactttccagtgttttcaggtacttacattttatattttgtctatacttcgtagttgttttgttttgttttgttttgtttgagacaaagtcttgctctatcacccaggctggagtgcggtggtgtgatctcggctcactgcaacctctgccgcccagactctagtaattctcctgcctcagcctcctgagaagctgggattacaggcgtgcaccactgcgcccagctaatttttgtatttttagtagagatggggtttcaccctgttggccaggctagtctcaaactcccgacctcaagtgatccacctgccttcgtctcccaaagtgctggtactaccggtgtaaactaccacacctggtctatacttcatagttttagggttggttggttctgaaaggacccattattagaaatctataacttcacattggaaagagttctcatattacaaacctttgaaaacataattttattggctgcttcattacaggattgcagaataatctattagtttaaacaatgtgaaattgtcatttttccaggtcagaaatgctcagataatggtaatttcatatggtttaaactagtaattatgttcttagatatttataatttattttatcattgaatatctatgggaatatagagtttcctgtagttcagtttgcttacatcgtatagagtgttagaaggagaatgcctgggtctaaatttatgtacgtctttaaaccccttcaatataattgctatttttgttattaaattgtaatgtaaataacatgtaatttttttgtaaaatggttgcatacattaatgatatttaatatggctttcatcctacaatcgtgtcatgcaattacattttggctttactattttttctttggcaaaatattatcaagttatttaattgatttgtgtttgttccttattatccacactgaatatattcattatggttgttagcttctctacttcatctttgggtaaatgtatcagaatattttaagtacccagaaatatttgagactttcatcatcaaatttcctcctttatccatatttaagactttaaaatctgcttaaatttaggaatttctaaaaataatttcaaattttatcttagattcagtgggtacatgtgcaggtttgttacatgggtatattacatggtgctatggtttggggtgtgaatgatcctgtcacccaggatcatcgagcatagtacccagtaattaattttgcaatccttagtcccctcctcccctccctcagctactagttcccattgtctagtgttgccatctttatgtttatgggtactcaatctttcactccaagttgtaagtgagaacgtggtatttggttttctgttcctgccttgatttgcttaggataatggccttcagctgcatccatgttgctaacgaggacacaattttgttatttattttatggctgcatggtattccacggtgtatacattttcgtatccaatacactgttgatgggcacctaagttgattccatgtttttgctattgtgaatagtgctgtgatgaacatatgagtgaatgtgtattttggtagaactatttattttcctttgcatgtatacctagtaacaggattgctgggttgaatggtagctctgttttaagttctttgagaaatctccaaactgctttacacagtggctgaaatgatttacattcccagcaacagtgtataagcgtttacttttaggaaacttttaagatggcttctatatgcaagtaataatatttgaaaatgtgttctatatttgtattattgtgcattcactcagatacagaaaaaggaatctaagtcaataagtgtttcctgtttggagaaaactcaatatatgggcaatacaagtgttatatataaagctcttgcctggttatgtgaccttaagtgttgtagtatgagctggcacaaaactctctaagtgagaaacagaaaggatatggcataagagagagtaactaatccccataagataaggcaaatttttcatgtcaatataaacagacgatttggaacccttgctgtgggcttactgtactgtggcatagtgctttgaatgcctaagaaggtttgtctgtttatcatattctgaaaaacaacatgaaaataataaattgataggtctcatttaacccctggaagacaataaatccaatgcaatgcttgtaaaaaaactgagttatgtttgtgttagcacagtgcatcacatactagcaacctgtgatttcagtacatgtctgctaattaatttattttgtaggaaaataaagttaattgaaagcatgaaatatggttcctaaactatgcatggagagggctaattggtccatggctttttaaaaaaacggataaaaatatgccttaaaaggatgtcctattataccttagttcaaaagaataaagtccccacccatgtctaaatgtatgctaaaccttaagaatatcttaaagcaagaatagtaaatacctaacacatgagaattatcttttgtataatatctgtgatagaaaacattagtaggtcactttaacctttcctgctcagctccgatgcagggtcaggatcctttggacacagtgtttcagtaagtcactaccaatcagttaggttagtttatgaaatgaagagttttttttgccatgtatacacctcttactaaacaacctataacaagagaataatcttacctagaaatgtaccacgaagaagaattattttgattttaagaaacaggaaaccatcgaaactattttacatgaaacatttttttgtctcacccggctacaaggtcaagttgtattccagtttcagcttttaataaaaaataacctttcagtttatttgaagatctaggtcttggaatataattctcaagtatctgtctctctcctcttttctctatggtgactttattctcaggaaggctctttctaagtggtgataagaagaagggagtttctcctgccttatgtcatacctctgagcaaccctcagttttttcctagtagctcataaatccaaggtaggtttctcattggcttctgttgggtctgatgcccttcatagctttagtccccatagacttaggagtagaaaatattggctggtcgtgcctgggtcacatggaccaggggtaactagaaagcattggaattagcctcaattcggccacataaacataggagatattattccctaggtccaaccaggctaaatgaacggagataaatgcttggcaagcaaaaaacaacaggtattcgtggtagcttccattcttatttttcttaactattcttctgaaattgttctgacgacagagattacagttgcattaaggataaagtttaagcagttataataaaagtctccaaaggagattggctcaaattgaaaggggacattcaattttttatggtattaagtaggttctgatcctcagagtcatgtaggaattcaggccagagtggggtttctttgtcatcctcaacatgagccttttactactgtgggttagtcaaaaggaaaaggagaagtgaatctagatgatctttaagtagatgagctgagagttgccaacagcatttttcctcatgtctctttggtgagaacctagtcctagaaccaaactaagtcaaaagagtgactagaaaatttagtctttaggttagcggccctgtgtccagaaggagaaaaagaactaggccgggcgccattggctctcgcctgtaaccccagcactctgggaggccgaagcgggcggatcacgaggtcaggagaccatgctggctcacatggtgaaaatcagtctctaccaaaaatacaagaagaaatgagccgggcgggttggcgggcgcctgtggtcccagctactcccggggccgaggcgggagaatggcgggaacccggggggcggagcttgcggggagccgaggtcgcgccaccgcactccagcctgggcgacagggccagactccgtcacatacaacaacaacaaaaacaacaaaaaacagattagtgggcagaggaagtggagaacaacctgtggctgccacaagctcttgttggtctttcctttttctctaacatgtttctgttacattgagtggaaaacatactttcaaaaacaactggaaaaaaaaagaaaaggagaaacttcattttggctatgtgtctctgtaaaaagatcagcctttatgctcctggtattactcgctatcccactattcgacatttgtcttgtttgctgcaacagaataataataaataaaattatcttcaaagatggcagtgacttttcatcctgtaaaatgatacaagattaaaaacttggagatttttttcaatatattctcggccattaaccagttgtacaactctgataaaatttctgaaccttactcttttcagatataaaaagaagctatggaagattatgttttctgaggtcccttccagactgaaaagatttcgtaccatgttggaaatagagaggtttagaagaaattctcatcctccagacatatgaggactttctccaacaaataggaattcatcctataactcagttcacaggcctttgagataagacttgggggcataggactttggagcaaaccatcaataggagagaaaactagtcattgtaggcattgctgattggagggtgggaaatccttctgacctgcacaagtaatcaatggatgccttaaagcatgagatttgaaaacacttaacattatcttggctacataattataatgttattaatggccacaaagtttcttagcctttttaaaaaatccagtgaaagtatttgatttcatgacctcccagggctgaattatacatattaatgatccatggcatgcaatacaagattttacctttttagttgttccagaattattgccctttgatttttaatacatatccttttgttcttgtattaaaggacaagttaaaggagtagtgactctgtcaggataactctgcagaattaatatggtctttttagctttattaatatcaaagctgaagtggctgctttgtactttcaaggttgcttttgaaggatctattcctcagtggaacatcctgcttcctgctttttattttttatttttattttttattacagcagttggccggaaagcccctgttgatctgtgactatttggaactgctagactgaaatgccattttcaaaactccagctcttctgctaaacaatttttctaggaatgatgccacatcactagctacttgtatttgccaaaaggcaatactacttcaatggccctagctctgggaatgataccaaatgatggttcaggagggagggagggaggcagtaaatcagcaggaaaagctgaaaaatgccccagcttttaatagcttttatctttttccagatgactggcctctctctcaccttctgcttctattcatgatagggcccttttctcccctatttttgtggcttgatattagtattttcattcgaaacggccgtcctcaattatcagagagaaaattcacacctttcaaagctacggcaatcacatttccatgtgactcataagtatatcttctttctctagcacctaggtgcaactgtgggatgcctgatagattaggattgtatgttgaatgggaaatgggtctgaaccaagtgtcagacagtagaatgggagccaggggagggttccaaagcagcagcagaaggtatctctagcaagcatccgctctggctggggactgtcttctggttccagccttactggaagctcaggctgtagagttgtgaattcctggggccaggcaagcctagatgtgttgcctgcttttgataatgtatcaaaaatatgaactcatccttggaagcgacagctatgaggtgtttcttggatgtagaaatttaggtcatctgtcttccttttgcattgccttaaaaagtacgatttcctttcttggtttatcatttgctggccttctttctttccatccttcctcccttccttccttccttcctcccttttttccttccctagactttccctatctccctcttttctttcgtaaaatttggttgcctgggataacgtgtattgcatacaagctgacttccttactgtccctagtaagctatgtgtggctattatttcttcatttatatgcaatgccagaagcttagaagaatgttatctccctttcagttaaaaactcatagttaagaactggccatcttcttgttttgggtattgtggcttggtactgtctaatatatttggagggtatttgattttttaaaaagctactggccatgcctattgagtttcctactgagcccagcacccagaccagtgattgattaaatagtagctgctcaataaatatttgttttgtaaataatgattctattgtcaagaaacaaatcaccaagaaagaaggagctatatatttaagagtactctgttcatctggccaaaatggagttccgagtcccttgctcagctgatgtttgttcacccagaagatggtaaactcctgagaccaacttcgctttgttgttctcttgtggttccttgaccttggaaatgtttttctacaggcagagtatttccccctgttggaattttatttaatattctatctttgtttctactttagaaaacatgccacgtgaataatgatgcctcaggcaaaagaaatcactccagcagtacaatttaaacttaggacaaatcctgccctcacttgcattcacaatttgccaaggcagttggtaagaactgtgcccacacacaaattgacagaatcgaggccccaaggttagcgatgattaaaatttaaaagtccattcattcattttcaaaatattttattcgattgcttctgaggcagaatcatgagttgccttcgcttttgctgctcccggtggtggcatccaactctgaggatagctcatccaactctgagggtagctctgaggggagctaaatatcctcattgttcaatgagctagatgaaaacaaaacgaggctgtaaggtcaatctcacagccttagtggagtaaaaattagaagtcaataattctcttaccaacaaagaggacttgcattcaacaggattttcaaaagtggtatcctgtaaaaattttggaaaataccaccataatggaaaaaaaataaagtggcatataaatcaaatgtagtgctaaaaattataatttttccatatgaattttggaatcctaaaatatttttatgtgtttgtggattcataaggcatcagaactggctttttgcactgaatatgagtacagaaggctttcctctccaatagtgaattaataaaggataagtaggaaaaacgttacgaaacgatgtggtaacattatagactctgtattagggcaaaaattgtgagatagtagaagatctgtaaatttaagcatgcacaatttgacagcggatggtcgtagcatattttgtaaattcaatagcaagccccaccacgcccttaaatgaaggaaagcaagaagacaatttttaatacgtacatggcaccacacccctctaagacgcagcaatgggagaaaagcagattggcgacctgtgtgtgcaacatgaaccgagtgaaaccatcggggagggggtggggggcgtttcttttaaatgtcgcttttgcagataaacgagcagggatcctacctcttttgaccggagatgttgaaaagcacgaccaaagtttttggcttggtctcttgctttccacaacgagataaagtctgaagcctgtaactctccctgtcccgcgggagcgtgcaaagggagggaagataagcggcgtgggtgaggggtggcggcgcagaacccaggaagggagcagaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgccggacagatcgcgtttcggaggcggcgcaggtgtgtcaggggtgggggtccgctggcatctctcgtgccggcgctgggggggtctcccgtggaggaagggctgaaggtgctccgggaggggtccactcgttatggaaaggaagcggggcgcggtcagggtccctcgtccgcagtgggggtggtccgggcccctcagcctgcacccgggaggagacgcccccttttcacgccccgcccccggtggccgaggccggattcggacagctcggggtcagtcgacggagcacaccgggcgcccgaatccgccgggtcccactcacgcccgccggccgccggtaggttggccctcccgcttccagcctccgccaccccatccctcgctgctctctgaggaggattccagacccccccgtagatctccgccctctctcgggtggggctccgaggtctagctggtctgggggtcagtcccggcctctgtctcccaccgcgcccctcgctcccctggacaccgcctggtgtgtggggctcagacccccccagtccactgcccctgtgtggctcctcctctcaggagaggattctagatcccagcccggggggggttccgaaaatgccgccagcctggagcggggaatccatggaccgtggggttgtggggttggggagcacgaaaacccagagaggggctagagctccacctccccagaccgccgaggggcgagagggcgcgccgggggccgtggttgccatggctcctggtagcggagcccggggggctggagatgccggtcgcggatggtcccttcttcctctttgtgcctctctctttctctcgctttttttttttttttggagtgtgagtgtgcgtggggaggcagcacggagaaagtgattaatttggggagcagggattggagccgggaggctggggaaagccagcccctccgttcccactctccgggctcgctgcgagccacagtgtctcagccaggggcagggccggggaactcctgcgaaaaaccacgggccggaggagcagcagccgcgcgggcccaggtacccccgccccagacggccagcagggtggagcgcagggtgggcgtttgggctgctgggcgggaaggcgggcggggaaggggtgggaggccggcggcggagggcaggtgtgcgtcggcagggctgggtggcccggcagagagggcgccccaggttcagcccctcctcgaagggcgccggcgtccagtcccgctcgtgggagccgcggagcagccccagggccggcgagcggctgccctgccaggcgcgtgcgcgagggcgcgctcccgcgggaacgcgccgtgcgcggggagatttgcgcgtgcgcgtggcgatggtaactggtgggccccccgggctcgctctaggcggaggctcccgggacgcccacgtggcttcgaattccagctccaccatcactgtgatgcgtcactctggactaggcatttaactacgtgcctcagtttccctttctcaataatacggagattatcgataccctctatactgggttgttgcaagactggaatgagatgatacaagtaatttaacaccatagatttttaaatttaacaccatatgcatatttgatgcataataagcactcaaaagttattgtcgttgatgccattactgttagttaatcctcagtttaattacatatggtgcattttcatttctctgcattttcattgaagtaaaaattctgcgttttctaattttggagaataatcttaattaaaatatgaatatttgtactgcacagtccaactcctacgaagctctgccttgcagcagattggaagagagaaactgatcaactgccgatgaagttggcttttcagtatattgatggagagagaagcttaggaagctctttggggaaacttttggtgacaagaaaataaaaagtttatcccagagtttttcttttgtaaatctttgtgttttctctttcacctgcagatgttgcagttgggtttgtcttaatttcagtctctttgtgagggaccaccatttggctttcataatttaacgtggttacagagcctatgtataccctggctttccattttatggccttaagtgctgcagtggatttacctttagtaatggcagaacgtagtgtataatcattccttgcaagctcctgaatattgtgagcaaatcaatggagacaaatagttattactggatgggtgtgagtactggctatggcaactcattaaaatctctttcagggtatgtttgtacccacttcactgcagcacaagactatgatgatgaatatatgtttcccagattgttatctgttgcatgtagacttacggatccttttcttcaaagaaacggctatagatatttattgattcctcatggttatataggtcctccaacctatctgctgataagtacactgtacacttcgtgggcctagctgtaggtctaagaggagttgattttgcacatactatacttattgcatttaagttaattcatctcattacatgaattggttttaaataaatttttaaaatcatttgattattaaaatataggcatttcttggtgaacttgaggcaagtaaagcctgacagatgtcaccatcacaaagatccttagtgacctttacaaaatagagctcacccagaaaaacatttgctagatagaaacctgattttatagttgcttctgaaatctttgaagataggaggttatttgccccaaaattgctttgttgaaataatttagcctgattcgcttttatagaaaaataagggtaacgatcaagactgatttaagattcttgtatttttaaccgataaaagaaaattaagtaatagttggggaactactggtgtcagatttgaaggaatgattgtcaggaaatactgagagtattacttcaggtagcagtgtttggctttgcaagacaaccctctcatcctcactgtgaatatgtcatctttaaaaggtaccttgaggaattagtgtgacagcttctctgaaattcatgtgatcatttacatattgtttcccaggagctttggcattaaatgtttcatttattggaaattattttgccctttaatttatgacagccaacagtgcaatagagtctaatgtattttagaaacaataaaattagcttttcaccattttctattttccctaaaaatctagcagcaatgcacttggaatgcttaagttagtccagagacaaatggtaagagtaggaaaacatgacagattgggaggtgttgagttctgaatttggggacctaattgaaatgcaaaggtataatcaagagaatgaacttgtctctgtactgaggttgttttcagtgatgtactatattatctgattcagtcaacgttccttgttattttttcaaaccaagattgagaatactatattttcaattatgaacattttgattacagtttcattctgactaattcagtcggaagagaatgcaattattatggtcatttacatacaatatgctaagttaacacagctaatgagtgaaagcataatattctttctgtttgttcctggaaaaatattgtgctaagcattctttcaaagaaagattacattattcgctatcattttatgtctatctacaagtagaattggcattgagccttttctctgctattaaagtgaaatctcttatattttggtgatcacatgcctttcctctcaccccttgggggagactggaaacaattctcaatttaattagatatgctgctttcttttttctgtacatctttatctgaggaaagattgtattttctaatttgggaggctgcttaacaccttaaacattactaattactgcagtttattttatgtgtgtcgcaatagtgtagttagttaattatagctttctcattagcaccacgtagagaataatgaattaacacatccctttgatcaaaaaggatttaagtttatcttctgagaataaaagtgttattgtgttactgaaagtcactataattttcccaagaaacaaattggttggaattctgtatcactgggttaggaagctcaatgaatgagttggattgatcacaaagtagagtagagctgtggttgcttggcaacctgacattattctgccatttctggtatatttatccagtaaactagaaaattctgtttcgttaacgaatgttttaagtcagtgcacaaatagaccataactaattgagattttatgtgttgtgggtaaaaaatgatcctgcttaccttctcattgtgtttagatcataaaaatacaaagggacatattccgttttcaattttaaggcattttcctgaaatgttgacttcactttcacataatttattcctagtgaagaatacaacttgtgtatctctttggaagttaaattattagaagtgtgtgtgagtgtatatgtgtatgtgtgtgtgcgtgtgtgtgatgcttatatacataatttcaataagaatcacaactagagtttgaggtgagatgaattctcaaaattcatagtttgctaattgaactgacagtttggtacatttagggtgggtataaatatctgaatcaaatgatgctggcagatgatgataagaatgataaatgcattgaacttggtcaatatataattatattttatgctttgaccagggtttcttctcctggtagtcttataacattctcccttctaatgtttgtttgcatcttatttcccctatagttgtggaggtaggagctctgttgcccatcttctgattcacctcttcctaactccagggactacaattgtgccattttcctatacaacctatgaattttagtgtgcatcacaatttccttttcagactgtaaactccttgagggtatacatttccttttatgcatctcataaactcttaaagtgtctggcacagcaggaagcgaactgttgtggtggttacatgcactggctataaaagtcaggctgccagggttcaaaatctaagtctgtcagcttgcaggtgtgtggcattggcttagtcatgttgacctctctaagactagtttcttctttagaaacggggaaatagccatacttagctcacatgtcacatgtgttcttgtggacattgtatggggcaatctatgcagacagattagtagcacggttttttattgtagtgataattatccttctatatcatgttcagtatgtgaatgaacaaagatagagggacagagcgtatgtgtgtgtgtatccctgtgtatgtgaataactgtgagccatgatcaatggtggtgtcaaatggcaaactgttgattcctacattaattatatgcacatataccaataatgattgcttcacatatttaaaaggttttcgcaatagttgttcttaggcttggctgaaattagaatcgtctggagagttctgtaaagctaccaacccaaatcaattcaattacagtctctgtggatggtgactagaaatctggatttttgaaaacttctagtgcgattctaacacgccctaatgtaccaatattggttaagaaccatcaccttagatttgcgtacgccgtccacaagattgtgttgggctaaggcattggttcacagtcaccctggtgtcatgaaatgtggctgaaagagaaaaaatgctctggcaaacttctgaggtttttcttactaatcttcttggtttaaatagcactttattctctgaagatctcaaatgtgcttttcatttactgtgtataatttcgtttttcaaccaaatgtctctgtgaagatggtaggaaagaagtaattatcctgatttgcagatgaatgtgaatggagtgagctacactgaaattaagtgatttgactagattcatacatttagaacaggcccagataacaagattcctgtgactttggggttttgaatatttctctgttttgcctgcagacttccaatgaggtagggagagttattgtttttggactaaagtactgtgtcagaaaaagctttaaaaatgagactttcatcctttttttggttataattgtgcagtgtaaagaaaaacagatttttattttctttctaagaagaggcaccatagtctatataggagccaaaccaatgtcccttggactttgaacaccgcttgtataaatatttcatttggcccaaagaatgtttaagacaaatttcagccaacatttaaatactggagatttcatgtaaaattcatatttctggcttatcttaaaaggattgatgttctcacagtattggacctgaatgcccaggtggcagaatgccacaggttagaacccagtggtttgtccccttgatgttcttgaaagacatatcttcgctgggtaaaacatggcttcctctcaccttcactttgttcctttcttttatatagatcctactccaaagaggtaattaagggaccttaaagacgggcccacatctctttggatgggattaggggaagcccacaagggctgctgaagcacatctggagctgttactgccccttgtcctgaagggataatgggaaggtgaagttcctggaaggaggtgggagcagtagctctggaagagggctgtcacgtgggacctatggcttttggtagaggaacataactactgtcaaatcacaagacagtgctctgcttctaccccaagatttccagttgcttcttcagcaaggcagtaagacggcaagggagcctattgtagtggtttgtggaggtcagttctcccagagcagagcaggatggaggaaggcagaaaagggatctgaatctgggaagtacgtgaggaatacctagcacatcttgaaggctttacatttgtggaacgtgagtagtggggaaggggaaagctagaattgacaaaaacagtacaaaatagggaatcattaagtttgtattcaggagaatcttcaccactttttctttgtcattcctttcttctttctttcattgcccgaagtgggcatgctcatattcagtggtgtgtttcagttgggactcttaaacttcaaaacaaatttgtccatttcattgcattatctatgctttctaagatgagagctgacatagcagagagaataatgtaaaagatgtattccagcttctatggtaatggttggcatttttagcagaggttcctccctaacaaaagcttttgctgtaagtggtgattctcctgggagggattgtagttatgatgcctgggaaagcggagatacactcaaatgtcagtctggcagctgaaactcatgtaacctggatgcctggatctttggaggaagtatccttcttctttgttatagttgtatcagaacaaggacgatgaaggaatagaccagaatgcactggttgcatcttaatgtgaggaatttttatttccagggactaagagatgtatttcccagagtaatagaatgtaagtggataaaaggaatgtggggattttgatgatctgttgcggttagagttgttggaagttcggttttttattgcattgaaaaccttgctaaaaactgtaaagtgacagaatattagcttattatgggatgccttacatattggttatgttcaaaagaaataacacgtctcatgtgcaaaaggttcagggggaagataaatactgaccttttccaagactgatactggatgctgcatttccatcctttcagaagattgcctctgaagatttctattttaaaaaaaaatcataatgtcttgcattatttgtgtgctttatgctttttagaaaatttttccatgtcatctcatctgacttttacaataacatagtgaacaaaaagaaacaggttgttagcccattttatagatgaaaaaaactaatgcaaggtcaagtagttagctttaccactattccaccacactgcctacagtagtgaaaattagaattaaatcatcttagatatcctaatttgtaacccagttcatagcccactctattgctttcaggttttctttttcctttttctttctttctttctttttttttttttttggagatagggtctggctctgttgcccaggctggagcgctggagtacagtggtatggtcatcgctcactgcaacctcgaactcctgggctcaagttattctctcacctcagcctcccaaagtgctgggactacagacgggcaccatcatgtctggctaatttttaaaatcttttttgtaaaggtgaggtttcactatgttgtccaggctggtttcaaactcctggccttaggtgattctcccacctgcccctctcaaagtactgggattacaggcatgagccaccttacacagcccagatttccttttttggaagaaaagagcaacattgtataactgatagtgaattgttttttaaggaaatctagagtcaccgtataaactgagagctgtctaggggaaaaattgaaaatgttaccagttatattttgagagttgaacgtagtcctggccaaagatagggagatagacttttccaaagcatcctgaattctataatacatgttcttatgtttgtgtgtgtctgtgtgtgtgtgtgtgtgcgcgcgcacgtgtatgtgtgggtcctatgaggcattgtgaccagtcattataaaaagcttttattgatcgccactttgtgctagagacaggaatgaaactgtgccaggcagatacttaaatagccaccattgatcatttatcaagtgtttattatgtgttttgcaatctccacatcagtgatttgaggaaagtactattataacacccaatgtaagctgggcgatgcagacacagaagggtccttgtccaatgtcacacaatatgtcttgcagtaccagagtcagaattcaaactcagaagtgtctgatttccagccccagcagtgccccctcgattagcaggattctccagctatggtcttcactatggactaacactctttcctgttgtccatccaaacttacctgttctgtgtcccattatccatttgtggaaaagtagacataaaggaatcctactgaggtattagatgataatgcatacctattccaggaatggtggcattaaatatgaggttttaaaacctgccagaggtggtggtgcaagcctgtaatcccagcactttgggaggctgagacgggtggatcacttgaggtcaggagtttgaggccagcctggccaacatggtgaaacttcgtctctactaaaaatacaaaaattagctgggcatgatggcatgcctgtaatcccagctactcaggaggctgaggcaggagaatcacttgaacccaggaggcggaggttgcagtgagcctagatcgcaccactgcactccagcctgggtgacagagcgagactgtcttaaaaaaaaatcttaatgcaactttgggaggctgaggctggaggatcacttgaggccaggagttcaagaccagcaacacagcaagactccatgtctacaaaaaatatataaataaataaaaataaaaattagccaggtgtggtcgggcatgcctatagccccagctacttgggaggctgaggtgggaggatcatttgagcccaggagttggaggttacagggaggagacatttgtgttctctccaaaatcaagtcatataagcgtctaatggtctgactcttcctgtaccagaccctgggcatcattatatgtacaaatgaaacttcactctcattatcattgtttatttcttggcagaaatgtttctgatactctatgatatgaatacgcatggatttccctcacttctgggtattatatgtaaccaattgcatttcgcggttggcatttccacaaaggtgtgagtatctgctattccagattaaaatagaaatcgttggcaatggcagatgccatatctcagcattgctgttcttgaaaacggcttgaaaatgacaccgatcataatgatggcactgtctttattagcagccgtcaataaagataaggctttagaagaaaaaaaggcaactctatttcaggcacagccaatatatttgggagttttaagagatttttgagttttttgtttgggatatttacaagcaaatgttcatgtatttttaagatatgcataatataaatagcattctcagatgctgagtggctccaaaaggctcctttttgtgtactagaaagtggcaagaataagtttgtttcctgctttggctagacaggagatcccacttccttggattatacacaatggcttttctataaagcttttgtttgacccatacctgcttctctggaatacacagcttggcttctcaagaagtaagtttatttctgtgttgtaaattcaaggatttttctaacttgttctgtaaaatgcatctgatgacatagtggagaattcatgcatttgattaaaatttaaagatgtaaagaatgcttaaggcatcatacaatggcaaaaaactgaaaacactgcccacaagggtaaacatataggcaataacaattttaacatctatcacctatatctgcatgaataataggctatattgcgttatttgttattgttcactaatttgagacatatactattttccataaagaagatctgagtgaatggataaagatagccaaaacaagcctgtttaaatttgaccttgaccccattttcttcgtgacctctagcaattctcagaggagcaaacttcaaagggtttcaacagtctgctcttcccatgcatacaagtttctgcttgtaattgatttgggctgaatagattttgaacacaattgatttgcttgaaataacattaaaggaccaagcactgagcaattcaggtgcaactcatgcacacttctgagtcaagttcaaataaattggatttgaccttaaccactgtcccctcaaaaaaagggctggcagtcatcagaatgaatgccatccaatcaagtataaaaactggtatgagtggtttggatcagaaattgatctccatacacaagaccttcttttgaaaacttgtaatgagcttctgttttcctgttttaccagctgtaaactgaggaaagaaacattgactgctgcctcccagtggcagttggaggattaatgagctaatatttataaagtgctttgaagataaaggtgccagctattattattactaataaaccattttttctgcagtgtaattttggacagcaggccttaaaaacccattactgtatttaacagtaaaacaatctgccacagcctagtatttactgcctcaattaagcatgcattccacttcctttgcccctccaaattcagaactggtgaggagagacagaaaggagtgtgtcatcatttcccaagttcattgaaatattaggtttgggttgtttgattgtctcggcagaaagctagactatatcctcagtgggagactagttgagctacacttttgtttctgtgccttatgaagggagtggaaggcttggttctaggcctttattcaaccagatttacattgtggtttattatctttgaagattgcattccagtatccgttttggttatttgaatatggtaccattaatgaaactggtttatttgggtggttttatgtgtgtacctgcgtgagggtggggttcacaactaactcctaaaaccgaagtggaaaatggaggtaattctgcagctatcccatgtccaaaagtattaaaaaataaaactggagaccttgaattatacaggatagtttcttagttagtaattactgttatcattatatgatattaaatcctttcaatctgatttattttgatctatatagatgtcctaaaatatcagatggtacagggtagtgtaaatatttctcacgtattgccaaaacaatgcttattttcctctgatgctatttcagtactgcaaataaaagtaaaaaaatataaagttaataaatgactataatgagatgtctcagctttcaacagctacttcaggtattcaaatgctaggccaatatctaaaagttgaacaaaagaagcctcaaagcaacctagatctctttcttggcaaaaattcactaaaatgtaaacacttgattatggaaagatcttcctaattcagtgactatttgctcttaatttagaaccattctaatatgcataattatattatttcagcagatgacaaagtataaactgcaagttggagcagatgagggaaattttgcaaattcattctaagacaaaataagttacatttaatatatttcttccgcaagagagagggatagaaagactagaaaaagacaactcagaaatgactatatgggtgatcttgagtcattaagaaattattttaaaataaaaaataaattgacataccacctataggagttcagatcatttatctgaaaatcttatggaaccaatccttcctagtggtctagttgttcaataatgttaaatacaaattcttaacagaaccctaatcttttttttgtcattattatacttcaagttttagggtacatgtgcacaacgtgcaggtttgttacatatgtatacatgtgccatgttggtgtgctgcacccattaactcgtcgtttacattaagtacatctcctaatgttagctcccctccgctgccaccccacgacaggccccgtgtgtgatgttccccaccctgtgtccaagtgttctcattgaacagaacccaaatcttttaaacggtttcttttacaagcaatgcactaataatgatccaaggtaggtgccgttgtttacagataggattttgtattgcccattccaagtttgccacagagtatactttttattactatcacttagggagactgtttggtaaataccatcaccattccattgacttttgaagttgagctcatgctattttcatcatttgttttgtttaattgtgtatggggaattcaccatatggcttaaaactgtttaagacctcaatagatatgtgttttgcatatgagattcttggggtatctgtagggatatacacaagctgtttgttattaggaagaaaagtacctgaaagcttgtgtgtagctaaggggagaaatgatgaaaaatattctgaatgtagcaaagtaacaatttgtgtaaaatgtgaaggcacatttttccacttacctatcactgaatgacaaactaactcatacctttaaacagtaacttcaaacaacagacattttatgaaatctcatgaattgtaggtgaggaatttaggcagggctccgctgggtgatttcttctgccccatttggtgacaactgaggtaatatggtggtatctcagagagtggctggggtgggctggtggccccaggatggcttccctcacatgacccatgcaatggcaaggagggctgagctcagctgggcccctctttctgtccaagtagtcacagggcctctctcctggtccttccagaaatgtcactggacttttcacacagtgactcagggctttaaaaatctaacttggaaacttaaaggctagtcctcagaccgttcagattcaaaggaaactctcatccaacttctagcagacaaggtagcaagaaatacaaattaagaaagacatgctaattaacagaattattaaacccattgtgatacaccattcactcaccatgtgactgcttacaaagagggaaaaaatatggagccctctgttccaagggaacactcctttccccctcccgacacttcctagagatcttagacccacatgactgtgagaaagaagagtgatgtgagagtgaactttggcaaggctgaagtgccctggttttgtctggagcgagaataaaagtgagaggaaggaggcgtccagttggctgagaatactgttggctaagattctttagcagggtgggcttttcggatgcttttctcctctgatctatttaggtttatccttactcttttccatttatctgggaagtgacttgggtttaagagaaccaggagtatcttagcagagtcaaaagggccacggtgaaccccaaatgtcaggaaacaaggaactgactagattactcaaggcttcactcttgaggagggagagaaaagagctcctgcatttccttctatttattgattacagccacaaatggaaaaggaagcaggctttctgccctgaaataatgatgatacatcgggctgcagagctcctatacctataactctcaaaagcaaatggaaaggagactagcgtgtggctagtaccattattctcacatcttcctgcagtgttatgagagcacagagtaggatgcagggtgaggatagacagcagtagagctttcttgagctgcttattcctctccaaattctctctgaaagtggatgaagaactgctgccatgtctggtgtgggttcaatttgtgctctcattgcttctacttctctgtttctccagatcctaccatcacgttcttccttctgtggcttagccatttttctctccacgcttaggaaccatacatactatcattcttctacctctgaagcattatcccatccttctgacaaacatgagtagatgttttcccctcacagtcttgccaaaaagcacttataaagtattgcaccgtagttttcatatttcaaaaacacttcaacaggcaaaatgcgatatacacaaccccaaaatgctgtgctatgatgaatttagttctgtattggtaatactataaattgcttttgaatgaaagatacaatgtctatatattatttaatttgatacttgcagtaactagctatttaagcaagataggtatcagtcctctttagcgaagttcagtggaaccaatggaacaaacgtgtgggagtggaactggaactcggatgtctgattttgtcttaagttattttaatgacaagtcatttagccaccgataaaaagttacttattcagaaaattcaatcttctggacaagttttatttttacatgacataacctaaaatgttatatatgttaaattctgccgttttagatttcaggaaaacaaatgcagagtggtagaggctggtggtgagaatgagctgagaagggtggtaataaactgaggtttctacaacgagtttgcattaaaaaaaacttgttgggggttctggaacccaatcaattctcagatgtttccatagtctatttttatatagcataatacatttttattatgatcaggcaataaagcaagactgttcaccagtcttgctttagccatttaccatttcctatactctatgtatgtcctttgtctgcttttacactaccataaagcctgcttcaactttcccctcaatacactgagatttatttcttcactcaccattctggaaaattccttgttcagccttctaatcactagacacctgcaacctttccttcactggatttctgcctcgaacagtcactcttctccactaagatctacatgtcaccgctaaaatcccctttcttgcttgtcactttgaccatgatgtcacttacttcctgaaaatttcccctggctccctactgctttgcaggccaagtaactgtcacatttcgtttccactttcagctggagtcagccttcattattcccctctccgtccctgtatccttagagaccctctcctttgactcaacagctcactgctcttgtcttctcaaagctcctgtcttttcacacacagttcctgctgtcttttcttcttaaaacaaccagccattcgacagtctccaattctctgagaagacattcccctaaactcaccatcttcaatacttgtgtcatatctttgtgccaaattctaattcacttaagattttaactggcttactaacaaaatatactaacttaaaatgaaggttttatttattaccttaaatgaaacaccagtgtcaacggcaaacaatgaaaagtaagagcaaacgttactatgatgaaagcaacttgaagtcattgcattttaggtagatatttgtgcctgccccagactctgggcttgaaccctgctctgtcttataaaatagggagattagaaaagttaaattgttattaatgttctattaacacctacttgagactttcaactttttatagtaagaagaattgaaaaataattcacagagaattgattcccatgatgcgttcacctatgtcctgctcagaacacatctaggatcatttcagcgctgatagactgttcaaggagatgcagcctaactcaagaaaaattcatcatgctcctcctctttccttctccagttttgttcccacatatgaacattaaatgaaaatttatgaagttcctgctgagtgaaaatcactgctggataggtgaattccaagatgaaatagatagactttctggcctgaagttgcttactgttaccactgaatatatgcccataaaatattaaaatagacctaaatgccttttctgaggtctggaactctcaaagtgttgtgagcctccaatctaattaaagaactcactcaagtataatgcaaaatagaggatgaaaaatgccatacgaatgtatagataatgttttatgggagattagaatagagaaagattatttccagcttgtgcactgttaaaagtcattaggaaagaggtagaatttggaaagcaaagaagagattgcattgcaaagaagacattcaattgcaatgattatttctctgaagcaaaataagtgttcaagcccaatttaatgagcaattaatttttagcaatattttccacatgttcataatctagtaccatttgaaaaaactttctgatgtgaaaaaaatgtgatttaaatacctgtctcaagttctgaaaggcttcctcacatattataaaacaggagccctccctaatttgagtcaggttagagaaagccaaacataggtggaatatggatacctttactacaactacatttggggagtcaacctaatgcttgcttaatcgcttcacagaaagattgaggaaggcagtgatatccagtatcatcatagggctctttggtgccaataatctattgaggtgcttttcgattgtgagacgaccaagaaattagctgatcccagcagaaaaacagagctccttccttacttttcagctgcgttaatttcttctctacgtttcagagtactgctaattccatccactgatcccttctagggcctggttttcagtcctaggcactcaggtaaggctattctctagacacaatatgcatgtgaaacaaaaaaagagaaaagtaataatgacttcaaatattaggatctgactatgaaatatcagatcttttaactcttgtattcatgtaaccttcctacatttttcaagtgaaaatatttcctacattttttaagagacatcagtgttacgtgctacgttatcaatattattttcttattggccatggaaatgcttaaataattgacttgacttgttaaatctattttatacattgcattttaattacatttataattttaagaaacttcactttttagaaagatatagacatgaatacccttggtattaattagtagtagatgtccttacttctgatagcccttacataatgtatccctctctatgagtgctgtagatttttcacttatatctacaaatacagaagatataacttattaaaagttcaataggaataagtcctcatgttatgagagagtataaagcaatagttagagtgatgtgaaatattataactctgtcttctggaattattccttgaaaagattaattatgtatgcctaatgagataacagtgacaaggtataatttagagattataaagctgagaattgaaatgcctagcatgtgcacgtgcacacacacacacacacacacacacacgtaactgctcttttgcaaatcttcatcacatcaattgtgttgaatccattctcttaggctatacattctcatgctagcaaaatgaaaacttgaaagtaatatgttgaagagatactatgttgaagagattcccatgttgattgcagcattatttacaatagccaagatatagaatcaacctaagtgtccatcaacagatgaataaagaaaatgtggtgtatatatacacaattgaatagtactcagccataataagaatgaaatcctgtcattgtggtaacatggatgaatctagaggacaatatgctaagtgaaataagcaaggcacagaaagactaatatcccacgttctcactcatttgtggagtctgaaaaagctgatgtcacaaaagtacagagttattagtgactccggaatgtatcaaggaggggaggataggaagagattggtcaatgacataaaattacaattagacaggagaaataagttctggtgttctatagcatagttgggtgactatagtaaacagtattatagtttgtatttccaaataactagaagagaggatcctgagttctcaccacaaagaaataatgtttcaggagacggatatgcgaaagccaatgtacacatgtatccaatcattatgatgtactccatagatgtgtgtacttattgtgtatcaattaaaaacacaattcaaaaattgtcatgggtttgctctttttttttgcattacaaagtgacatctatttcttgactacatgctaggtgattaattataaaatggctctgtgcattgaagcatctctttcaagagctttacaacctgacttttgggaaagatacattgtatcttttgaatgattcaatagtgaaatttatttctgagtttaccattttgtgatttctgaattttttcactttcagcatttccactagtgttttatttactggttccacaaatcagtcagtttcatcaaatttgccaactgcaagcctaaaccattggaaattggcataatgaatgttctgagtgagaatatatatgttattaggaatattttaaatataagaaaatgtgatacaaacctggctgccaaaatatggcaaaaatgtaaacaaaaattgatgtgtaaaaaataccactgtatttaaaagggataaaactaatcagatagtattttaaagctgatgtcttgatggcacaattttaaattgaagtgctatgggggatattgtcttactggtatttgcagtttgggctcaaaaaaccagaaactatatctttaagggtgtttaacagaataattctaaatattatagttttctctttcctttttgttgtcctgtgattttaactttgacattcttatgtgacaattgaaaaagtctcttcacttttgtgtattctttctaatgtgatcaggagaattaaaatgaacattttctttcataaagctgagagttaattctgaaacgttgtaccagaatacttttatgaatgaaagactagcctttgaaccctaggagagtcaactctacaccaaccctgtctattaaaaaaagtctgtgcttacagatgtcttgtgtgagatgtggctttaccaaaagtatctgaacttcaaatttctcctatcactgccaactacccatgggtattggcaatatatttggtagacttatttcttctgtaggcatatgatgccatggccaaagtgaactctacatttttaagagaggctgctaaatatggccaatcacaacagaaaactagcatttctccaatttggcagtggtttctggatggcacacccagacttacttccttaagcaatgctgatatatggaaatgccatgatagaggctcagaagctaacactgaattcagcagtgcagaaaaactccaaatcatgtggttcttctttgtcaatattttcactaaggcagcataagatattaaatcacctggaattagttatgtgccatttcagcaaccttttgtgctcagtctgctacaagctgcttgtgctgattagcagtttaaaagtctgcaggggaaggaaattttcagtagcttgattttcccccaccctttggtcctgtgtgcattggggaagaaattaccttctgtgcaattcctgaataatttggtttgattattaatagattcatgctgaaaaaagaacaataacagaaaaaaaattacccatggggttgcagctgtgctcccagatacaaaacagggaaagaaaacaggtctctccaagcaaagggtatatgtgtatacgtgtgtgtgcatgtgtagctctgattctaagaagccattggttcatttattcatgcatcaaatatttattgagctgcgaacaaatcccaggcactgtgaggaagacagatttcctgccctcccagagttgccattactaagaatgttagccaataaataaatctttacgggaaagaaacaaaggactgtgatagaaaaaaatgggaggagaaacttactttagaaaggattatctgagaaggtgcctttcacgctgagccagaaagggaagaaggcaaacaggaaaagagccagaagagcagagttcccagcagaggggaagcaagtggagaggcggtgtggaggaatcaatttggccccatctggaatggacagaaggctagaacctgcagtgcagtgagtgtgggagaaaccagctggcacaaggtgagcttagggcagatcacataaggccttgtaggtcatggacaacaatatggatttaagtgcagtataggaacttcaaaggaattccaacagttaagctagttgatgtaatttgtgtctatatgtatatatatttatatatacaaacaaaacaaaccttggctgttgcatgcagagtagattgcaatggagaggaggaccagttggtattccgcaagggagataagaacagcttaggcttgaatgaggatgtgataaaggggattttatgagcaaggctgttttattattttatttattgtacttctattaagatgatatgggtgctttgggggctgttgtaaattataacccacagcccctgcacaggaaacctccacaggaaacaatcaaagaataagtggttgtgagatgacaaggtttacgatacgtgttttcaggcttcttaatagcagagtgattgggtgatttccaaaagacctcagggctgggatgggtgaaattttgtgagcttctggattggatgagggtgtgctcttgcagaaagaattcctgaatactttctgcactgacagaacctgcttattaattcttacagcagttatgttttagaagatgaaagaccctttccattcaattattgatcataagcatgatgtgtgttgattaaaatggcatgataatggtatcaaatggagtttggatatctttttccttaatatacttttgtgtatcatatttaagtttcctcaagtcagtagagaagatgttacccacatcctcttttccaaagaaggaatcatttgatcattgaaaggtttactgaatagaaaataaattatgttgactttagcacaaattcctgccctaagttttagcccatatattgatgatgtcaagtgctgctaaatgtgttcttcttctataaaaattaaagtttaagctttggatgctaactttcaaatctatgtgaaatgatatgatttattgtgatataaagaatgacataaagaacaaaataatacttttttaaatttatgaggaaaaagacaacagaaaggaaaaatgggcaaagaaagagaacacgtttcatgcaaatcaaaaccacaatgagataccatttcgcaccggtcagaatggttataattgaaaagtcaaaaagtaggccgggcgcactggctcacacctgtaatcccagcactttgggaggccaagacgggcggatcacgaggtcaggagatcgagaccgtcctggctaacacggtgaaaccccgtcagtaaataaaaaatacaaaaaaattagctgggcatggtggcgggcacctgtagtcccagctactccagaggctgaggcaggagaatggcatgaacccgggaggtggagcttgcagtgagccgagatcatgccactgcactccagcctgggcgacagagtgagactctgtcaaaaaaaaaaaggtcaaaaaataaaagatgcaggtgaggttgtgtggagaaaaaggaagagaaagtacactgttagcgggggtgtaaattaggtcaaccgttgtagaagacagtgtggtgactcctcaaagacctgaagacagaaataccattcaatcctgcaatcccattactatatatattcccaaaggaatataaatttttacattatgttaaaaagacacattcatatgtatgttcattgcagcactattcacaatagcaaagacataaaatcaacctaaatgcccatcaatgacatcaataacagactggataaaggaaatgtagtacatatgcaccatggactattatgcagccattaaaaaagaatgagatcatgtcctttgcatggacatggatggagctggaggctattatccttagcaaactaatgcaggacctaatgcaggaaaaccaaatactgcatgttctcacttataagtggaagctaagtgatgagaaaacatgaacacttagaggagaacaacacacactggggcctacttgaaggtggagggtgggaggagggagaggatcagaaaaattaactaatgggaactaggcttaatgaaatagtctgtacaacaaacccacatgacacaggtttacctgtgtaacaaactggcacatgtacccctgaacttaaaatgaaagttttttaaaaaagagaacacatttcagaaaaaaactcaaatggccaaaatacatactaagatagacaacctcatgaatagtcaggggaatgcacattgaaatcacagtgaaacaattgttcatctacatcattgaataatacttagtatctaaaagggatggactactgatatatgcaacaaaataaatgactcttaaaagcattatgctaggtgaaagaaagttacatactgtgggatttcatttatacgatattttggaaaaggtgaaattgaagggatagcaatagaatcattgtttttaaagactggggagggtggttgacgactgacatgatgggaatactgtgtgctgattgtggtggtattaataccccatctacctttgtcaatattcattgaattgtacctttacaaatttggttattgtgatgtatgtaaattaaaccttcaatgatctgattttaaacattacagtgaagtcaggagtggtggtatgcacctgtagttccagctactcaggaggctgaggtggaaggatctcttgagcctggaaattcgaggctgtagcatgggtgtccaaccttttgactaccctgggccacattggaagaagaagaattgtcttgagccacacataaaatacactaacactaacgatagctgatgagttgttttttttttaaaaaaaggtccatgcataatttttgtgatatctgtcatgccaccacagatatcaaagaagtcctcacattcaaaggattttacacctatgcatgtagaatgctataattgcacctgtgagtagccactgcactccagcttgggcaacatagtgagatcccatcacaaaaaagactcacaatgagaaaatgttatcatttattagactacaacaatgaaaatatgtagtacagaatcttgtgaaggtgttaggaaatgagaacgctcatgctctgttggtgtgagtggacagtggcataacctccttttagaggaggaatttcacatcagctagtaaagttgaacatgttttaacccacaccttcgaaagtctgataaacatttacaatcaattgtctctgaagcctactacctggaggcctcatctggatagaaccttggtctccacaaccatccttatcttaaccaagacactcccttctatcgattccaggtctttagataaactccttggactagttgccaattagaaaatctttgaatccacctatgacctgaaatcccacactcacccactttgagttgtctcacctttccagaatgaaccaatgtacatgtttcatgcatttattgatgtcttatttctccttaaaatggataaaaccaagctgtagcccgaccaccttgggcacgtgttctcaggatctcctgaagctgtgtcatgggccatggtcactcgtgtggctcggaataaatctcatcaaatattttacagaatttgactcttttcattgacactaatcatcattgtaaaattaagactatagtaatcagtgcattttgagccctcagttgttcaagtactatcacagaagatcgatatcaacttttgtttcagctccagattaaaaggtgagcctattagagtgtttatgtgtagcagaccctacacttattcaaagaatcatttgcttagatctaagagaaatctcatcccttttacttttaatatcatggtccttgtgaaagaccagacaaaaagtcaacccagttagttccttaaaagaggaaaagtagagggaattcgcatgagcaacacctcagtacttaacagtcattcaaggacttatgcatcaacagtacttggcatttcatgtaatccttccaatgttcttatcagttctgtgtgttcttaccattgaaatatagatgtgcacaccattgaaaagtttaaatcattaatttagtattaagttaacaagaacatagatgctacacctaaacttatccaagatattaatccattgtgccttagtactttattgactcaatttataaaaatattgtatgtgttcagtaaaaatataactacatttaagacataagtttgattttatgacttaggtttctgtaagaagcagcatacttttaactcaggcttatgaatataatatcacttcatctccttacaaagtaattagaataaaggcagcatatattttgtatgaactaaaaagaagtacaaaatattggtccccaaaattaaaatgtaagttcttaactacacatttctatgctatattacttgtattagtttcccattatggtaataaccaagttcctcaaatttagtggcttaaaccaacatacctttttctgttagagatctgaagtttagaagtcctaaaatcaaggtggcagcagggctgtacctttctagaagctctaggggagaatctgtttacttgccttttttttagcttctagaggccacttgcactctagctcacggtcctgttggagctcaggggaagctgccctcttgcccttggatggtttgctgaaaaatgaagccacaataaggcatgttaataagaagaaagcataaaatttatttacccatatgcatgtggagaatcacagagtgattacctaattacccaatcaaacccaaacacttatataacctcctttcagaagagcgggggtagatgggaaatataggtaattcctttgacggacattacatgattactagggaaaagtaaatggatccttgggaaaacgaatagatggacttgtaaatgatttggaagttgaatgaacttcagagacaggcactattttgtagaaaggctgtgccagttctgaatacattctttcactcctgtcttgaaatagataatgagataacagggaagggaaggaaaaacaattttttttttggtggatccatcctatttttatgaagatggggaaaagtctcttctaacgcatattgatttctaagggattttaattcaaagtattcattacttccagggaatcatattttggggtgaaattctctgtgtttttttagtgccatccttcatttttatagccagcagtatagcatcttccaattttcctttctttctgggctctgtcctcaaaacatcttttcagattctgaccctccagcttctcttgtgtaaagacacttgttatacattggcccacccacataatccaggacaatatctccctctcaaaatcctgaatcaccttacatttgcaaagtcctatttccaatgtaaggtaatattctcaggtcctagcaactaggacacgaacatctttggggttattattttaatcagttgctccaccctttaaactcttttctggttgatatatccataaaattaagtgacattcgggtgaagtgtcatcacccatcactatccctatctgatataaaacaatgatacttaagtgaagtgttataggaatacaaatttgcactatgaagttaatattagaagataaacatcctctaaatattatcttatggaggtaagatgacttttgtgtgaggactataccatcttttattcttggagtaatttactattcagaatgtggtcagttttggcacgttgtcagaactgcaactgtgtaaggaataaagaataagacctatctcagaaggttgttgcaattattaaataaattattattttggcatatagacttgctatgtatttactgcagttgttaatattagatccatgtgaactatcaaaaattgtattataattgtccaacaggttcttcttgcccactgcatggatagggcaaattcactgagacagcggtattacagtagagaaagagtttaataattgcaggcccagtgaagcagaaggactggatttattattactcagatcagcatctctgaaagctcagaggctaaggtttttccaggatagtttggtaggcagggggctagggaatgggaaatgctgataggttggggcagggatgaaatcataggggtcaaagctgtcttcttacatgaagtcacttcttgggtgggagctccaggactggttgaattagttccttggtatgagtcacagatcctggtggagtcagctggcctgcccaaatgcaagagtctgaaaaatacctcaaagactaatcttaggttttcacaataatgatgttacctataggagcaattgggaaggttacaaatcttgtaacctctggcacaatggctggttattgtttaactgtacctacatcctaatagagttcaggcccctcccataatcctagtcttgtggccttttattacttttacaaaggtggttttggtccctgaacaaggagggagtagtttggggaagggctatttttatccttgttttaaagttaaactataaactaaatttctcccaaagatagcttggcctatgtcgaggaatgaccaaggacagcttggagttgagaagcaagatggagtcagctatgtcagatttctctttgatatagtttgaatatatatctccgccaaatctaatgttgaaatgtaatccccagtgttcgagattaggcctggtaggagaggtgtttgggtcatgggaacagatcccgtatggcctggtgctgtcctcgtgatatagagtgagtactcatgagatctggttgtttaaaagtaggtggctcctccccaactaagtctctctctagcttctccttccaccatatggtgtgcctgctccaactttgccttctaccacgagtaaaaactccctaatgctcacccagaagccaagcagatgccagtgccatgcttgtacagcttgaagaagcatgagccagtgaaaactcttttctttacaaattacccggtctcaggtatttctttatagcaatgcaagaatggcctaatacatttattgtcataattttgcaaacgtagcttccctgttggctacatcaaattgagggtttgctaggatagaaaagtggaaaatatcaattaaacaactcagagccgggtgcagtggctcacgcctgtaatcccagctactcaggaggctgaggcgtgcagatcacctaaggtcgagagttcaagaccagcctggccaacatggtgacaccccatctctactaaaaacagaaaaattagccaggtgtggtggctcacgcctgtaatcccagctactcaggaggccgggcgggagaacacttgaactcaggaggcagaggctgcagtaagccaagatctcgccactgcactccagcctgagtgacagagtgagactctatctcaaaaagaactcaaaaagattgtgttaggtacttacagactagaagattatgttaatgaatcttttattcattcaacatataattattgcccactgagtatgtaacacgttttctgttatgtttagaaataattatgagcaactcagaatgatctccaccctcagagagtgtacagtctacctcagtatgtagatgattaatagacaaacaataagtgttgaatgttgcacaaactgtcctttatttgatccttagagttatatagcatatttaaacattttgaagtttgaaaatgcatacaaattagagagacatccaataaggtaggacttgggttaatgtttactttcctcaagcacgagaatagtatgtgagaattaagaattaattgttaaaacacatctttatatttctttatgagacaactcttgaagcaaaagtgaaagctggctcaaacacagttcaattacacagacgtatacacacacttatagtcacacacacacacaaaaccaccactgtccaggaactaaacaataattgtactcttctagatatgtaaaatcaagcgaggaacagttaagaataggttatggccaagcgtggtggctcacgcctgtaatcccagcactttgggaggctgaggtgggcagatcacgaggtcaggagattgaggccatcctggctaactctgtgaaaacccgtctctactaaaaattcaaaaaattagccaggtgtggtggcaggcacctgtagtcccagctactcggggggctgaggcaggagaatcacttgaacctgggaggcggagcttgcagtgagccgagatagcaccagtgcacttcagcccgggagacagaatgagactctgtctaaaaaaaagagacacgttaatcttaactttttttgagagagtctcgttccgtcgcccaggagagagtgcggaggcacgatctcagctcactgcaacctccaccgtcaggttcaagtgattctcgtgcctcagcctcctgagtagctgggactacaggcatgcaccactatgcccagctaattttttatatttttagtagagacggggttttaccatgttggccacgctaatgttgagctcctggtgtcatgtgatccgcctgcttcggcctcccaaagtgcggatcccaaagtaggattacaggcatgagccaccatgccaggctgaaaattctgtattctattatatattatataatagaatattttatatatatatacttatatattatataatatataattatacacacatatatattttttaattttattattattattattttttctgagacggagttttgctctgtcgcccaggctggggtgcaatggcgtgatctggggtcactgcatcaccgcaacctccaactcccggattcaatcgattctcctgcttcagcctcccgagtggctgggattacaagcgcacaccacgcccagctaattcttgtatttttagtagagacagggtttcaccatgttggccagactgttcttgaactcctgacctcagcagatccacctgccttgacctcccaaagtgctgagattacaggcgtaagccaccgcgcccgacctgtagtacctatattttttatttttctccaatcttttaatcttttaatcattctccaaaatgttgcctttcttctcaatgcttagcagacaatttgataaacaaggatccttttctaagtagacttcatataggagagttttcaaaacagaataagaagggcatattattccttgtcaaaatattttcttgttgaaaatggaaagtttttgctaaaagctgaaatgcatggcagattaatttatgcctattacttcaggtaaataatttcaccaggagtcttcataggtaaaatgaatgtttatgcttgataaaaaagtagcagttgttgatttcaacaggtttaagaagcgtaaatgttgtccacctcttctttccatcccatgcacatcttacttttactctagtaactaccacccatgaatgtccatctattaaacccaagcagagagtagtttttaaaatattcctttcctgttttctgttgaactattttatagacaagctatataaaaaagaaacacaaggaacaaaaaatgatatcttattctagtgaaggaaatccaaagttggggtctagaatacaaatacacctgtgtgcaagctccagtgatgccagttcctagtactggagagcattgtgactctgagcaaaagagggaagacaaacatatgaacagaaaacctcgtcttttctcaaacatcctcaatgactgttacatgaaaatgaggactatcaggctcatatcattttcaaagacaataggtgatatgcatgtggagaacaaatacaaaaggcatgcatagaaatcaaaagtgattaaaaatagtctgaattctggagacaatagcatgtgtggacggacagatgctacagatttaatgctgacatatcagagatgaaatgtcagctttctttattaccagtagctctcagcttttcaggcaaatcgttctttgtactctacgttctttctccttatggagttccttcttgatgcctcttcctacttcttcacatctttctactccttgagatacctgcactcattgcttgcacttctgttagtgattttgttacagtattgtgctgtgtgtttccaggagtggagccaaagtgaaggaagcccagaaatgcctgtcaagggagactatgagatgataacagcactcgtctttttccttgtgcttcttgcagttaacacccacatctatctatccatctatttgtgtatctctgtgtctgtctgtctgactatcgatctatccatcacccattcatctactcatttattttggcatacagcttttcgatagaggcaaacactgcctaatggaattgatctacaacaagaccatagctggagtgaaagaaccaggactcagaagttaaaaccaaagttaatgttattggaatgtatagtcttaaaaacaatatgttttttaaggacaattttaattcaattaagtgtgcaatgaaaacacaggggaatgtttgaagaatcttttatcttttacccaggtgatgtgcttttcgacaggattacatttagtctaagaggtagaaaaacgtcaccaacgacaccttaaaggcttaccccaaccaccagaaaaatatttgtactatttccttcttaaactttgcacaactttttatgtagatattaagtgttcaaggggatccctgcacatggatgaagtcatgtttgcatacactcagtgtaaatatgtgtacacacacacacacacacacacacagcaggggaaatatttctcaaatgactacacttaggttactttccatctctatttattttcttctgtggaataatgcagactagaactaacataaattgaatgctcatgagaccacacatcttcacatggtatagagtgtgttatcgcagcaattttataatggctcattaacccctgtgagaggccagtaatatgggatagcaacggatttctatcaactccatgagggagataagtaaggtggcatcttatgtagatttctaaatcctctactttgaaatcagctcaatggcatattttaaactcaaaatagaatgtcttctggttcctaatggttgatttaatggtggatttgaccatatgtgtatcagatgtaaaaagtattgtccactaagtggagtaaaaaatgatcttttacagaaggaaaaaaaaactgatttaaatctttagattctcatgggatctcattaaggttctctttctttaatacattgtgcagcctaatagttatcagcagccctgcggtgtgcattgctgataggttagtttacacaggattaattgtgtaattttgcaagcaaccagcacagtgaacactgatttttgcattagccccatgtgttgtttccaaggggactctgctttctattttaaggtggtgttacatttcacttcttattaattataatttctgctagcatgttttatgcccaatatgatttattaaaaatccttcataatgtttttttcctaattgttatgtccttcggtaacttcattaattttgagcactgatgtgtaaaaaatggcaggagaaaatggcattcacagaaggttctctgaccagccagtttccccatgcccccgttgataagttgccacaaatcttttgctaaaatacagacacaaattcagttgcagccactccaggtatgcgaagtgaataatcagtgcaggcaacaacctgacaatactacattcctcaaaccaaaagaatgcgaatgttcaaagaagtgttggctaagcagaactcagtccattttccacaatacgtagcttagtattttccagaaatacttgtgtattcggaagaattagaggaaggaaacttttgtttgaattttccacataatagcttagttcaatactcagctactacattttatcgactcttggtgggattatgaaatgcctattgaggtttcagtggaatctttatagctggacttgatattcttttacatggttttgaaaaaacaaaacaaaacaaaatgttgactgtgcacagtttagaacttaatctttaaattctttttgccttgaacttgaaaatcaattatctgtctgtgccccaccacctcttccctcatctcagccttcacgagataaaatttctctccctccggagcacatggtctctcaaaggggaagagtcacatctccttgtctgtgcagctgttgcttcgttttgtttagggtggatcttctctccttatccccgtgagtttctatagtattataaaggcccaataaggttctgtacaaagtgggtacttaaaatgtgtcctgagtgacaaactggcccccactggaagaactctttaaaacactctgttaccagagcttcaaaaagggcttgtttctgaaggatcaaaggatctcttgtataataaattctgagcattcagtacataatgaagagaagaaaacatgtcttttaagctcctatatgatgcctggattatgtgaagagatgaaggaagtggtgactctttctggcttttgtgtcattcacattaaacaggaatagatgaaagcaaaggcttaacactgacaaaatcccaagtaggcaggctctgcatccacagcctgttcacacattcataacaaaccaccagctgatgacttgaaaaaaatatgattttctttctagtgaaagactgactttgttttgtgttttgtgccttttttaaacatctaccttcagaaagtataaaccttttttttttttgacagagtgattgggttacaatattgttacagaaggactagaattagaatcacaatacttgggtgccacacttgacctttgtcacttgttatgtatgacactaaggaagtaatttagtctgtaaattaattttatttttcatcatttataaataaacctagtaaaatgaacatgaatagttgtttcaagggtttaatttaaaaatcatttttgtattgtggtaaaatgtagactcttatattcttataggcagattgcaataaaactctactaagcaattacactagattttatttctctaaattaaggctgaacaatctcttttttcagttccactttgtctgagtagtttgaatggcccagatcagagatgatttttgagactgttgttattgtgtttgatagattgtgctcatgaaggcacgtgcatatttatggagaaagaatccttagctttccccagatgctcacatgtgtttgtgatcctaatggggttaagaacccttaacctgataatctcaaccaattttcctttcacattaagtgggagtcctactattttagtattaagtaccagaagggtgaattttatatgttactttatatttactatcggttttgtctaacaggaattttgtgcagtaaaatatctacctttcaaattccctgggaggagaaagacaatgcatactggagatatgaacacttttccacaatacttataaaaaataaaaataattaccttggtgatttcccataattaaggcagatttttttccttcctccttcctctcctctcttttttacgttaacaccaccaccctcatcattaccactgccacttttctctcttccccttgaacagagtagataattgcatatgtacaatttcctagagaactgaagcaggcttagcccatagttgaactaagtttcaaagtttgcaaagtaagactggattaactatattttctgctaagtgttggttttaataaaaaaagaagtttatattcattgaaattttcagttgggagtacatgttttaaaaccttatttcttccttttttttttttttttttttgagatggagtctcattctgtcacccaggctggagtgcagtggcacaatcctggtttattgcaacttctgcctcctggttcaagcaattctcctgcctcagcctcctgagtagctgggattacaggtgcctgccaccatgcctggctaatttttgtatttttagtagagacggggtttcaccatgttggctaggctggtctcaaactcctgacctctggtgatccaccctccttggcctctcaaagtgctgggattacaggcatgaactaccacacccagcctagaccttatttcttaatctctgaatgtgtttggtgtgacactcaactatactttcagcttacctagcccaatataaattttattttaatgaatggtttccaacattttgactctcctcatgttaaaaaatctctggatttccttatatttgatttctgtacttatcagtatttggcaggaagacaagtcatggcaacaactgatggctgacgagacgttatgcttggaattcgtatattcatctccttaactgagaaggttttggtgtctaccattactgacctcactgtgaggaggcaccggagaatcatgatctcattctgtgtattggcatgtcattacacattattaatttggtcttttgagtgacacaactgtttttgtatatcggtgtgtttgtgcactgtccctggagctctttgtactaagttatttttatttcattttcattaacaatattttgggaattgtcattgaatttgtaccttttctaccttgcactttacaataattagcatattattatagtaaattagaagtttaataattaaggtaacatttagatcctgtcaataactatagcctactttattttttgaacgttttactatgcccctttgtaacagttttaggttttttaaagagtcattagagtcacttatttatgctctgctgattagctatttattttcacagttttacaagttagatgttcgtacttagatattttttacagatcgaagtttctatttgctcatgagtagctataaaataataattatcattaggttagatattttctgtgttacagtttgccatttatatattctcattgccaccctgtgagtgaaatgaatcagaggttgttagctccagttaaaaaaaaaatgaagaaagagaccttcagagaggttggctaaatggcttgctagtaagtgcctgagatggtgctgttctgttcatttaactttacattttagtctagaattttctctgttactccacttccttttctactcaaagacctttttataaaagaaaccagggagcacttaaaatttgttctctaagtttagagctggactcaaaccattactggcaaaatcaatctggtcctttctttcctccttttttttttttctttctctcataatgaatcaagacatccagcatccttgaaaccttaaaggtatctgaggatacaaagataccaaactggagttatcttcctgacacataaatctgatcttgtcatttcttactacaaatccacgatggtcttttacaagataaagtttaattatctgagcatgacacctagggctcttcacattctgtgcgatccaacttttcagcctcgtctctttttattatctattgcttgcccttatacacctcatcttcagcctccaaaatttcatgtatcttcttgactgtgccctgctcttttaggtttctgagttgcctctcttgcttttctataccagcccccaaccccaacaggaatgccattctttcatttgtagcttgctaaactgggtcacttacctaaccaaataactatgtggctttggagaaaatactgtttttatttcttagcttgtttattttgatgtaaaaaaatgtaacgcatgatcattaaaaatatatctattacattaagtcatcttcaatttctgcttaccactttcttcccataaacaatggtagcaagttgatgtttttctttctaatgttatttctcatgtagacattgatacatagtatttttcataagagcaaaattaagctcacattctataaaaaattttgtagtgctttatttcacctaatattatacaaagtctcagcattcaatattctttaaaaacacaactttttaaaattataaacttttctaatacataactatattctacatatttaattatttctctattattgggcacttaggttgtcacccaaattttattgttataaattacactcagtaaagatttttccattggtagttggtgatatattaatatgtttaatccaaacttagttagatttctagatctgggcatactggccaaatgaacataaaaatctatgttagaatatttaaagaagtcaaaatgctcataatattatgtagagataaatagcatatcatttttacgtatgtaatgtattcatacacatatctgtatgtgtgtatatgagtgtagctatagcactgggtgaatattaatatatcaattgaggaaggaaatacactaaaatattattttacagatgatgtccattttattaggtatatgtgtgtgtgtgtatatatatatatatgtatatatgtatgtatgtatacatatatatttgtattttaccaaatatctagagtgagaatttgttacttttagaataaaacaaaactcccacaattatccaccttaaccaattgctgtctcctacaaatcctttccaaccagacttcatgggtagaaagcgagtttctgctggtgaaagggtgaaactacttgaaaattatttattgtctcccaaggttcactgcagcatgagacgttacgtagttatcaagactaaaatacaaagacagccctgaaaatagctggggagtgtgaaaattagtaatatttaaagtactgaaaattagtgatatttaaaggaaaacagaaagtttagctcttggtttgctttgggagaggacgggactctgaagcccccatgctggtgaggcacggatcttggagggtggtcagaggttgaaagccacttgagcaaatactcagtccaaagcagcaggtgcaatggctcaagcaggaaacagagtaatatcctgagattggctatgtttagacaagttcctattttggggacacagggctccccattcatgggtgtgccttgagtgcagtgccagacacagaatagtcaagtaatatgttcttggatgaataaacaaagaccctttgtacaatgctctgggacagaaatgcttcataatagtgatgttaacatcttttcacacctaaataagcctaaaagacttccaggcagttttcacatgtatttcagtgtgacttaatgatttataattctttttttattactattattattattattatttgtaattatactttaagttttagggtacatgtgcacattgtgcaggttagttacatatgtatacatgtgccatgctggtgcgctcacccactaactcgtcatctagcattaggtatatctcccaatgctatccctcccccctctttctaaacattattaaaaatatttgtgtcactaatcttgcggccataaagaacaagagtttgctttaaaggtgtactgatgctgcgataacacctatggcaatatttaaggttatcaaaattataaagctccatcctggagaaatggtcatgtgacattaggcaatatgtaacttcttcatgccttagtttggtcattgttaaatgaaggacattaaaaaaaaagcaaaaccgtatctacctcatgggttgtaaggataaaatgagttaataaaatgtaaagcacttaagagagtgcctggcctgtagttagccctgtataaatgtatcccattatcattaccaaagaagcttgacattggtattaacttgcccacaattaactggtgtgatcaggcattagttcaaggtggtatctgaggttactatcagatacattttggactatataggaaaacatagtgcttctctataaattgtttgcagaattactaccacaaattttaatggccttctacttccaggggaggccatctctatttgcattagaaagtaatataaagtcagaactgggtcctatttgagatctaaaagattatctatttgacttattcttaacttacaacattgacatttttgcttattgctttcaagactgtttcaaacatgatttctttcggtatactatctttgacagtagtgagaaaacaagagatgcctctgccgtcatactccaaggtgggaaacagaggactagcacctccagaagagggcctctggcttctgggaggtggggcttttaagtttcatgatttggtattggtgctgggatctgagttttcaggtttgactatgcaacatgcttgaaacatggcctcaaggattgtttggctgcctcagcattcatggtgggaagaccagcgtctgaatgataagagatttggaccttgtgtggcagcatttggtctcaggccctgctccgcctgcttgatattctactgtgatgaattggctatagctggtttcccaggagctttgtcatatccacattcgactgcagaaaaaaaacaggagttaactaactttcccaaagtgacacagctagtaagtggcagagcttattcattcactcaagaaaatatttagtgatgacctgttttgtgctacatgctggagctggatgaaaaccccaaagtgtctgagtgttactgatatcatcaatcagccccaggtccttctaggtcagccttctatagggaagggaagtgttcttgagaatgtgtcttggttctccatgatgttcttggacagtagcaatgaaatgcatatcctcatttctatgaataaactatgcctgcactggccaaaaatgtgtctctccgtttttggaagctatttatttctttaacatatatgatctattatagtaatataattctattgtgtacgatttgccctcaatttatttctggaggatttcctgtcttccaagttgtaacaggccaaggttgtagaaaacattatactgacattttctgtggcccttaacattttatttcagtctatctattctttgtattcatctttccacactaaagatttctaatgtttctaatcttcctctgtgtgaatcccatggccccagcctcttaaataatgtagtgcctttctctgtacctccttcagtcccattattagagagtttttaaaaaataatcatagacttttagggcaaaaaaaaaaaccttgtaaatagcattcagttgaaattctcatgtcgtggataaggattctgaggccccagttagttaggaaacacgtcattaatagggagtgttactgacatagcaaggaatcaaactcgttaggacctctgacttgccttggaatgttctttgctgatatctctctattacgctgttggcttctaatatggtttggctctgtgttctcacctaaatcttatctcaaattgtaatccccatgtgttgggggaaggacctggtgggaggtgattggattatgggggtggtttcccccatgctgttctcatgatagtgagtgaggtctcacaagatctgatggtttaaaagtgtgtggaagttccccactcactctgtctctctgctgccaccatgcaagatgtcccttgcttccccttcaccttctgccatgattgtaagtctcctgaggcttcccaagccatgcagaactgtgagtcaattaaacctcttttctttataaattacccagtctcaggaagttctttgtagcactgtgaaaacaggctaaaatacagcctcctttagacagttgaatatagcttaaaaatagtaaaagactgaggtataatcagtatggagtccttttctcaaagtattttagatgagtgatgcaataagaaagagggtctactgtagataaaggcacaggccttgaggttacacacattaggttcgtatcttggtgttgacatttattgtcattgtaactttgtaaatcatacctaacttaattgaattcgtttaatcttatgtaaaattaaagttagtggtacccacattaaaggtacttgtattacgtgagattatactaaattattaaatatgacatctgacatataatctgtcttcaactgatattagaaaaaaatcacatatgatgtttagtggagagtcaatatctgtgatttagtaaagaaatggtaaaactcgtgatcagaaataggggctatttctatttagaatgctctttcagaagtattcttagaaaaagttgaacatcttcacattgcctatataaggttttgctgataaataattcccaaaagccaacattaacaaagtatcgtattttttctagttcttactttattgtacatcattttatgttagacatattgaagaatttctgtctgtgtgttcatttttgcagtactagtagcttataacctagggaatattatgtgcctcatgtatcattttcctttttaaaagatacagtcattcaaatttgtattgagtattttggcacacattttgagggtctgggcctccatgatttgaatcaagaactgattcctttcgggtaaatgttagctgatgaccaaaaaagaggtattttcaatcccagtttcttaagaatattgacctaaatattgactaaaagctgaggtgctcacagccttttctagcaatttaaaaaatcactcaaaacctccagtgtttaaagatcaattgagatcagatacattttttaaaggaaaaaaaataaaaaaaatagccagttttgatctcaaatgcatacacatctatgtagaataggcattttttgtcaacatatgtgtattaagcaaccaatatttggcaatctgacagcaattgtgcttgagtactaggaaggcaaaaattaataagatcatttttccccgacctggacttaaggaactcaaaatcttgcataaaacattgtaaagaaacccttttctggccaggtacagtggctcacgcctataatcccagcactttgggaggccgaggtgggtggatcacctgaggtcaggagttcgagaccagcctagctaacatggtgaaaccccgtctctactaaaaatacaaaaaaaaaaaaaatagctggatgtggtggcgggtgtctgtaatcccagctactcaggaggctgaggcaggagaattgcttgaacccaggaagcagaggttgcagtgagccaaaatcgcgccattgcactccagcctgggtgacaagagcaagacttctaaaacaacaaacaaacaaaacaaaacaaaaaatcttttttttttgtcttgtgagaataaggcatgtagctgctcacacatgtagcttatatagcagctgtcaaggttcatatgctaccacgtggggtactgtgtgatttcctcctgatggctgagttgagtggggactgtcaagtagggggaacccggagactgatctcaagtgtccctcccggcttcactggacatcatcaatcagaacagtgatgtggctgctgctaccgcagctgccccttgcttatcacagagcaccggctagatctcagcctagtgctaagcaatttttgcatgttagtaccattcctccaagccattctgcaaaacagatactattatcccttatttaccaatgagacaactagagttctaaaaggctacttgattagcttacgatcgcacaacaagtaagtgcacacttgctccgttttcagtctgtctgtcccttttttctctgctgcagcatctcttttgacagacactgtggtggtaatgtgctccctcctgctccatgaagctatgacattcatacttgtgactgtaaggtgaaggaactatgaatactactattaattgatatgtgtagctttaatgcattcattctttaattcatctaaacagtatatatataaaatatatatattttaaaattattttttcataggcttttgggaaacgggtggtatttggttgcgtaagttcttttatgctgatttgtgagattttggtgcactcattacccaagcagtatacaatgaacccaatttgtagtcttttatccctcaccccactcccaccctttcccccaagtccccaaagtcattcttatgcctttgcatcctcatagcttagctcccacttaagagtgagaacataggatttttggttttccattcctcagttacttcacttagaataatcgtctccagctccatccagggtgctgtgaatgcggttaatttcctcctttcatggctgagtagtattccatcatatatatttaccacaatttctttatccacttgttgattgatggacatttgggctggttccacatttttgcgattgcgaattgtgctgctataaacatgcatgtgcaagtaccttttctgtgtaatgacttcttttcctctgggtagatacccagtagtgggattgctgaatcaaatggtagagctacttttagttctgtaaggaatctccgtactgttttccatagtggttgtgctagttgacattctcaccagcagtgtagaagtgctccctttccattgcatccacaccaacatccactattttttaaatttttttcattatggccattcttgcaggagtcaggtggtacagagatgtagttttgatttgcatttccctgatcattagtgatgttgagcattttttttcttatgtttgttggccatatgtatatcttcttttgagaattgtctattcatgtccttagcccactttatgatgggattttttgtttttttcttgctaatttgtttgagttccttgtagattctggatgtcagtcctttgttggatgtatagattgtgaagattttctcccactctgtgggttgtctatttattctgctgactgttcattttgctgagcagaagctctttaattaagtcccacctatttatctttgtttttgttgcatttgcttttgaattcttggtcttgaagcctttgcctaagccaatgtctagaagagtttttctgacgttatcttctagaatttttataggtatcgggtcttatatttaagtccatgatccctcttgagttgatttttgtataaggtaggagatgaggatccagtttcattctcctacatgtggcttgcgaattatcgcagcatcatttgttaaatagggtgttctttcccccactttatgtttttgtttgctttgtagaagatcagttggctgtaagtatttgggtttatttctgggttctctattctgttccattggtctatgtgcctagttttatacaagtaccatgctgttttggtgattatggccttatccaaagagtatatattatgttttattatggtgccaggcagtgacattggtacaactaatatatgcccttatggaactcaagatttcttatgttaaatacagaataaaggaagtaggaatatttatagctgttaggcctttagttaattttgtctagatggagtttcaaattacttatgatttgttgtcagttcagtgcataaggagaaatttatcttataaatagcttagaaaggagtcatgtcataaaatgacatgtctcaaaatgtcttgtgaagccaagttttcttccagcatggcaagcaatcaccatttctcttgctgagcatctaatgaagtcataggtttgatgtagagggtatgttgtgtgaaaagtactactttgaaatattagataacttcagagtcacaacatgctcatattcagaaaacaagtgaccctgacttccgctgatccgcagctctcatattacaccagccatgggtaggttgtttgctgagtgtaccctcataacccagtttttactgtatcttgctcttcagcaagtgctgtttctccttccagtatacttctctctggtttttttttttactttgcctcaagtcagtagagtttaatttaactagtttttttgtgcatatactatattttctttcagtcatactttttaaatcttagttacaaagcacacaaccaataaggacccaaatgttgtttcgccttaaattactttctttttaatattttctttttaatattcctctccattcttgttttacatttggtgggtatatttatttgtatctcttaagtaaaagaaactaagggactttgaaaaaaaaacaacttttcactaataacagagaataagtaagacgttagtatctatgtcaatggtggtgagggaaagggtaaatgctttctagagtaaataaattcaaaggattgtatgtcatgttaatataacaaaaacaaaattagaaagacgttttcttagattatagtagtgtattgtgtatatacccttatctaatagtgtttgagtctatccctccactatatgtatatcctaaattgtacagagacactagtatgctaaaatttatcataagaaaagattaaaaggagagaaatgtttaaaaatgagatgaaaaaccataagtacatgtgtgtgtatgtatatatatatgtgtgtgtatatatttccatatttcttgtttcattctaaaggatggtctgtgcatctctttccagagatcatgcacctacaacatgaaggaatgaaagaaaacctaataatacagagactggctgagcgcggtggctcacgcctgtaatcccagcactttgggaggctgaggggggcagatcacgaggtcaggagatcgagaccatcctggctaacacggtgaaaccccgtctctactaaaaatacaaaaaattatcccggcgtggtggtgggcgcctgtagtcccagctacctgggaggctgaggcaggagaatggcttgaaccagggaggcagagcttgcagtgagccgagattgtgccactgcactccagcctgggtaacagagtgggactccatctcaaaataaataaataaaataaaataaaataaaataatacagagataattcttcatttacaataaacactaagaacacatgcacacaaacacacacacacacacagagagagagagagattagattagtagcaaggaacttacatacatgattaatgtgaatgccttctgaaccaaagctgaaggaagcagatgagagctctgtgggcgtaggctgctgctgtgagcatacaaataagtttgatcatagctacagtctccatgcctaatgtcaaacaactgtcttgaaaatcctaagtgagagtggggtgggtaattcagcacaagtactgatctctgttgtcatgaatgtccttgacagtggtaagaagtggggacccattgggaagagccacctgaggtggcttcatgacatgatggattttgaagagatgtcttagacagatctaatgttagaacaataaaagtggtaccatggctgtaggagatcctgaatgcatgacattctttatcactgggataaagaacattctagattaagtcatgtaacattcacctcagcaaatggaacagcagggtcagcaaatctcattttgagtcaacaaatgcaaacattgcattatttcttttccccactgagagactgtcgtaacacacataggatgctggacacagcaacatgggagccaggttctgtactcttctacttaggtaaacttctgtcagcccgcagaagtcagtgaacacaattatattaaaacaatgtgtaccatggacccattggtcagaagccatattaaatgcagtttcatgcatggttagtcatccataaacatttctgcttgtaataataatgcggtcagaagtaggccttgtggggctgaaaagaggttactaaacaaaagtattaaggacacagtctgtgcagtgtgtcacttggtcaactggaaagcagtgacgacttttcttatacttgccagggtggaattcttctcagtgtattggtgtgaggttctctccggaggcattgcaatctgtttctaactacttggcaacagcttttggaataaggccaaaaagattgtcaaataatacacagagtggaaatgagctgtttgaatttttcagccatccttccttttcttagggccaaagatgtagttttataaatctccttaattagtaatttctaccagaatgagttagaattattacatggaatttagctcttctgaatgatgttcagtcattaagttatgacagctggtatgcaaaaaaatgttgacttattccaatcgttctgatgcctaatagaaagtagagttttttaaaagcatgttcatgggatggcattcaaaaacaagcttaagcaatctttctgagattgggagccaatccttgagacacctgggaatgaacagtaaaaggattggatatattggttgaatcagtctcctcatttcacatgttgatgttttaagagataggcggcttggcaaaccatggtgagagatgacctcttgagttgaaggcttatgttcactctgtagttcagaggtctgatctttcaatgcttcctgacgaagctctcctcgttttggtccatatcgttttattttgaaagattagtcacagcatcagacagatgcaagtagctattgtgccagacaggtcaggagaaccgctatgtagaaatgcttacagttgtggtctgttgcaaaatacgtgaattcatgagagaagacacatcgataatgttttcaatgagaagtgtaattacgtggctgctttttgcatgcctgccctctctcctccttttgttccttgacagaaattcgcaggaccccttttttagcaacagagcaatactatagcttaggtatttgagtggaaattttgaggggtgtggggagaaagaaaaattaaatccatttttttaaacagaaaatgtaagaattaatttaaaagtgactcaaatgataattgtttccaaaattacaactttctaatctatccctaggtgctgtaaactgcaaaccataatcctgtcttaatactgcaaacaaatcatagtggaactaaggggaacttaatttactggtaagagtattttccttaatcagttgttttatgcatttttgattgtatttaattattgcagtacatagggcaggagtcacaaaagataaggataaggagacgttgcagaacttttgtcttcactacggtcttagcgtagatatggaccagatatatcatatagtgaaggttttttttgttttttgagttccattaaattgctggtttatttttgaaagagcaaaacccttaccttaaagttatttttcttgttggctgacctgttggcatatttgaaagtggcatatttataatatttatcaaaatgtcatttttaatagaaaaaaatagtttcaccactgagatttgagaaggttgacttctaaggaggcttgaagtttcagtgagaaaacctgtattttcagggggttaacagagctcacgcttcatagtctgaacgacttacagcttcagtcactgttccttgaatttgaatccgtttgaaatctgacctgaatccttgattggagttttttcaaattctttgtgcaacaccaagctgaattataactaatttcaaagagtttggaacaataagaaaagttcacattggaaggagggccaaacacacagtgatgtagttctaggtaagctgtttagctattttgatgacccattttgtaaatcataaaactggaataatagttgtaactgcctacaggtgcagcctaaattagattattacgataatgaatattagcactgggtttggtccatagcattgtgtttggttcagtaagtgccaataattagtatcacgactagtttttaaagacaaaataattggaggaaaaacaaaaacgagtaatttttttctcaatgatgaaagaatggttttcttactttctcaggagcacattatgtcaccaagagaatatgcactccagaagaaataagatattacttggtgcatgaagaatttttttctatgcatttgttgcaaatgggaccttaatacaaatataaaataatgaagaccatgtggaaagagatagaaaatcttggctttatgggttactgttagcatacctggttcctggtaacccccagcggccttctaaatgaatgcaggccataccaagaataagtctatgaagaaactctctgtgctttgaaaaacatttgatctcttctctcatccactggagtggttttgccctccactatttttagatcttcacttgggaactttctccaagaggggttctccatacagactttctaaccacagggcatctgaaagtctcttgtaacattaaaaatggtttgaagtatattctaatatccttagagaaaactcttcccaaaacctgattaatcaattcctttgatgatgattgtgtgggatacatttattccattaaaacacttttatgatttcactttaaatgaatttctagttcataagaaacataggtaaatcttctgagatagtaatgaacaaaatacaatacccagggtattaaattttaaaaaagagattatcatactactatgagaaactgtaattgtggttgtgtcatgatgatgtattaataattatttctcttgacattatgaaaatggatggtaacccgcaaaacacccttcttgctcgtagccctgcattctttcctgtattttattgaattatgtttatttcttgtgttcctcttggtgattgatgaaatcattatttaattctacaaaataagttcccttaccgtcagttttcattgtgctagggaaatcagccatcaggttccaggaagggtttgtggaatcgtagtcataaaacacccatacccacacccacacacaaacacgcatttacctaatcttcatttttcttttcagaatctcttgtttggaaatttcctcccagaatacccaacctctcaagaattttaaaacgatggagtaaaataatcttcaagctctgattagattacaacatatgaatgctaattttgtttttacaggtttcaacacccaaatttatctgaacttagggcacaataagcagtttaactgttagaaatcttatgagattgagtttgtgcctatcagatgaatacatatttgtatataacatttcaattattgctacatttatgtataatttatccaaaagcgatgttatccatgcatcttaacagaaggcttaagtagttgaatgacagggactacatttttgctgcagaagatcatgataaaacatgtgctgtgtggtcaccttgggtaatgtgccgagactgcttgatggtacttatctctacacactgcatctcatactgatttatggatttggatgacttattttatgtcaaagacataaagagagtagagaagagagaatagtattttcatttcagtcttaaaaaagttctatcctatgagatgttaacagctgccttctcttggtggtctgtgaagtttttataaagatattgattattttccaatgacacacaaatctactgctagagaccattcaaatgcttagttacaccagggcttggctcctgtaccctgaggaggacacgattaaccaaatcctcctttttaaatgttctcaggacaatgagctgcacatacggcacaaatgcaatttgcttgaccaatcttgcctctgtctccttctatctccgtttacatgcttcatgctcagttgaaattaattctctacacattggtctcatgaacacatctttgagagcagagttcaagttaaatttttattttcatcattacctctgagaacacaatctggggcatattagacgctttgtaagtgtagaggtggggagaaagaagaagaaagagaggaacagaaggagggaaagattttcctgatagatcactttctggacactttctgtgctgagaagttctgagattgcctctctggatcctgctatcttggcagtcttgctaagagtttccatttacacttaaacatggttactgatgcgtcttaatgttgccttaactatcaggtttctgatagccccacatagccaagtgggaccctggtcaagaagttcacctctgttaaataaatatgcatagattttcaacatctcttcacatgcattcagaggtgatgaaagattccactggatgctagaacattgtgcataaataatcgaagttgtatgctcttcagcaatgatgctaccccatatcctttttttttctttcccatgatatgaggatatgagtgcagcagaactagctccatgcccttgtcccagaattaatcattcctatccatatttgatgtctttaccttttaaatatttatgggctgttatgttcctttcttgttgttcacccactctggggacattcagaagcctcacatttcttccttagccaaacaccccattcccttcatcctctctcagctgttctttggattacctccaaattgcatacataattttggtattgaggtgccaaaaatgcatttgtttcaactggagttttattgaagttgcttttactcaaatcaagtacacaaataaatttgatttccaaggcatgaaaattcagttaggtctccgaagggaagctgaggtatacttatatttcattataatgctacaggtagattttaagtcactaggaaaatgacatctcaaaatcaaaagattatagaatgagcactatatgaagaattacattttaaagcataggtctgtgatcattttgtaggtttttgttgttactgtcagtctattggtttttattaataattttattgaggtataactgatacacaaacgacatatttaatgtgtacaatttgatgagtttggacatatccgaggactcatgagactgtcactgcaatcaaggtaataaatgtatttattacttccaaaagtttcctctgtccctctgtttttgtttgtaagattttaataggctcaagctcaatcttcatagcctttttttaagttaattttttctttctttccaaattcagaaggcagattcatttcatcaaaagaaaacagttcctcagttgctactgcattgcagagaaaagactgactataatcaccattaaattattaaagaataaaagatactgaaacccagcaaaacttgggtgatctctttcataagcagacacttttaatcttatattgacatttaaaaggactgttcaagtagcaacatgacagactgcacatataaaatgtccatgaaaatatgtagcacagctaaacaaataactcagagcaaaatccaatgaaaggagaaaattgtgtttcctcaagaaaatgctatttttgccctaaggcaattcttgctggagaaaaataccatgtaaaacattgacacaaatcacagacatctcttctaaacagtggattttattggactgcacacgcgtgcagagatttggcagatatttgaggtcttggaaaggaaacaaaccagcgaaatatatcactattatcaccaacacaactgcagagggcaaagagcagacacatctcagagcctagtgatgaagcagggcattaaaaactaaatcaaagcctctgatcaaaggctaatttagtctgtcataattgacttgcagtggaaggaagcctcatgcacaaagatcaaagattagtgacttcacatttaccacaacatccccaccctaaaggagggaaaaaaatcagaaagaagaaaggggaaaaaagaagaaacatgtcaaagctcactaagaaccctgtgcaatgtaatctacctttcttaaggatagcatgcattattagaaaaatgaaaatgaattttattatggcatgtttgagttctaccttcgaaagagtgagaaactggcactattggcttaagtaacttatttgcaaacaggcattattaggcagtgccttttgctgcagttgcttccctttatttgtagcccttcaaatgcatacattaagattctcttcacagttgcaaacagcaggtaaataattgtatatttgagagactattgcctattgaatttaagttggtcacagactttggtccatggtaacatactaattgttaacttcctgttaaccagttatatcaagccttatgtaatttttgttgtttcagtacatactgtgaatatagccagctccctaactctgtatgaatattatatggggaggaaaaaatcctgtttctctattcttctaaaatctgtacctggggactgtgaattaaactaacaaaagacagattaataggaaaaaaaagcatactttttttttttgagacatgtctcactctgtcacccaggttggaatgtagtggtgcaatcatagctcattgcagctttgatctcccaggctcaaatgattctcttgccttagcctcttgagcagctggcactacaggcatgcatcaccacacctggctaattttttatattcatagagatggggtcacactatgttgcccaggctggtcttgaactcctgagctcaagcaattctcctgcctcagcctcccaaattgctgggattacaagccacaaattttatttgatattagtaatttaatttttacatgcggagaggatgtcatagtaaagaagtgaaaatcaaaaaagcaattagaccaggtttgtatactattttaactaagggtgataaattgtgtagaagtgacaagacaaaggaaaagagatttaggcttctaggagcagttaattgtgagaagttaagtatatgggcaaacctagtggaagattagggttatttttagtaagatttgtctgtgcagatctatctcagtactgagtttctatctccagtgatagtggttgtcctcctggtacagcagtgggaacggggaagaccctcacaaaaggaagtgtatgtcctccttttaggcctatagtggggaggcaaagagctctttctgtgtttgctgcttgctgactgccttcagctcaaagtaaaccttattgccaaagtggcatattttggggtgtcatattctgatctctttcagttcctatttattatattctcctgtcattatgctttgtatattttatgacattttaaacctgtgccatgtgtaaaatgacagtgaaaaggaaggtaatcctcttatgaaatgtctttctagttgtctaattatagggtgccctattagtttgtaggaattaagcattttcaaaggcatttattcaacgattgtttttgtgtggctgttaagagccacagggttgaagatacagtcgcaaagagagacacagttcttatcctcatgaagcttataatcttataaaggcagatatgttattcaagttataatgcaaacaaatgtaaaattgctgctctaataagcgccagaatatggtgatttgacctgtggtggtcagagaaagcttctctgagcaacaaatgcctgatcagagttgagaagtaaactaaaccagaaagtaagactagaaggatccatttgattgggaactttattagaatgctttcatttttcttgagatagatgtggaatccatctgtgctggggaggtaaaaaattagtccacctctcaggcagaggacagacagtgctgtagataatgcactgagaatggattttagttccagaaaaatatgagttccagctttaactcagcaacttttcggttgaagatttggacaaactagtcaacctctctgaacctgaggctgctaatccgtaaagtgggctcataatccttatctcagataatcatctcaactactgtttgttatcagtgtcatcaacatagtgctgatttgcaatgtgatcttaggcaaaccattttatctctttgagtttcaatttcacacttctttaaaatgggggatgttggattaaatggtttcaagatttctttcagctctacatttccatgattttgcaagcaaatgtaaagctggaaatttctgtctagatatcatgggaagcctatatcctggaaagttagaaaaagtgttgtttttggaaagtagactttttaaaagaggcataattccacccgttagcgattttacttatatttctttaatccacacttagaagtttctattatcttagattcaattttatagcacatatttcttctactaaaaagcctttaaagtgtttcagtgggatgtttaatttcccattatggttggtttctcaaatcattccttttgtaattgtcacatttttacagtcctgtttaaaacaaattcagtttttcaactaaaaatatcaagctgagttggaaatcgaaatccaaggactgcaaaatcaaatgataataaaccaaccataaggttaaactttccaaccaccacaaacttagagaccaccagaaatttgtgttacttgtttcttataaaatatagaataatcttttgaagattcttgtggccaaagtaaaattttattacatttctaaatctagaaaagggaaaactatttttaacaccttgttacttatttaaacataaaaatatttagtttgattggagcctcttcttgactctattcatatttcacttaaattactattgttttagctatacaaagcctgcttctgattatatttatgttaaacatttaatctttctttgtagagccacagatttaagaaagcatccagatatatatatatatatatatatatatatatatatatatatttctattttggtattttaaaatctcactcatgttttgattaataaatattcttaagtgctttcatatttatctttatttttaccttaggaaacacatattgaatatattaaataggtataccaggtgctattgtccttacgttataggttagaaaactgggccattgatttattcaagttcgattgtatatttatcgagtgaaaattagatctcatatctcatatcttctaacttcttattttgcattgccttactgattttccaaggtaaggaagaacctacccaatcaaatgaaagagtgctgacatgaattaaatctggttaaatgtctgatggtctgattgtcctcaatgattatagcattcaatggtattttattttcatttacccttccatttgtttcttataatatttcccattttgttagcctatgtatagatacgcttttcattagtgaatgtccaattatcatgctttcattttgggtggaagactgattagcatggattaattaaggtaattaaataattatagttactgtaatgtaactatatagaaatgaacattagcatggcctaattatctagtatttaggaacatatgctttggagaggtgatttaagtgggcttgaatttgaccttccatacttactagtaatgtgtgcttttacaagttacttaatctttatgagccttaatttctcatcagtaaagaggagatagtagtccttacagagtttatttttaatagacacatttctataattgtactatattttacacatggtaaactctcaatattatgattaacaatgcttttattgccctagccatggctgtgatgtatctcgttatgaaccaattatgctcccttagcaccatagttatagaggatgggacagttaatgcgagttaggttgtttagagttcttctctgaggagttattgaattgatgctgaagtaacagagctggtatcagagaattataccagtacgtaagcaagaaagaaacaagaataagcaagaaagtctcagaggtgtttgggtttctggatccaggggtccctgtagctggttccctctctaccttttctgtagtttttgtatgcgggccaataaagttccataacttgttagtttagcttagtttgatttgggttcctgtgacccactaatgtaatccaataatacaacatcttaaagacacatttctttgtcttcaagttaacatgtattactcacaacagtatcttaatacttatttatttatatgtttattttgtttctcccaattactaaaatgtaagctctatttgaacaaaaacttgcagtactctttcttcagctgttggaaaacctctaccacctactaggttctcagtaaatattggacgaataaatggataaaaagagaaagaaagtgacacttttctaaaagtgctcctgaattaaaattgcatctgtatttcttcctgaatagactagaaaaggacacaaatttaacatttattgagaacttacactgagctagccatcatgttagatattatatacattttgaacttgatgatattatctccattttacgaatgcacaaatggagggacaaagagctaaagtcaaattggtggcctcctggttctctgctcagaccgacctttgagaaccagctgcttccccagctgctgggatgtgtccagtagctagcacttaacatgttagccctgctttagggattgcctcagtggaagagagtactcctttgtgcaatgtcatgtcccctttccagggaagcccacatctaatgcctataaaggcccaacaccatcagctcagctctggacaactcctgcttccgaacacccctttcccataaattgatctcacatccctcactaataaacaagactcttcttcccagggaaaccaacctgctatggtaattttcaaatatctctgcccaagctagtgacatggcctctctaaggaggtaaagtgggctgatacccactgaaactgggagaagtatagttccaaggtatgatctgagaaagggctaggtattttctagggtcttaaagataggttttttagctgggatacagggagcttgtgatgagatgattgtcagggcagcagacatcagactatgcagggccttataagccacgtatcttggtgcttttgtgctgctataatagaataccacagactggataccttgtggatagtagaaatttatgtctcacagttctggaggttggaaagtccaagatcaaggcatcagcatctggtgagggccttctcgatgcttccttcagagtggaggtagccatgcctcacatattggaaagtggaaaggcaagctagctaaatcctgcatgaagcctcttctaaggcctttctgagggccttaatcccattcatgagggaggagcccttctgacctaatcacctcttaaaggcccaccagttaatactatcacattgaccattaagtctcaacacttgaatttgggaagggatgcattcaaaccctaccatcatgcaaagaagccaaagttatatttcctattgtccctaccctttcctcagataccaggatttgcctatctccatctctagctacaattgttctgaattttggggcccgtttttgctgcatgaatttgtatttgaattcaagacttgaaagattaattttcctttcagaatgttattcatataccccttcattcttaacctgctcactggtttcctaccataattacagtctcaaacagtggttgcattctggcaaaacgatgttttgagttagagttgttatgcagttagtcagttgtttgtagttaaaaagtctctttcttattcactgaaatgactggagtcccagctgctaggattcaaaggcaacagggaagacttcctagagtttcatgtgatcataaaaacctttccagacgttttaagtgattatgatttctatgctgcattgacttacaattagagatcattcaagtaacttagaattcagtaacttctaggtcacagagaggctcagatacacactgttgacagccttttggtgtctttgtatgtgtgtgtgtgtgtatacatacatacacactaaactgtactgctgtatgtgtgggaaaaagtctaaatactaagcatttttattctattttgggcaagtatctgtgctcaatggatgcaagttggtatctaaaatctaaaaaatgcaaagataaatggatcatctgtgtacttcaagctttattttcttgcatagttttttcctagtatttcctgacaacctagaacagtagttctcgcctttgactgcctattgccattgcccgtagcatattttagatctaaggatccctggacagatactctaactcagtggatggagcccaggtagctgttttgtttgtcgtggtagttgctctttttaatgtctacccattgtcctgtaagacaactagggttgtgaaccatcggttttttacactatctaaaaggaaggtgtctgtggattgaggatatttcttaccttgcctacttccacactttcaactttctaaaattcctgggattcatgctcccattccccaaagaatagtgagttacctataattatctacagcatctatcaataatgcctttagttcctcactttgagttctgcttagagctaaacatattctaagcgaagtaaggaggtttcatgcttctgtgtatgcataagtgtgcctgacaaagagatgaaacatgaaagtgaaacaatactgataaatgaaatttaaaaatatagtatgactttgataggtagtctgtattctggcacttcatgaaatctccaaattattgtatattaccatagcatgcaatttttacttatagcatggtaaagcagagctcctccttttgagtgatgtacagctattgcaccactctaagtggtaacttaacacagaataaatatgaatagaattatctagagttgtacaactcagtacctttggtttggaccagagaaaaaggccttagagtagtggttttcaaccaggagtgatttcgcccttcaggagcatttggtaacatttggaaatatttttagctgttaacgctaatgagggagagacttgcacctggtcagtagaggccaaagatgctgctacatgttctgcaacactcaggacaactgaatgcccaaaaagaattatcttgccccaaatggaatcatgctgaggttgagaaactctggcttagagaattgtattagtcatcctggcccataaaattcccatgaaaatttgggaacgaggggaggattcatatgtatctttttggtattgtatttctggcgcctgggagcttgctcagcatgcagtagttgctaaatatgtttttggatgactgagtgatggcatgatttgaatcagacaacattattttaccagccttggaatctgggcaaaagtgggctgcttaggagcaaagacacgagtctgtgtatttctgtggttgcctttccatggaaattcccattcaaggggatacctaatatgtaaggattaaagatgcctcctccatggattttccatggtgtctcacattctctaattagttattccttaaagttttgtccacctgtgtatctttagtggtatggcttcatgtcacctcaaatatggaggcattagctttgtttagttcagtatataccagattatgggatggaaaatactgaagggatatcaaatgatcatacgtaatctaagatataattaaataataaacttacataaagcatttaaaaaaaatttagttctctttcccttaattctttcaatatttcaggtagagtcaaaggctggttttgtgctatcatgattttataactaatttttaacaccatctccttttcttcttttcttcttcttttttttttttttttgtgagacagagtctctctctgtagtccaggctggagtgcagtggcaccacctcggctcactgcaacctccgcctcccgggttcaagcaattcccctgcctcagcctcccaagtagctgggattacaggtgcctgccaccatgcctggctaattttgcatttttagtagagatggggtttcaccatgctgaccaggctggtctcaaattcctaacctcaggtgatctactgcctcggcctccctaagtgctgggattacaagtgtgagccactgtgcctggctctctttttcataaagagacagcaaacctcaaaatcagagattcagcttgccacaggtctatttaaaattgtttttatttcaattcatgtattttttatgtaaagtagtgttgatttcctgtttatagcagtggagaacatattaagatattttaatttaaatagaaaagtaagccaattacaaataagtgcaagtagcgtacagatatgaaaaaaatcataatcatgtcacttaaataggcgaagaaatcattgaatttatttgttttgttaacattgtctcatcttgaaggagaagatggaatctggagattgcagcttgaatggctccggaagaggcagcatgttcggtggattggatgtgtttgcataactgtgggaccacatgggaggtgacgcaggaaggctgaaagaggacagtctccaaaggagggagcaaaccttgaaaacacctgcagggcccttttaatggccaactgcatcaatttaaaacgttcacttgctcccccatggctgtctgtccaggcagaagcaacatgacctctggtttgaaaggcctctcagattaagagagaatattgtgtcttggggaaatcaatcatattattatgaatcatagaattatgagtcatgtgttataggttgtttcaggcaacaagacctcagatgtccttcacttcaaccactcttgggatactgaagggtattgccattgcaatctgtggccaacatctacttccacatctctccctcttggggctttcaagtccaagcttggagtcatgtttgtaggagcctcaaatctctctctcaagaattttcatttgttttccccagttctcccctgtggaaccatggaaattaaaatcgaaaccctgttctattactttcacatgtttgaagatagatttcatgtcttacttgagccatttttttcttcaagaaaacatttccagctccttcaacttttccgtccatgagataatgtcagtccctttttccatcttcggaccttgcctctgaataagctcagcttgtctgaatcagttttaaatagaagcatttacacttggatacaattttccaggtgttgcttcagtgggacaaacgaaagtgagacaattgcatctcttgttctagatatcatacttctttatccataccctaaggttactaactttttggcaatttcatcacattgttattaactaagtcccctttttttttttataaagaaggtactacaattatcacacacctttattttaaacgtatggcaacatctttttttttttttttttctgagacattctccctttgtcacccaggctggagtgcagtggcttgatcacggctcattgcagcctcgacttcctgggctcaggtggtcctcccacctcagcatcctgggtaactggcattacaggcacatgccaccatgcatgtcttttttttagagagagaatttcaccacatttcaggctggctttgaactcctgggctcaagtgatctgcccatttcagcctccaaaaatgctgggattacaggcttgagccacaatgcctggcctgcaaatgtctttctaataaaagtatgtgtatctgtagtgtgtgtgtgcacacgtgcgtgtgtgtgcttgtgtgtgtgcgtgcttgtgtgtgtgtgtgcatgcgtgtgtgtgtgtgtgatatagtgggggtggggcaggagataggaattgcagagaaatacgaacagttaaacataaagagaaactggaaatttgaaaatatatgaagtgtctgaccccaagttcaagctgagaagctaggcatcaattttatttttccttagcctgtttttaaaaaagtattttttcaaagtttggtccttgagccacttttcagcatcatcttatcagggaggcctttcctgtatgtcccattgcttgttatctcatccaccattccttgctatctgctttaccctgctttattatttttttcatagctcttattacttccaagcattttatatctttttatttatgtattacaaggcttcatgaaaggaggtactttgtttttttaccactgctatttgtcacaacgagtttattaaatgaacaattgaataataagtaaaaggctaacttgggatgtgattgcatattcagatttttgggtcccaagctgggcctacagaattagaatttctggtcatggggcccgtttaacttacttttctagtgtttcatctgtgttctaaaattttagcaagactgaaagtgcacacaatctcagtgcactaaacactgaaaataaagtgtaatgagtaaatttttgaaatatcagctgggcatggtggctcatgcttgcaatcccagcactctaggaggccgaggcaggcctatcactccagatcaggagttcaagaccagcctggccagcatgatgaaaccctgtctctactaaaaatacaaaattagctgggtgtggtggcgcggacctgtaatgccagttactcaggaggctgaggcaagagaatcacttgaacccaggaggtggaggttgcagtgagtcgagatggtgccactgcactccagactgggtgacagagtgaaactctgtctcaaataaataaataaataaatgtttgaaaaatcaaaaaatggccatcttcctttacattcttaaaggaaaacataagtctgtatcaaggcattagaatataattatgctgactgtatattttaagtcaactgcatattactggccaactggagatcactatctattaagacataaaatttgctataatgtaggtttattatttacagaggtaaaagggccttattcaaaccttgtttcgactatgatgatgtcatggttgaggattcactcccaggtcctaaataacattccgataccagcacgacagcagattcacacaggcacaggcacttgcagactgccatagcttaccaaacaagacccaggtagagcatttcaaaaagctaccaaattgacacagctggggtgtagtttgggaaatttgttcaaaatgctaatctttgaagttaaaggtggaaagaaaaagtctacataaaaaccttccttggaaggagaaactcttatttccctataaacttcattactaacaaaataagggaggagagcaataagaaacaaataagattaaggaagccaaatggtttttaaatgagattattttttctcagacttttccacaaggcgtcagcagctctgtaaccaccagattgtcagaaattagcctggttttttttggacagtttgagaagccattccgtcggccttatttattgtttattaaattgattctacttgattttttgcagacataaatgagattcttctgaatgatgacctaagctgttaaaccttataataacatcactagtcactacttctgcctctcagctagtcagaagggcacaccctatggctttacccttgatcattgcacaaaaagaagagccaagactgtgtaacccaagtgtaatcaaagttacataaaaattacttagtgaagccagcccctgatctgtttagcatcatgtttactaatttattttttttacctccaagtaaagtacttggtcttttttaaaaaagaaggaagaagagcaaaatagagggagggaagaagagagggaaggaagaaagaaggaaagaggagaagagaaaaataaaggaaggaaggagggagagagagccttctcaaattcagaaaataatattattttttctattatgaagcatcgtggaagaaaataaggccagttgctacttaaaagtaagcattgggctgaggttaagaaatcatattctatctttaaattttatattcactacctgtttggcctcaaaaagtcacaaactcattgagctaagatcttacttgtaaaatatatgaattagagctgaatgatattattgaaacattccagctttaaaaactatatggctctttgattattaatgtaactgtcagatttgaaacacaaagatagaatgagtatttagaaacataagccacagacttaacaaccagctctcaaaatcctctcctcagtatttataaagagaaataaattttgaataaaaagataataattgggaagtacaattgttactgattataattcaatcttcaatgttttactggaaagaaattgaacaatatatgttcttaataacttcctttagtcaataatcgagtttgggaatttttagcagcttgagtatatttaagcccagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcctagatctacacagtactcacagggcaggattcacacgtttaagcccagatctacacagtactcacagggcaggattcacacgtttaagcccagatctacacagtactcacagggcaggattcacacgtttaagcctagatctacacagtactcacagggcaggattcacacgtttaagcctagatctacacagtacttacagggcaggattcacacgtttaagcctagatctacacagtactcacagggcaggattcacacatttaaatgctaagggatgaggtatcaggagaggtataagacaacagggagtggtaaggcctggtacactgaaaaacaggattgttttaaagcaggaaagccttgctcaactctggaagaattttgctgtgtgccaaagcagaactagtcttgtcagactttctaagttttggaagaaaggacagaaatcagcatattaatgttaaaactcataatgtttaagacatgggagttcattcaagccttcaaagacatcactgtgcaaactaatcaaaacacacctgtgagtttggccccactagggtttctggagtttccttcctcccattcaactatcaggtgaactacaattaggtattaatccttaatgacagcttcctaatgaccttgtttagctatttcaagaggatccttccctaaagtattcagaatcgccttgaaacatgaagaccacttcaagtgctatgcaaagtgagggaaatttggagagtagattcttctgaagatttctctgctaaataagttgcactcaactgaaatccagatgtgccagcactgaagctccatcgcaggcaaggccgactcattgaccccaacttctgtccactcaagtgccccgagactgctggtgatttagcaagtgaactccttgccagttgtaagagctaattcaatctcatccccagggtggtataggtacattaagagttgcagctcttagagtagttaatccggaaaaagaaaaaaaaaagccaaagtgcttgctgaacatttaactgaaaaatttctcatttgtacctgatggttctgaattttgtcaactgtttctttgtatccttgtgacacgtttcttatttgtcatgttttcttttaagaaagaataatgtgagggaaatgaaatgttcatttgttactggaaacttacagtgatgagatgtggtgcataagacatcataaaatatccctcatttccatttgcatttgtcactgctccaaatcattcacgtatctctgtatctgcgtctgcatctagctttgatttattcacataattgatgtagagtgacttttcccaaagacatgaattatattaaatttttgatttgtgcatgtatttgcttttgcatatcttacttttagatttttatagctcttcgaactcagagaacattcaccacatctatattggcctagggaatgttgaaagaatgattttaattatgccacatatttttgcactgttcttatctacaaacaattgtataagctatgccttttgaatatattcatgtgctgtgccagatagtagtagtgcaaaatgctaatgttgattttaaaagaatgacctttccttgtgtgtttctttccagtgatctgcttatctaagacggatagtattgatggactgcactatcacagtcttagacttgcagaaatgccttggagttttttgtttgacatttctttgtcccttgggtactttgctctgactctgtcatttagactttactgtaaggataaccaattagtagttaaatgagttgaaggagtctttttatgtactctattcaaataacactaaactcactgtcacatgaataggagatatgaattatttctctacgcacttttaaagcaagcccacacagtaaatgatattgttcataacccctgcctttattgctttcttccctacacttagggacttattttaaagaagaatttatagatcctctattctgtattccagtagaaataataactcagtaggaataggagtatgtagttttttttaataaacatataacagaatggtagaattagttttgaaagccatactctgaaggaacaacaatgagaatacttgctgggaattcgcctctttaagaaatagcagaggactgccaaattaacaaaatgcccctggtctgtatcatttatacatggtacagatatatattgtggacctactgtgttccaaacccaaagattgaagaagtaaattctcacttcctgtctttgacatattcagaatttggaaatatttcggaagctagaagtcaatactcacaatctaactcttagaatgaatgatccttggtcttttaacaaaggacatctgactaataaaatagtcttagagttgtaggagaaatgtgtcattctggacaacaaagaccttctgtctctttcgcaatggactgtttgcgtaaaataccagcgtacttagtgaattagacatctacaacactgtgtaaacattcctttccagtcattgcttcctggtcagtcatagagaccactttgaagtgcctttattttgaacactaggaaagaactacaggagagccacagccctctgaagtagtaatttttgtaaatttgcgaataatgatgttacatcacgtcactgggacatcaaacctgtctaatgtgcactactactcccacactactactgctaaggcaacaaccatttactaggcttattggccgtgtgccaagtgctgtgtttatttcttattttcataggatatgttatttaattaacgggtagctaagagagagggttccagagacaaactgctaaggttcacattcttgcttccattatttgctagctgcatgaacttagccaaatttctcaacatttctgtgtctcaactaccttatctataaaatggaaatacttgcctgataggtttttatatgattaaatcagaagatagtggttaagtgcttagagtgcacagactaaatgttcaatttgctataacatttctataatatcactcaatgaatatttgctataatattttcatatctcttactgatcactgtaactcaaataattgtgctgtcttattattcttagtttgcaagtgaaaaactgaagttcacactaaccttttagtcaaaaaatgcactaaatttctgagctgaaattccaacactgtttgatctgattctgcagttccaatgggggatgatatgtaaagagaaggggtaggactgcacctgaaatgttactagaattctattcaatgatctgtgatcctcatattcattcaaaacctatgggtgggagatgtggggaatgggtgggagatgtcagaatttgtatttacagtgaagcagggagtttaataaggtggaatttcaaggtttttaaaactcgatggtttttgtaaggtgggagtggaatggagagtgaggtagtaaattgggataatcaacctcggagtctctgggatgggagagatttctcctcagtattcaaattctggaaaccttttgaacttccaccaaaaataacaagccgtctaataaacaaaccatcccatgcacagagaaagaaatggatggttggggctttgaagccagtggtggttcttagtctgtgtggctaacccactagggacagatggtattattgggggcagctctcagaagatttgtaaaatatggtgaggttagtagcatggccaattttgttgtacagtatcctcagttaagcatgtataccaggagaaggatccatctttcttgcactttgaaggatttggtaacttattcaggacttggtcctatagctgtggcagcaacaagagtagtcagctcagcttaagcctctgttcctaaaggaacttggtctaaacttgtaggtctaaagacctacaagtggctctgatggggacctgcagtgatgcaccagcgagcgacaaatggagacatttctttaacaaggaaagcgatacaatttctacatgggaaggatgcattggaagcaacctggttagaagggggctggggactcattttgaaggtctggctgcacaacaggcatcatgttcttacttagatttaagtttctttggaattaataaaaattatgagcaaactgactcctttcctgaggtacaagtttgctctgcggctgctctttctcttctgtgaaaacgtgaagctccagttttggtgctagcaacaacaggacagaggcttactttgcaatatgtctgatagtgattgtgtggttttcctgcatcaaagggttaaagttgaaataaaacttgcatttcattttgagcaaataaagcaagagcaaatggcattgtcctgagaaatgttagcacactgtagattcttaaatttattgtggttgaggatggatgctctccagattagcaaggcagcacttccaatgttcagtggagggcactttaagatgcaattatttacacttcatgttgtgatattacaacaatagttaataagagctggagagatttcctaattatctgagggtgcaggaaatcatttcaccctccccttacttgaaatactaggaatcaagtctgcaggaagctggctgatcacaaatcacgtgtcagcacctccataacatttacctgcataatttgtccttattattttttatgttgatgaatctatattgataaatcttgcatttatctgttttttgcagtatgtatttcctatttcacagtagtagggaccctacgctctatttactttgtgctctttcacagtacaccataggatttaaataaatgcctattgaaaaattcaacaaataagccatgtcatttttgttaagcagctttacttggaagcaagacttctgttcaaaattatgctaagatgaagagtctcaccatcatttccctggtgacctgtgggcacagaatttaatgagaatttgtttccttgccctcatagcaacttcctctgcataagatcctaattaaccaccataaggtgatttaggccttggggtggggtggaattattcattttcctctattttacatttatattttacttcataatactgcattcacttcctttgaaatgttagtattaagaagttttctagtagctgttctcttaaaattacgaggatttttgattttatgttattttattagtcaaaaactaaaaccaaaagcaaaatctgtaaaattccttttttgaggatgtaaaattgccttatacattatatctcattatctttaccgattttaaaattaacacctaattaaaccgtgtgtgtatttcaaacgtgaggctaggttctcattgatgctctccactaaattgttgcatgaagctcaagaaaaatgtgaaagattatacagtttttgggcaacaaatattctccctaagactcaagatgtgttttcttaagaaaatagatttaaaatgtgaactatttccaaaatataaagcaaattaagaagcattttcttgaaggagaaaatgtaacaattaccatagaaatgcatttgccttgatatcgtcatttttagcaatgagtttgatcagctttgtgttgatgatcaattctaaaatgattctttcctatgaaaaaccatgctttggtttcatttcacagctgctaatttatttacttcacatttgttgtcattatcgcattctctgtttattcttgcttcaaatgtgttttgccccgacacatgttcaatagatacaatcctttacataaaaatgaaagtagatttctaaaactctgtagtatatttacatcaaactgtgggtaaaataatttggaataataaagtgttttagatattatggcagtgatgaagaaaatgtattgaaaatgatgactaggccaggcacagtggctcactcctataatcccagcactttgggaggctgagatgggcagattatttgaggtcacgagtttgagagcagtctggctaacatggtgaaatcctgtctctactaaaaaatacaaaaattacccaggcacagtggtgggcacctgtaatcccagctacttgggaggccgaggcagcagaatcacttgaacctgggaggcagaggctgcagtgagctgagattgcgccactgcagtccagcctgggtgacagagcgggaccccatctaaaaaaaataaaataaagtaaaataaaataaaataaaataaaataatgactagcttatgctctcagtacacattttggattagatttcctacttcagttaatacaggtttcttctttccctcaatattattgcacatgccataaatatatcttgcaaaactgaataagaattaactttgaggcagctatacatcttatagtcttgttagcatacagaaaacaattaataaagaatcttcggaattatttagatttgagttcaaatcctgagttcaattattaggagttaggtttaagaaataattcactctacctctcttccagtattcgagaatacagggttaaaggcagagctcaatcagatggcaaaatattggctttgtttacacttccccagtaattatgaatgttaaagggtgttgagtgggattttgtattttgttgtagctgttgttgctctcaaattggtaactagagttcacagctgcatgcagagattagcctggtataccatttactaaagagagaagcaaaaaattatggtcagaatcctgtctcaggagcttcttaagagttgaaagaaaaaactcaatttccccaaccatcaaccagctgctcggcttgtgcacaaaaagttttggaggcaggaaggaggagagtagctctttgaaatgttctagcattgtggaatgtgcatcatttatgatcagatgggattccttctatagcgcttttctcatctcaagtcaagtgaagggctccaacttaatcatttgtacagactggtgcacgtgaaagaaggagacttgcaaatgttccctgtttagttaactgaatcagtaatgaacttccgaatctgtttctgtgccaatgttgggcagataggagaaaaatggagagagatggtagggagggtcagtggagcacctacattctcgcctttcagcccaggtggggtacatgaatgttctgtagataaaaaagactctctctctctatatatatatatgagatggagttctgctcttgtggcccaggctggagtgcaatggtatgatcttggctcagtgcaacctctgcctcctgggttcaagcgattctcctgcctcagcctcccaagtagctgggattacaggcatgcgccactatgcccagctaattttatctttttagtagagatggggtttcaaccatgttggtcacgctggtctcaaacttctgacctcaagtgatccatctgccctggcctcccaaagtgcacggattacaaggatgagccaccacactcagccaaaacagacccagtattaagcagctgggcttgagctgttgctggtacctcatctaagggggttggtaacaggctacagtgacaaaagcagcaagaggcagtgagatctccaggaagctggaggaaggtgggatgaaggtggaagtacctgagacctgtgcagaacctgacccagtagaggggccaggctagaagagatgtgataattccaaggtgctaaagaggaagggggaatcaaaaaagagacaacgctcttttattttcatttcagctccttccagccatagttctggccagaaatggggggaagggggaaatattttgaatcaaactgagttttagtgacagaaggtgacttgagatttatggaagaatcaaatgcataaaggcatgggaaaggagaatttggcaaaaaatagtgtggaaaactgtgtttgaagaaaaaaaatggaaatatttcaggccaatgagggtctttgataaaccagttacagctggattagagaactctatgaggcttcacatgttatttttcctgaatttaaaccctgggactcaatattatttctaaccaatcataggtagcgaggttgaaagggagactacagagacctgattggtgtttttaccacctggacctggaagcactgtcattgacagatcccaggtgtaggcagaaagggcaggggatccgggtgcaaaagaatgagccttgccttgtttttgaagtttccgttgaaccaagctgatgagacatctacctgttgttctagttactgttagtgcataaaaaattacccaaaatttggtggccaaaaacaataatttattttgctcacgatattgtggattaagaatatagagagggcagttcttgctaaaagttttaaatgcaattgcagtcaagttgttagctggggctgcagttatatgaaggttcacctgggctggctgctcaccacagctttcccacatggctcgtagtggacgtctgctgccaactgggagctcagctggagctgtggacttgagggtgcacacatgtgtgacctctccatcacagcagtctcagggtagttgaacttcaggcatgactgctggctttttcagaaccaagaggaagtagaaagctttgtttgatcacaccttagaataattggttacaagtatatcattaagaccagcctgaattcaaggagagaggtataagcctcatctctcaatgggaagttgtcaaagagtttgtggacatgttttaaatctatcaccctgtgaaaagccaaaaatactgctccaatcaaaaaaaaattcttatattttggccaaagttccatttcctaaggattgtggggagggggaaggaaagtttttgtgaactcgggcaagtcattttaactcgctgattttcagttttctcttaccaaaatgaaagcaaaaatgcctactttattgtgctattgtttaatggggtgaggttggtggctcatgcctgtagttccaggtactcaggaggctgaggcaggaggactgcttgagcccagcagttggagactgcagtgagctgtgattacaccactgcactccagcctgggcaatagagtgagaccctgtctcaaaaaaatcattgcacttttgtaaatttaaatgaaaagacagtgtctaatatatagtagctcttattatttactcatattacatgaggtatccaaagagaatttctcgcaagatataatgaagaagatttgtatattggaagctttcatttatggttggagaaaaactgctaaagatttgtaattttgaatgaacattggcataaatagaaagccagcgcgcagagcagagaaggctgatatttttatgctaagctgtagaaatcaggaaatgtgtgataaggttatctgaaaaatagattcagagaaaccacagagagaggaaggggaaatcaaagtgaacattgatgaatgtgggtaaggatattgtgtgttggggaagcatcttagttcttccatttaatacacatgtgatgtttgaagcactcttatgaaaagtcatctttcatgttaagtggagatcatgtatttgtaacatttccatttggtagtcatatctctagctattaaaaatcacattgtgataaaatactcttttgataggtgctgactgtaaaatcatatggtagacattttctgcaatgtagcatgatttaatagaattgggaaaataatgtttttatatttctattataaataacattcatatagataatcttaccagttgctatcaatacagggaattcttgtttcaattaattagttaaaattttcattgtttttgtgctttactgtaatattgctactgttatttgaaacacattacatttgtataagcacatgtagcaatgccaaaaatattggggtgcctactctgtgcaggggtttacattagttgttgcatatttccaattcataattttgtgttttttgtattcctgtcattatggtatactttgttgtttttgcatagattttatagtctttttccaggttttaggtttggtaatagaaatacttctatctcatcaatttcaagtctactttcagaaatatttcaggaaggcaaactgcattcttaacaagagactatgttttcgttctttggaaatgggaagataattaagacccatattctgtcctcaggtagctaatagagtacactagtgtattagcctattagccatggcattttcaattgcaagaaatctaaggcaaaagggaattttagatcttacaattagaaataccgtagagttgttcacattatgaaaaataagttacaggattagggaagagcttatgttcaaatagttcaaagcagcaatggacgtattttgtattgaaaattccaaagatgatcataaagatgactccttggcacttgctcccaaatggattcatccttttattcattcagtctttcatccatccagtacttactgaactcccatatttgccaggcatttggtgctagagatagagaggtgaataagaccaagttttgcccttatgagagcaacagtctaatctagggagatgacagacagcaaaatcaatgaagagataatgaagggccacctagggatcattcctattaagctggtataagttggtttaaactagataatgaaagaaggtctttctgaagcggtgcctttgaacctgagatttgactgacatctctgcgaagatctgggaaagtcttcaggtggagggtagagcaggtgtaagaccctaggaaagtgggagcttggtagtatttcacaaacagtgaggaggtgggagtaaattcagcactttatgaagttttgtgcattcttcagtgttgttggcatcagtgagtgtgcgatagctagaaacaggtcaataaattattcatgatcaaaatgaatttgctgtttctctggccacattattgcacccttgggaagtggttagtttgccccacctggaccaaaggagagttccttacccaagaacctgaatcaatatgttttagtttagctatgtttttccacaagctcttaagctctttaattccataaagacaattatcactcctagacttaatcatttttctcttagcctctgtgttaccttctttaatcttattcaagacttgtttcctccagtcccttattgttttgccattaagccttatcaatatttgcttggagctatatttaatatattcacgttctttttctattctctctcattttttctgtgcaaggccaaatgtaaatgtcacgaaattatcagaatcttgaattttgatgtcacatttatgttttctatcataatgacttcttttaaagaataagggtatatatctcttatgaatgcttcttatttttaagttataatgtttctgccttttaaattagaggtggtaggatggtaatatgcctatgttaaatttgcttttctactagatgtgtttcctaactgctccaatctactcttgcctatactgtaatgttccatgctgtaaccagataattctttctgaaatacaaatttgaccacgccataattctgcctaaaatgtgttgatgatttcacattctttttgggtaaagatcagctccttacatggcctacaaagcctcaatgaaatagactcagcagcagggaggctcctctctgaccaaatcccttctcacttcaccagtttccattcactgaccttttcctccttagtttctgttctccatgccagtctgaaaacagagaatttgcatgtactcatttgtcgtgttcactacatttttttccctccttgactaactaacctatacatcctcccaaatctcaattcaatgatcacttcatgacagtcaccatctctggatagattgttaaaagcagatctagacagagtaccacatgcaatttctggtcaccctaaaacattatacatgcacacacagtgcatacacacatataccccacacacattccaggtaatattcagaaatcttactattttaataggaatgtgtttgcctaagttgaaccatgctcaaaaaaagaacattccaaattattaagctgactaaagctgtctttaaacagcagaatacatatacccactgttcagattagctaaatggggaaataactgcttttcaaggttattaacccacaatattctaatctcagatgctgtactagaacagtctggcacagttactgtttggtttatttttttactctagtgagctgtaggctgacacgttaccaatagcttcttttcattgtaagcagcatacagtgtgatgctcaaagtgtaaacaggataatttttaccattttcaggagcatctaagtcatctacagttggataacttttttccacaatttgtgaaatacaggtgtatctgtcaaaactgatgcacaattttctctgtttcttttatctgtataatgacttacccaattcctagtgtgcaagaaatattattgatgtcttattgaatcctgttgctttctgtatatactactgtgatcttggtggcatcttcatttattattctggtggacgcatgtagcttactatcagtgtttttatgagacaagaagcaatatctctcttttctaactaagcatttagacagtaaattctctttgcatggatagcagtgtggtcctactcaccactgcaacttcgttgcctagcatggcaccagcacacagttgaaacttcattcttgaaacagcctgtgggttagggatattctacctatttactagtgatgaaactgccccttaaaggaatgggtgagtgattgcccaagtgtacacagctgctaagtggtaggggtcaggctcttagtcgcagtgtggctcattatctagcatttgctaacatgttatggaggcattttgctactttaaaataatttatttattcaaacttcatattcactggtcagatttcccttgtcagactgagaaaagaaaccactcatttgcaggacagtagcaaacatcttacttgcattccagttgtgtatgggttcttttaaacttcataatattcttttcttattcctcttgctatatattgatggcaaccgtaggcctaggtttaccacatctctatagaacaaagccatatcttatgaattgttttaggtgctatctggactgacacagttttgttacctatagcaaaatatttactgctttgttgcagagaaagctagcagatggttttcatgacatcataggcagggaagagtagacatgtagggtccacatgtttggccttttttccaagagtctaacttcatatattcatgagaattttgaatgaagaattcaataaacttgttattgttctataatgagaaatctttatttgctgaaaacaaagcctattactgtgttctaaagaatagatctcagtctgaaaagaatgctagtgcaaagataaacttacataaaaaaactagtataaaatttaaatattattagcaatcatgattaaggatattattaattgtatatatatactatgtgccaaacaattggctaagtagtttatattttaccttatttaatccttaaaacccttttaacatatgaaaaaacttagaacttgaatgtttaagaaggtaatttttgttctaaaaactaataattagaagagttggggttaaagatatgttgaactctaaagtcgaaattattattgtttatattattcttttaaaaattaagataaatattatatattcattgtcatgattacttttataatatatttttccgacctgtctaaaatgctgtgaaggtaaagatcattatgtctgtttaattcaccactatattaaaagtattatattgcaccaccaatcatattgtatatgatttgtgtccattgtagatactcaataaaatatatcaaatgaatcaacttgagctttgaaggttgggattgtcacaacattaagagtgttataacctttcttctcagacatttttgaggagttggagataggaaactgcagagtttagcctgtttggaagaaagctggtgttttatagtttgcagcatgattggaatccagtgactcaactgcctttgaccatgaggtttcaataagaggcaagaagaacttcagttccaaggaaaatctcctgattaaaagagtcgtacactgatctcaaaaagacttcaatggcagcatggcatggagttcaagagtatgggctctggggctgggcacggtggctcacacctgtaatcccagcactttgggaggccgaggggggcggatcacgaggtcaggagattgagaccgtcctggctaacagggtgaaatcccttctctactaaaaatacaaaaaattagctgggcatgctggccggcacctgtagtcccagctactcaggaggctgaggcaggagaatagcgtgaacctggaagtcggaggttgcagagagccgagatcatgccactgcactccagcctgggtgaaagaggaagactccgtctcctaaaaaaaaaaaaaaaaaaaaaaaaaagagtatgggctccgggccagattatccgggttccattctaaagcactccacttattagctggtgacttttcaaatgacttctctatacccaaatgatctcatctgaaaattggagataatgattgtacctgcctcataggattattattattaagattaaatgaattactgataaaatacttagaacagtgcctgatacacaatatgtgttatgtagtgtttgttacatgagtattcattctaaaaagtcttttaaaatataaagtaaatgcttatagattttttttaaaaaattatgcatctgcttgaaaactaaaggatattatttgataaagtgctaagatgttctcagtgctagaattatataatagtagccacatcctggaaccataaaggcattcttaaggaagtttatatttaaaaaagcaaaataaagagccaggaatgagtaactagtgcacagactgtgaaaccagaggataatattctatatctgtaaatacacataacattaaaatccttaatttgacaactggcagaagaacacagcattgaatcttgtatattttcattttctctttctcttctctaccacattcatttccatgttacttttatccttttcagaatgaccaattgcttccgttttaaactatactcactgtacttgggatttatttctcttaccttatactggaaaaaaatgcaaaaaaagggcattcagaacttacgtgtcatttttatattgcgaattcaaggaaaataaatatttttgtgactttatttctaagtgttacatttgcttattttgtcttttccatatttccccctttccctgtctttggcatgacatttggaattgttattggaaagagaatcaactcagaaatcaggaaagttagccagtgacacattcctttattacatgatgcaaatattttgctttgctcttttaacatttttcttttccataacaagaagttttacagctacatttcacagattttacatctctgcatctaacagaaacataaaatgtagtttgcatttaggtatttgtattttattttactaggcaggaatgtggagtgtgtttgtgagcttgtgcatgtgagctggaaggaagtgtggttgcccagtacttcctcaactcatgactgaaactttgttccagttcaagaaggaaataaagagcccttcaaaatagaatactgaatactttcttcatccgctctatagaaatcaggccaggaagcaaattaaaattacaagaatatccaaaacagaattattttgcttgctgtctgtgtatttgaccactgccttttatgattttaacctttccagacattctctttggggtcggttttccttgtggcccataggagatcccactgaaatcatttactagttgttccagatttccccacaatccccattgcgctaagtggcggctaatgtgggagctgtcatgtttggaaaataccatgatgccatgagttaatttcatacctgtcacaagatcttgcatgcgatcccaggggaccagtggtatgtcacacactactgcaagcgttcgttagtacctctcaaagcaatgaaccatggccaagagatcttgttgcaacatatggcagcacctgtcaccaggcttcatgactggcataaaattaacctgttttcctgtttgatgcgctgcttttttttgcttatccgtaaaaaggatgagaataaattgtatttggaaacaatttactgttcctttcaagaagtataatggtagacttgggttactggacacaatgaatagacagtgtccttgtagaagtacacacactgctattcagtaaaggtggtattttatgaatttctgaatggcagtctgcacatctcacacaggaagcaacgttttagtttctgaactctgtcaaacttagacatagagcaagaaatgacattattgtgagccacattgtggaagaaaaatccaggaagcatgagtttcagatgtgagtttgcccttgcctttcgaatggtttcaagcaaccttgagcttcctctctcttctctctatatttctcacgctcagatcttagtattctaatggggacgcacgaaaaagggacccacagaaaaacaatattcagaatgatgccggatattcagtgtcttagaaaaatagattaatgggatttagtctttaagtcttaaaactgcaatttagcagttatttttatggataaagacaaagaatatagtccagcatttatatatggctttctacctcagagaaatagtaaaagttttttgatcaaatgatttctcaatagagaaagtatccggtttcttgcatcatttttcttttcttttcttttctattttggatcttcttatatatctttttgcagagccttaagcttcttaaaatatttattttaatcgaggggggagctgttttctatagctagtctttttccttcttcttaaggtaaatgcttcttagattctgtgagttttaaaattcatatacagcaaagaacaaagataaatttagcagtcttttccctttatgtcactaccaagtctagggaacaaatggtgctgttcttccacaatctggactggttgctttgaattctggagtaatcaatttttcctggcatttcttaaatggtcttttttattcactgaatctcctttgaaagtataaacattagtccttgttctatggttttggaaattgatgactgctattctcaaaggatagtatagttggaatgattgaaggagcagagcaaaaagctgaactgaaacaatggagggaggaaagatagtaccagagacaatgagagaagtgggcagtgattggaagggaatccgaagtagggattggggacttaaaggctgcttagacttgattaataaatgctgtataaatgaaatgctgagacaagggataaaattgcacttgagaagtcacttgaaaatgtgttaatgcctttacttgacaagcatttattttttcatcctgggtataaaaccactgtaggaaaatgtagatcattttttcacactgagtattttttaactgctgattatggttatgttgtcctaaaatcaggtttctattatctgaaaagaaaataaaaagaaataaatataggtgtgtaaagataagtattttggaggcatggatcttcaggtgaagtgtcatgtaatatctttgctaagtcgggataaaaataaaatttaaaactgaaattcatatttaaaaagttcttagtagagtctaggcatttttttttttttagtgtacctaacagtgatgaaaattttgtatctaaaagaatgagggattttgcaagggattttcaggagactgtggcactgtcatggatggtagctataccattttctaacaaagtatgtcaagaaaattgaacatcagtcttcttactagaaaagagaatctgtggcaaattattttattaataacagcaaactgaagagccacaaaataatttagataagaattaaagtgctgaataacttagataagaattaaagtgctgaataatttagataagaattaaagtgctgaaacaattttattactggtaaagctgaattcagaactgcttctggtaattttactgtatcaagcaggccctgagaaagacaacctggaactgtttaaagggagatgttcaacgatggtcacaagatgcaggactcaagagcttccaccattagaaactatcacctttactaccaccaacaaaatacctttttctctgagaaggagtcagtgaagggtagagatgaaataggaaaaatttggttggttgggtgggtagtaagtttaatcattactcttctttaatgagtaatagagtggaaataactttcctctctggttttaaaagttaactaatagtaagtgtctttgttaaaacacgtagacacacacatgcaccacacacacacacacatgcaccacacacacacacacacacacgcacacacaacaactgtttgctacaggatttctaattaatgatatcacattttctaacccagtaattcccaactggggttatttttttcccctaggggacatctgacaatgtctagatacattttttggtagtaatgacttgtattactggtttctcaagggtagagaccagtgattctcctaaattctcctacaacacccagcatatctcctcacaacaaggaattattcagttggaaatttcaagggccctcaggttgataagccctgtaattgcttgaagtaacttaatctccctagtaattgtgcagtatctcatagttattccttcttccactactactccccacaaatttgcccacaaacttgagaatttacataactccaggagtacaatagaaagggacctcacatccaagtgcttgggtactgtgctatcctctggttccttatttgccttcaccactatgatttactattggtaaagttgtggtcatgtcggttctcctggactaccagagcccagaaatcttctcttgttgatggttcacctctgtcttaaagtctactttgtctaatgttaatataactaccccagatttgttttatttttccaatttgtaccttttttttttttttttttgagacaaagtcccactctgtcgcccaggctggaatgcagtggcacaatctcagcttactgcaacctctgtctcctgggttcaagcgattctcatgcctcagccccccaaatagctgggattacaggcacatgccaccatgactggctaatttttgtatttttagtagagatggggtttcaccatgttggccaggctggtcatgaactcctggcctcaagtgatctgcttgccttggcctcccaaagtgctgggattacaggcgtgagccaccatgcccagcctatttctttttcctatatttttgcttttgctttgtaaatacctttgaatatacagtttatctcttctagatacgacataatcatatcatttcaaaaactattctgctaatccttactttttgttagtgtttaattcatttatgtcttatataattactgataaggtagaattgatgcctggtgtttctatgtctttgcttttttattccttcatatctgccttgtttttcattaaataaatattgtctggcatgccattttattaccttgtttcttttgttgtagctttaaaactattttcttagtatctgttctggggaatacaattagcattttactaaaataatctagatcagataaaaattaacttaatagtatacagaaactttgctctaatatgtacctgttacttctttcctccttggctgttattgtcatacaaattacttttatactgtgtaagcccattaacgtggtattataattcttgatttatgtagttgtcttttaatcggatagaagaaaagagttacaacaatattttaatactttcttttgtattttcctttactagtgttctttatttatttgtatagattgaggttaacatctagtgttctttcattttagcttgaaggatccttaacatttttggcagtgcaggactgctagtaagaaattatctcagtttctgtttatccaagaatgtcttattattatttttgtaattttcaaagaatagttttgctgtgtatagaattcttggttgactgtttgtgactggttgactgtctttctccttcagcacattgaatatgtcatcccactgaaaaatgtgaatggcttcacaaatttgcatgtcatctttgcccaaggaccatagtaaccttccctgtatcattcaagttttagatgggtcaccaaagcaagcactctggatctttccatactgcaatagaaatgaggaagacttgggggaacttactatttctctccatataaatcctgcctttgccactttttatctgttttctggactatactgtatagaatacagggtctttctaagaaaacaaaatactttgattttgtgtccagggatccaagtaaaagccctgcttttggggcatctggtggttttctaacagctcctgctctgattgtttccttgtattccagttttctgcctaatcacatgcagaaccattccattcacatagtgaatacatctctcacttgacacagggatcctcatttatgggaaagaaacacaaacctttcatttgaaaaagatattattatgtttgctttatgcagtacataaataaaacttgatgatcactttctcatagccattctcttcacgaatatcattagcattcaatgcagaaattagcctgcagtcttcccctaatgtttgcatgtatcttttttgtgatccaacattttgctattaaatagaatgaattatgtggagacatgattagataataccaagagtataagtttcctgagattagcaatcacacatggtttattttagtcctttgtagaatgttgtgactatctttctatttatgtacacatgtatctatgaagtacttattcatccatccttttattcattagtctagccagtcaactatctattcatctatctgtctgtctatctgtctctaacatatctttttcttcacaggaattcaatttgatgttagcatatgatagttgtctaataaatacatgttaaattaaattcatatgaggaatacagactctagtgtaaactattggcattactgaaatatgggcttgatcattcattgtgtgggtaactaccccatgggtacatacattggatgtttagaaccatcatccccggcatctcaatataagccagtattattctcccaattgtaacaaccaaaaatgtcttcagataacataaaaacatccgtgggggaaaaatccctctcctccaccccagttgagaacagctggtataaaagcatcctttccttcttttatcacagtatgtatgattaaaataaatgttaacaatgactaatagtagggaatttatcagatgaatgaatgcatttacatatgtattttccagatagtcacactctccctcactgattcatccacccatttattattcaacaaacacttactatgtaccaattatccactaagtactttgccaggtagaggggatacattcgtgaaatgtaagtttctgccctgatggggcttacagactttcggtggaactagataaaacaacgaaacaaaagatattactaataagtgttttgtttacaataaggcaggaagttataagggaaagacaggggggctgcatgagattagtggacaaggaaggactttctgaggtgacatttaaggtgagaaatgaataataagaggaaaacaaacaaagatgtgaaaaatttattcattaattttacttatttcttatagcatatgaggtttatgctaggagtgcaaaaggatgatcatttggtggcatatcaacttgcttctctacccatatttgtgaaaaacaccagattgtttgtgtggaagccactgggaactgttccaaaccgtgtgagaagtctgacgttttttattgagggagcatagccctaccaatgtaaaggcgttgttttatgacaatgccgtgaaaactggtaagacattgaaaagcaaaaatgagacatgcagaccttaaaatatcctgtgtgataagaactagtgattgttcactgaaaaagacaaattttagttctatcttcatgacattatatgttgctggggagatggtggtgaccagggaaaactgttcagaggaaaatcctggcctgatacatttaaaagaaagcaggtaaatgcgtattcatctttttttttttttctccaacctcagtagatctaaggacattaatcagaccttgggataattatatatagctgtgctatgagtacgtggattcatttataattccattggtagtagataatgcaattaagtacaaaattctgcagaatctattatatcgttgtttgacgaatcaaataatgtattctgcatttttattctcatgaatatttcccttataaatagatgtctaaaatgaactattttgcatatgcttgccttatgaaagtaggcttatccactggaaatacaaagctgttttaagcatatttgtgtgtttaaacatgcttacgcatgttttcaagcataattgaaataattagaataagtttcattatcacctttcaccttttatgctagatgctggatcaagtcaaaactggaattgcaagtcaaacatcttgatgagatacagaattctgtaaagggaagagatgaattacaaaatacaaccttgtttgaggaagacattatgacagctgggtgacttgggcatttaaatggaatctgatgaagtccctcccaccattttctctataaaatgccaatggcatttaaaagtagtgtcaccagaggagccaatgtatatttttatactgcaattaagcaattgagtacaaaattcagtacagtcagtgggaatgtgatcagatgaataaaggaagtcagagaagataatcatttcagttctttccctaattttgctttctagcctggtacttaaaattcacaggctcacaagtctcactgggctccagagaagaagcctgactcctccccagctgtgtactctcaggcaaactacgtagactctacctcagtttactcaattttaaaattgagatcataattcttgtcttctagaatatttgtgaggattgaatgaaatactatgtataatatgcacattacatagctaatgctcaataaatcataactttatgattagcaatgtttgtttccctcagaagtgacctaaaaccaacaacaacaatatttttattttgctttctatgatcactgctaattatgaaaaaaaaaatgtgcctgccttgatgcttaggaaagaaaaatggttgcaatgagagagaaagcagtgtttccagacttgtgatgactttattcagttttctgcattttgtttctctctggcagttttttttctcctgtcactttcaagattgaacataattacagtaatgaattataaatgaacataatatgtaatgaatataatacataaagtttattacccccattttcataattctgattccaagttagagatccccttccaagataggctccatagcctcctgtgtaagatgtctctgcccaccctaccccagataacaccacccagtttgtctcctgcaaggcacttatcacaacccttaatgttttttgttattcgcagggggtcctgatccatgccccaaaagtgggttcttggatctcgcacaagaaagaatttggggcaagtccatagagtaaagtgaaagcaagtttattaagaaagtagggctgggcatggtggctcatgcctgtaatcccagcactttgggaggccgaagtgagtggatcacctgaggtcaggagatcaagaccagcctggccaacatggtgaaaccccatctctactaaaaatacaaaaattagccaggcatggtgacgcacccctgtaatcccagctacttgggaggctgaggcaggagaaccacttgaacttagtaggcgtaggttgcagtgagccgagattgcgccattgcactccagcctgggtgacagagtgagactttgtctcaaaaaaaaaaaaaaaaaattaaacaaagaaagtaaaggaataaaagaatggctactctatagacagaacagaagcatgagctacccagttgcttatacttattgttacttattgattaatgctaaacaaggggtggattattcatgattttccaggaaagcggtaggcaattcccagaactgagggttctttccctttttagaccatataaggtaactttctgacgttgccatggcatttgtaaactgtcatggcactggtgggagtgtcttttagcgtgctaattagaatataatgagcagtgaggaccaccagaggtcactttcattaccattttggttttggtgggatttggccagcttcttcaccgccacctgttttatcagcaaggtctttatgacctgtatcttgtgccaacctcctatctcatcctctgacttagaatacccatccttctgggaatgcagcccagtaggtctcagccttattttacctaacccccattcaagatggagttgctctggttcaaacgcctctgacattttcatttatacttttcacatatgtatcaacatataatataaaaatttaaaatgtcatatattatatattaatacatattatatttaccatcattagaatgtaaattctagtaggtcagtgaagaaatctgtcttgttcaccactccctctctagacaatagctctgtgccaggtacatgcagacactcaatgtatattgaatgttgaagaacttttcctgcaaaccgtaattgccacctgataggtttacacattcgattgtcttttcacctgctcttatataaatttgtgctgagacacgcaagccatttgatgttgtagttattttttacagtagaggtgctttgggaaagatgattgagatacctccttataatcttagaatccatcctaaaatgtcttctactcagataataaatgccagtctttgatttgatatatttaactctttaggtaatatttacaatacatagaactaactggatttagtaagatgctttaatttactgatagcatgctacttattagtgtgtgccttcaagcatcaaatataccaaaaaaatgatcatttttgttatggtagcagatagatacattgctccactggtgtctttttttgtttttttttttgagatggagtctcactctatcatccagggtggagtgcagtggcacgatctcagttcactgcaacctccgcctcccgggttgaagcgattctcctgcctcagcctcccgagtagctgggactacaggcgtgcgccatcacgccaggctaagttttttgtatttttagtagagatggggttttaccctgttggccaggctggtctcaaactcctgacctcgggcaatctgcccaccttagcctcccaaagtgctgggattacaggcatgagccactatgacccgccttcactggaattctttagctagccttattttacttggattctgattgaaatatgttctcctcagaatacaggatgaaacaaagctaatttaaggtgaccaagtttatacattaagtacaattagtgcatttttcaccagaaagttggtcactactttaagattttaccttcattttcattagaaggtattggttaatctattatctcctctctctaactgcagtcatcatattaaacttttgcaaattttaggtgacaaacacatgtcgaatttacatatatacaggcataatttacatatatgcatatacaatgtacaatatatccagaaggtaattagcaactggttacagtttgctactaatgtacaatatatccagaaggtaattagcaactggttacagtttgctactaatgaggtcaagtttacagatctactgttcctctgagtctgtcttttggctctgttgcattgccacagatcctatcatgatccctgggctgctgtttcacacacgttgtttgtcacaggaggggggccatgaaggaggatgtgattgctcccctgccaaccccctacctctactggtcaaggatctcagcatttttctgacgaatggcatgggcgggatgcgctccatctttgcattctctatgtgtcaggctgtgtccacagggaattgtctgtgaagggtttttaaatcagtgggaccagtaacaccatctttatatagtgaagacagcttatcattaaatatagtttgagacaagcttaattgtgcaactgaaaaatattttcgataatatttacaacttttatctatttagtgttattagatgaagactttatcatttttttccatcatgcctttggttttgtgagcttcttttttgtttttatttcccgatttctttctttcagatacttttaatcaacatttcttcctttggaaaacaggtcaaatgacaatgcgaagggtgatcaaggagaaaatgtgtgaagtagaagcctagaactcaagagaaatgaataatatcttggcatcacttactttgctttaatttcttagttttactcctttaatgtaacaactgtttttcatttaaaagggagtcatgaaacaaacatctatataatattttggggattaaaaatgcatttgcaaagttagatttattggtttttatcttaaagacataaaaacttgatatcatatttaattttgtgctcaaacttaccgataacacattacttaatccttgaaattatttgctttattccctgttgtggattaagatgagtgattttattctgaaaatattaggttgttgtaaaagtaattgtggtttttgccattaataattcacaatatgagagcaattatagaatctagctaaaattatatgtatttatccatctctcattattcatggtagttatcttctataaagtctctgcaaacactgaattagtaaatactgaacaattactcctggtaggtaaataagagcttggttcctgcacgactctggccacatttttgtcaatctatcaatacataatcttattttatatgtatttctgtttaatgatatcttatgtaatacatattgtatgctcattaatacatttatttaatacatattgatttaatacatatcttatttaatacatattttatgctcattaatacatttatttaatacatattgatttaatacatcttatttaatacatattgtatgctcattaatacatttacttaatacatattgatgctcatgtgctttcgagcatcaaatataccaaaaaaatgatcatttttgttatggtagcacatagatacattgctccactggtatctttttttttttttttttttttgagatggagtctcactctatcacccagggtggagtgcagtatactcacagtatactcatagccaatagcaccgtaactcacccctcattgaagcttgttcaacacagtttttttctctgtaaggcatgttatagcctccttgtgcttaagaaaactagggagcacttctgcattatttttaaacagcaagtcattttaaacagcagaatcataaacaaaaaacataaaaatgagaagaactaaatagaccatgaaaaaaccacttgtttatagtaagagaactgaaacatgaaggcagagtttcactttgttcaacctcagctggcaacatgtgtagggggtaactcaaattttgtgattctctgcacatgttggggaaagatcacacaaatattgtgagtattaatttggagtacaaattaatattagcaaatagctgtatttgcaaatatggaatctgtggataatgagaacagacagtatttatattctaggttagaaaagagaaaatgagctccttttagtcatcagaagccaatgaaagacctgggtttagtattttcttccatctcttgatttctgtttgcttaattgaatgacaaattctaattagtcatgcctgactaacataatttaggatgaaactatgtcttcatcactctctacttctgaccctggccctgttcctagagtacagtaggcattcagttaatgcttgttgaaagaatgcataaacccctttcctcatttggaactttatggaattgctgagaacatcagatggcaataaggtgattggagctgtaatcacacacaaaaagttgtctattttaattagccaggtgtggtggcacacacctgtaatcccagctacttgggaggctgaggcaggagaattgcttgaacccgggagacagaggttgtggtgagcagagaatgtaccactgcactccagcttgggcaatagaatgagactctgtctcaaaaaaaaaaaaaagaaagaaagaaaaagaaaaaaagttaaaaccaccaaattgtttattttctattttgaggattttaattttgcttaataacatagtcattgaaattaatttataaataatattgtatagttcaaaacattaatataggacttttttgctgtaaaccagggttgcctgtttaatatttgtatttcattatgagtagtgaactagtatctcttgtaatgcaaggtaaagaggaagaggttggttaacaaaaaggaactatgttaattttgctattaataagggggaaaaccttttgaatttatttatcctggagacacaaaacttaaactcataatgatgtcatatatattagcattactatatttccttattattgcaaatgtattctacccaggtcttttcatcattgtagtcacttaaaaaacatattgggtaagttttattatacaatttttctcagattgattttagttttattttttcttttctcttcttttcttttctttttctttttcttttttttaacctcagaaggaattagatgtccagtataaagaagcctgatcactctggccttacttggctttccaataatagtatttttaggatcactgatataaaacctacaaagtaagtaatttggttcatataagcaggcaagtaataaattttcctatacattgttatttctcattaaatacatactattactctccaaataagagatttttagaggtcattttttttctcatttttttaaaatactgactgacccatatttgcactggtagactcagaagtgtttggtttatacttgttcaaaatgattgtcagcagatgtaatgagccttggaccagtccagtaacttggctaacatatgtctgcagaaggattttaaaatcctgctgactaggctggtcctgtcgagtctcacagcagaaaaattgtcttttgcagctcagcttataaatataacctttgtgtgtttggaaatatcccttctaaggcaggacttatgctcaccctgaaattcaaatgttcattttgatgtcagcactaaccaggagaaagaaaaggtggaaacgattcctcttgcacgtttcagagtgttagaaaccgcctattatttgtgtcttgttctttgctgctctgtacaagctctagaagtcataaaagtgttcctcacaaattgactccttagaaatgctgactctgtgtttcaaatcttataaaaatatctaaatggtagacgtattgttttcattacagatgcattaagtcaaaactgccaaaggctgtgttgtttctgcaaacagggcaactactgcttgaatggggctaatctgtttaggcactgaggggctagctgtgctgtctgcacatatttaatcacaaagctttacttgactttcccacatatttccttttagtatttttacttatggaaagcaagaatcaggttttatagtcattcagtaagtcctctttttaaataaaaattgttatattggaaacagtgtctacaagaccactggtggaaattaatatagccaatataattagtaagttggattcaccacaccacagtaggtaaatcttattgggggcaaaaattgctatcttattcacaagtgtgttgagctgttcttgtattgctataaaggaatacccgagacttagtaatttataaagaaaagaggttagttggctcatggttctgcagtctacaaccatggcaccgctcagcttctggggaagccacagggagcttttactcatggtggaaggtgaagcggaagcaggcacgtcacatggccagagcaggagcaagagggagagagtgggggaggcgccacacgcttctaaacaaccagatctcaagagaactcactatcatggacagcacccagccatgagggatctacccgcatcacccagatacctcctaccaggcaccacctccaaaatcagggagtacgtttcaacaggagatgtggttgagacagatatccaagctgtatcaccaagtgaactaccgaagctttttattgatttgtattaagccaacacatgggtttacccagtaactcatgatttttacacaaaaaccaaattaatgtttatcgaacagttatttggatataaatacatagatatagcacagtgcttcaggttagtttataaaaatcaagtctttcctttaaataataaatgatttatgcattcattcaaatttagaatgctgaggaataaactacaaaaaaaacttgtggctgagtgcagcggctcatgcttgtaatcctagcactttgggaggccgaggtggatggttctcttgaggccaggagtttgagaccagccttgccaacatggggaaaacttgtctctactaaaaatacaaaaaattagccgggcatgatggcaggtgcctgtagtcccagctactctggaggctgtagcacaagaatcgcttcaaccggggaggtgaaggttgcagtgggctgagagatcgagccactgcactccagcctgggccacagagtgacactccatcaaaaaaaattttaaaaaaaccctaattgaatctttccccctgtatttctgagaaaaaggagcaaatataaaataaacaaaaagaatacatatggaacatttatttagaaatcaaagacccagcgtcatacgttctaatgtttgataagatactacccagtttcctgcaactttcacttttgttctgtcaaagattccaaatgatgattgtgagccactgtaacctgaagacatattggatacatttacttatgtgtgttaaattgtgattcttaatgctattttgtggaaaggctggagaagattttttttttttttttgagatggagtcttgctctgtcactcagcctctggggttcaagcaattctcctgcctcagcctcctgagtagctgggattacaggcagttgccaccacacccagctaatttttgaatttttttgtagagacaggcttcactgtgttggccaggttaatctcaaactcctgacttcaggtgacccatccaccttagatttttaaaataaaggttacaggctgggagcagtggctcacacctgtgttctaagcactttgggaggccgaggcaggcagatcggttgagcctaggagttcaagaccagactgggcaacatgacgaaaccctgtctctatacaaaattcaaaaattagctgggtgtggtggcaggcacctgcagtctcggctactcaggagggtgaggttggagaatcacttgagcctgggaggtcgaggatgcagtgagtcatgattacaccactgctctccagtctgggtgacagagcaagactcttgtctcaaaataaataggtacgtacatacctacatacgtactagaatcaagggggttgtttctgagttcattgagttaacgaggaaggtaaattaatcaggaccttcccaagttacccatgtaatattatttaattgtacatgtttaaacaagctcagattacgttgactgtgagtcttaaaacggtaaccacaaacaggttataccaagatccctcacaatgtgtgttgtctgagagaaaaatcttatcattttctttttttccacattcactattgttcctagattatgaaaggtagtcattcactaaacccttctaaaatattccttttttttccaaatatagaattattatattagtaacagtacaggcatgcccataacaaaaaatggaaactaatatagtcaatataattagtaagtttgattcatcacatcccagggtagaatacctcttgaccttcaaaactgcggtcgaccacaattcagattttgagctattcaccagtgagaatgcatggcaatacatgcctaattggcatagttacatgtcattaatttattccttttattcatttaacaaatatttattgaatgtttactatgtgccagacactataatgctgttctaagatagcttatattacttattattgaaattatacttattaaaatggtaataatttgtagagagattaaactttgttttcttgccctccctttctccttctcctcttcctttcttcctttgtttcttttctttctttgcctccttcttttgtgtagccataaacaggagtctactgggtcgtttctgtttgtaaggcacaatctgcctcccaatccccctcccaaaaaaactaacaaaatttagggaaggagctgatttcacatttcttcagagggcctgttagagtgataaaaggcaaaattattttctttacacgaacagtcacagaaccaaaaaggccaaggaagaagccagagagcacatagtatttaattaggagagtttctagtgtcccgaagccacagaagaagcagctgcttaaacattgcttaccctttgactaatggccaaaagcactgaataggagaaggattaacatggataagacttaaataaaagtgatacaatcatcagagcaacaacaaacaaaggcacattaaaaagtaacatgaaatgatgttaagaaagaggtcatggatgcaaaatgataaaatgtttcgttctttggaagtaactctttttttttcttctgttcttagtcatccatctctgtcagagttctcaaataaaaatgcaaaggaaagttagcaccactctaaaacagtgaagggtcagttctctgcttttggatatgtaatttgaatgggaagtgtcctaatgacaattaaacacaattttctaagcacaggaagaggactgataaagtcaagcaatggctgtggcttttcttttgtacttccgttactattaactatatgcaagttaacaaatgctggacagcctgtccagtgagcagggttgctccgttgccaggcttatgttttaagcgacgattgagtgtacacagatctaaacaatcatgtgcaaagtctaagtctctcattttgaattcggaagagagaaccttggtgccccttcttcctgaggaaatttgggaactatagtacaactccctctcaaaaaaaaaatactcctgtaattccatcctaactactgattgctttatatttttgatgtggtgaggagttcagaccccttcttagtgaatgcaatgtttagcacattctttggaatatactgcttgagtctcttggtgcatcagctgaaacttcattttaatatcccgtacgcacttagtagatacttgcctttcctctacattggtgattattcctggcctatcattcagttaagacctatcctccatatacagatttttatatcgttcatcgaaattaagacttgttgcaagtaataaaaactgaactcaagctacctaatacaaatggaatttactattttatataccaaaattctgtgaaaatacaggtgggactggccttagggatacctgatattaggatataaatcctgtcgcctttctctcatgcttttttttcttccctttgtaatcacttctttattatttgtcactgacctcttcatgaatttagaaccacggtcgtcggcactttctaactcatgctttcatagtttcatgaccacagaggaaaagaggctttggaaattctcaaggaatcactgtgactatccacacttgggtcacattttggactcattgcagcagcctgaaggttagatggtatggatgccccagcttaggtcatgagcctgcacttgggaaaaatgaggggaagttatttttaaaatggaaagaagtggaaggcagacattgtatccagttttatatatttatataaacaaaacactgtaagggggaaaatatagacttgaatcagaggagaagagttaaaccaatgtttatatatttctttaggtttgttggaatatatgtgcatgtaattatatcagcaaactacatagtgaagtcagggagacagattagagagataggaagagtgggagggagagaatgtgcaaaacaagcaacagaaagaagagtggggacatcctgagtttgtatgtgaggagaggacagataggagaggtacaaaggaaagggattagaacagagaattagttagaggatggggagataatacaagggagagatagccaggcatggtggtgcgcacctgtagtcccagctgctcgggaggcagaggtgggaggattgcttgagtcggggagatggaggcttcagagagctgtgatcacactactacacttcaacctgtgtgacaaagtgagacctcgtcttaagaaaataaataaaataaaataaatataagggataagtagagagatcatgagagaaaggaacatagagggacacagatgcaagaacagggaaagagaaggggtcagaaaagcgtaatttgtggagagaaaattaaaatgctattattattggtattattgctgcagttgctctcttttgcccattagactattttggcattattggcaggtttaatgtaaaatgagatttgtgagtaacattgatctccaaattataaatgtctttcaataggatatgaacaaatatcatagtaattctcaaagaatattgctatttttaatcaatggagtatacaacatattatattttaaaatcatacaatacttcaaacaccgtgaagagagaacaaagccatatcaaataatgaatgaatggttgtattacggaagtacttgtcctgatagaacacttcaaataccatttggctgctacttctctctgggtttgctttgtatcccatggagatgatctgagcttaagcttttgttagcttcaaagagagctccgttcttgcctcatctctgcagtattgaaaaaacagacccttggttaacaacaggaagccaaactgattttaatattgtgaactctttaccctgatgcaggaaatgttatctgggccatctcagtgggctggggattatagagctggataaggcttcaaaatacaaatgaactccataggtctggtacagctgtaaggtacaggggtagagaatattaggtggtcatcttgataatcatttgtgttatgttaatgcactccaaagtggacttgtttcttctacctgagtgtatatacaaccagtcttttcactattttcagtggttataactcaggaaagagacaacatatcaacatatgaatgtgggtatatccaacgagatctctcttataattttagtccataaataggcataaaaaatgtgttctttcagaaaacacttactggaacctgagataatacaataagtcgaattgctaaaaagagaccccatggatcacaggtctgacctaatatctagttttactaataattttaatggtataggtaatcacatggcatgggtgagccagggagagaggtctttgaccttcagtatagctcgcaaatgctttctttccacataagagcatgcactggacccacaggaaatctctaggtgacatgtgcagtttacattccttgctcaataggagtatttaggtaattaaaatctccatttatattcagatacttgcatagctttttccaggagaccatgcccataaatgcatagatttcaggtttgtttatcataagcagtgctagatagtgagcatttgatagatagggactgtctctaaatgccattaacttgcttgccaggagggtctctcattcatgagtcaaatctcatgtttaataggagatttgactgggctaccttgtttatttccagggagtggtcccttggtgaaaagagagaatgagtggtagacctattatttgaccatattcctcctaaataccttcttggtgatatggatacagagattagcaaaacagtcactgccttcaaatttttttaccatataagatgatgaacacaaaatcaacaccagagataatgtgcctaaacccttaaataacttgtgtgacacagaacaagtatctcaatagacagtaatattttttacgatagtattaacaatgccgtgttaaggtgctataacctggttgaatcttatttggatggtggagtcttagtggacaatggaatttgtacaagttttgagtatacttattctgctgacatttattgagtaacctcccatgtgccagacattatctgacgtgaaatgaaagagaattcctggtttccgtgagtttttagtcttagagaagacacagtcacgtaaataaataattgaaaaatatcataaagtgtttataaaaatctacttgttaagtatgagagtgcagcatacttggcctccagaaatgcagaaagtttcatcaatatacaaattaaatcttgaaggatgagtgaacacttactgggtaaataacaagatgaaagactttaggggaagagaatgagatgggctaagttagcagcatcagtgaacatatggacatgggggtgctgcagattcttaccattggttcccttttggatgttgatctaggaaaatgctggaaaattaggtttgcctcagatgatatattaggccaacaggaatgaatgataataaaaatagctaccaattttgagaaattactatgttccaggtacaatattaggtacacatttttaatattcatgacagattaggaggatgtaacatcttgattttataaataagaatttagttcagcagctagttagatactatgttgggatgtgcctccataactctcttactgcaaacccatccctctccatgaccctgtgtgagctcccctaggcttcgaagcttgcacattgttctcacctgacaggggagcagtgaaacaacactaggaggacaattagtcatcattcagagtgtatatcagtgtgcctctgcgaacacccacaggaaaaaataaatctacgaatagtgagattgctttggaaatacaatatcaaaacaaggtcactgctaccttctctctccattccatcgagattgcagctcctggcacctcttcaacaggaagttgttggccgcctctcccttgaaggttttagtaggagaatgaaaggatcagtattgggtttcagaaagataaattgcttaccaattgatggaaaatggcagcttagagaatctgtggttagagaaaattgtttgaaacttactataatatttcagagatgaagtaataagaagaatctggagtggcaaacatagatcaattgattgaaactaaaactaataagacttgctgtgaccattgaggggacccaagatatcagtttgaatcactacagtgagcagtgaggctacttagatagaaattgccagaaaaagaaaataaatgaacctttggatttactgagtttgtgggggctgaatgctaaagttttttgtttgagttgggggtagcttataggcaggcaggaactggctctgatgcaaacagaggtgatgggatagaagacatggatttgggttctgatgactttgtgagagtgaatgggaaagcacattcaatggcaagaaccttacaaggaggtagggcacaatgtggttaagctataatttttactatatttcttcatttttattggcatccaattattttatatgtactcactatttatttaaacagctttattcatggggtgcctattctgtgcaaggcaatacctttggcaatgacgacatgatgatgagcaaagcctgaatgtttcttactctcctgagtttattgtctagtaagagacaagcatcataagacattacactagtgaatgtataatttgaaactgagataagtgctctcgtgtgaaacatcttatttctaggaaaaaaaaaagtgcaacaaaaaaaagagaaaacccttgtgatatgaaaggtttccgaagaaagtgcagctgtgttaagacctgaaggataagagttgccatctaggcaaaaggtgatgaaagtaaaggattctccagactgatggaaaagttataacaagagattggagtgtttaggaagttaaaagaacatgtaattgaagctcaggagggggaagagagatgagagatgtgtgtagagtccagagcactcagaatttgcagaataataaggattttgatccatgttctgagtaatgacatgccattgaaggtttccattttttaaaaatattaacccagatctcctttacatgagcaatacagataggaagtgctgaggaatcaaagtagaggtagaagggattcagaccccagagtgtctacattaggagggagctgaacctcatcaagttctttccataggattttcttcatgcacaaatatgcatggctggcttagtctgcagaccacatttttggttcacctagtgtttcagatggcagatgacataactctgagtaaattagaagttctggctgtaccaaaaatatatacatcaggaaaatgaaaaaggaaactgttctgtgctgcttaagagaattcattgccaacctcctactggctgttctgacccaataaacaagcaaaagtgacttgttagagccagcagctatattttgagtaccattatccccactgaataattcaacacttaatggtggtgattttggttgctcagagaaggtattcttttgcaattgtgtagctctttgttgagattcagcattgtctagttaacagtatgagaagcaaagcagaattcttgctgtgaaaatcactacttctaaagagatgcggcattgccatatagtagttacattgtgcaattactacatggaaattacttgctgtcttgtagtctttttccggaaagaagacactcttttttattattattatactttaagttctgggttacatgtacagaacatgcagttttgatatataggaatacacatgccgtggtggtttgctgcacccatcaacccatcacctacattagctatttctcctaatggtatccctccccagcaccgcaccgccaacaggccctggtgtgtgatgttcccctccctttatccatgtgttctccttgttcaactcccacttatgcgtgagaatatgtggtgcatggttttctgatcttgtgatagcttgctgagaatgatggtttccagctttatccatgtccctgcaaaggacaagaactcatcctttttatggttgcatagtattccatggtgtatatgtgccacattttcttaatccagtctatcactgatggacatttgggttggttccaagtctttgctattgtgaattgtgccacaataaacatacatgtgcatgtgtctatcgtagaatgatttataattctttgggtatatgcccagtaatgggattgctgggtcaaatggtatttctagttctgcatccttaaggaattgccacactgtcttccacaatggttgaactaatttacactcccaccaacagtgtaaaagcattcctatttttccacaaactctccagcatctgttgtttcctgactttttaaagatggcaattctaactggcatgagatggcatctcattgtggttttgatttgcatttctctaatgaccagtgatgatgagcattttttcatatgtctgttggctgcataaatgtcttcttttgagaaatgtctgttcatatcctttgcccatttgttgatcaggttgtttctttttttcttgtaaatttgtttaagttctttgtagattctggataggtcttcgtcagatggataaattgcaaaaattttctcccaatctgtaggttgcctgttcactctgatgatagtttcttttgctgtgaagaagctctttagtttaattagatcccatttgtcagtgttggcttttgttgccattgcttttagtgttttagacatgaattctttgcccatacctatgttctgaatggtattgcccaggttttcttctagagtttttatggtctaggtcttacgtttaagtctttgacctatcttgagttgatttttgtgtaaggtgtaaggaaggggtccagtttcagttttctgcatatggctaccagttttaccaacaccatttattaaatagggaatctttttcccattgctagtgtgtgtcaggtttgtcaaaaatcagttggttgtagctgcgtggtgttatttctgaggcctccattctgttccactggtctatatatctgttttggtaccagtaccatgctgttttggttactgtagacttgtagtgtagtttgaagttaggtagcgtgatgcctctagctttgttcttcttgcccaggattgttttggatatgcaggctcttttttggttccatatgaagtttaaagtaatttttttccaattctgtgaagaaagtcactggtagcttgatggggatagcattgaatctatacattattttgagcagtatggccattttcacaatattgattcttcctatccatgagcatggaatgcttttctatttgtgtcttctcttgtttccttgagcagtggtttgtagttcttgaagaggcccttcacatcccttgtaagttgtattcctaggcattttattatctcagtagcaattgtgaatgggagttcactcatgatttggctctctgtttgttattggtggataggaatgcttgtgatttttgcacgttgattttgtatcctgaggctttgctgaagttgcttatcagcttaaggagattttgggctgagaagatggggttttctaattatacaatcatgtcaactccaaacagagacaatttgacttcctatttgaatacactttatttctttctcttgcctgattgccctggccggaacttccaatactatgttgaataggagtggtgagagagggcatccttgtcttgtgctggttttcaaagggaatgcttccagtttttgcccattcagtatgatattggttgtgggtttgccataaatagctcttattattttgagatgtgttccattgatacctagtttattgagagattttagcatgaaggggtgttatattttatcaaaggccttttctgtatctattgagataatcatgtggcttttgtcattggttctgtttgtgtgatggattgcatgtattgatttgcatatgttgaaccagccttgcatcccaggtacgaagccaacttcgtacctggtggtaagctttttgatgtgctgctttttgatgtgctgctggattccatttgctagtattttattgaggattttcacatcaatgttcatcagggatattggcctgaatttttgttgttgttgttgtgtttctgccaggttttggtatcaggatgatgctggcctcataaaatgagttagggaggattccctcttttcctgttgtttggaatagtttcagaaggaatggtaccagctcttctttgtacctctggtagaatacggctgtgaatccatctggtcctgggctttattggctggtagattattgattacttcctcgatttcagaacttgttattgttttattcggggatttgacttcttcctggcttagacttgggagggtgtatgtgtccaggaatttatccatttcttctagattttctagtttatttgcatagaggtgtttatagtatcctctgatggtagtttgtatttctgtgggattggtggtgatatcccctttatcattttttactgcatctatttgattcttctctcttttcttctttattagtctggctagcggtctaactattttgttgagtttttcaataaaccagctcctggtttcattgattttttgaagggtttttcgtgtctctatctccttcagttctgctctgatcttagctatttcatgtcttttgctagcttttgaatttgtttgctgtttcttctctagttcttttaattgtgatgttagggtgtcaattttagatctttcctgctttctcttgtgggcatttagtgctataaatttccctctaaacactgctttaaatggaaagaagacactccttaaatgacttggtgggagcttttattttatcaatttctctctgataaattatactggtagtcatatctggtcacggataaactttatttcgtttttgactgtcaggcatgttgaattcaaattgcatgccaaaccataacatttaggaaaacatcatatctctagagttataattgatttgtgctaatgatatgttagtagaaaagaatgacagtttgatttctttcattcaaaggaaaatctctacagtaaggaagaaagtatcatggctaaaagtcacttttatttaatctcaggttttatcaaaatatttacagaacactttgtctttgtcacctgctagtcattcagtatatttcaatgacgacagtattatctttggaatcacaaaaatatgatgtaaaagaaaacttttctagagtagagtgaatgcttaaaaatataatatatatccaataaatgaattacagttaggaatgttgacatgattaagaacgcttgcattactgatagtgacctctgccctattataactttatagctaaaaagtttaagatctttcacagtttctccttcagtaatcctttttccaaactgaatttcgagtgcctagtaacttgtgatttttctaggaaaaacccatggtctttacctgtttgttctatagataacaccctataacttgcttttttcacttaacaaaaaataatagatatatcatttatataacagatataaggcatactatacattatatataatataaatgtacatataaataaaaataaatataaatgtctggaagtgttcatatcttaaatgttttctggcagggatggggagaagagggttgtataatcttcaaatttttactgaatacgttcctttgccattattttctgttacaataagaatatattttattgtaaaataagtaaaaacaaattaattaaaaatggtacgtgatgataaaaacagtagttcttagaaatattatcaatattggaatcaaaacacataagactattaaacatgtgtatttaagtaaactgcacattatatccagaaaattgaatctaactggttatcatgcaaatgaagaaggtaatcagttcaaaaatgacatagtaactgatattgccttcctgttcttatttcttattcatggaaaacgaggacaagatatgaagggtttagggatctaggtcattggcccgggatttggcattaattcttctcatacaagcacagggaacgatcaatcagtgttgacagctctaatgccatcgttggagcagaagatgagccaaaggaaattatgagtttcttataaatgtgtcttaagtatctggaaatcatactttgtatcttatggcttgaatagaatacgtttgcttttaatgatttgtacagtgagaagattaaaatttctaccaacatatccaaagcactgatacatctattaaactgtttgcaacaaaaatacctatacctttttgaatttgaataaaaaatcccatttaaacaaccactgggatgtgattatgccccaaatctctctgattatagttggtttgctttattatattccacttgaaaattttgaattgacaagagggatgtttctgtgaactacagattttagaggaaaataagactaaagttttttgtatcactgtttggtgtttagcatttttcaaccagtaaattgtctttaaccaaaaaatttgtctcagagaatggaaaaagaaatgtgatgacaaaaaaaataatgcaaaaaataaacagttatgaaacagtatagagataaaaaaatcaaaggtgagatatcccaaaccatgaactatttatcttaatcatgcagccttttcatctctgaaagaatctattaatgtcatattcaaatgcttaatgttcactagcagttgataattatgatgaccatccctgtcactacaagatccttaagtgccttttgatgagcaaagaaaaataaaatcatattcaagtaccaactgttggaattcgtactttaaatacaacctgagaaatggccttaggttaaggctaatggtgtataacttgctcacatttctaaagagtatattttctgacaatgattccatatagaaagtttaccgcagataatagtttcttcatatttgcatcctgacctaatttttggtcattaggttactttttataggtatcaatattttccaagtcctagagaaaaatgagagttttaattttctcttataacctagctaccagatgctatgtggcaaggacagtcttaggatgaaattgtccagacaaacaaatatgtattagccatcaaatgtacacatatgctcataagtatgtgtacacatgcacaagcatgcatttacacacacaaacgtacacttcacagaattataccctgtattctgtcagcttgatggagtcccagctgttaaacctttgaggcattgtgacagaaatctgcaagaaagcttcactagaggcagatgagataatattctagctgcaggattcagctacattttcgattggagtcataggaaaaaacactcattgcaaaaatgaatgaaatcctaagcctggagtgcaatgaaattgtgtttaggctgtggggctcccttgattttttaatatcctattcactcaaggatgcttgtgtctgagcaaacatttctagcaaatccaccaatatatacaacactacttgtttttttttaatggaacattctgctaacatcgactatagtgattaagccatacttacacacttaacatactttacgaaataaagatacctgaagtacatgtagtaaccagtgctgctacatttgactagagatttagaagagttttgtttaagaccttttgaatattgactgactatacttatggggtacattaaaattcagtagcctctacattaccacacagcctatgctaaagtattttaaagtaaatttcagaaaagttaatgatttgtttttgttgacacttttaagaaccactaaaacctatgaatatggttggccttaagtagacactgtaaaatgaatgaggttgagagatattcatttaaagttctattagcctttatggaattattgtgagaagcccagcaatgttcagctcagtgttttacattcagatccatatttactttaacgagtatttcagaaagtttaatttctgagttgtctttggatgaatgagaaaataaaaggaattcagaattttatcaaccgtctatatctatgcagattatattcttttgtggacatatgtatgaaattcattcgttcatccagaaggatttattatgtgtatttcctatattctaggcaagcgcaaaaataatgaataggatctggcaactgcctcataaaatgtacagtctcctacaaatatgtagacaaggcaggtacaaaaaattgtgagcccttgtttattttagttttataagtaatgtgctcactactgatatccacctgaacaatttgattaacacaaaaaactggagaagtagattaaaaccatccaaaacattgggagatatagatagacagctgatagatagatagataatcatataaacatagatagtcatataaacatagggagattatatatatagataatatctatattatagaacatatatatgttataataatatgcaatgatatctatattatataatatatatactagaatgataaacaccgttattaggtgagctgagacaggaaggaggcgcgttggtttgcctctccagaccttgatctggctcagatggagctccagttccttgcactctagcacgtgtagccctctgctcagcacggccccatccttatgcgatgcacgacagaagctcgccctgctggaactgctcctccagaagactgctgtttgcggcattcattttcctttcattatatttttttctgaatttgttctggatcgttttttgtttaaaatctcttcctcctcaggagtccgctgggcccccttcttgtggcccggacggtgcacagtggagctcgcactgctgttgccaaggtgcgcggccggcagctcctcgccagggccccggtgcaggccggctggctgtgggtcacacgcagacaagatcagcgaccctcgttttgcgagtgcaacactcccagccacagaagttcccgggtccagcctcagagcccagtatttcccacggcctccccacacacaccccgcgtggatgcggcgagggcccgccttagtcctggcagtgcgcaccccagctcagactcccgcttcttgtggcagctccttctcttgcccctgtgccttctgctgcttgtgccagttgtcgtgagagatgcccggtgctgggcgctggttggaaagaaaaacttaggtatatattttctttttctttccttccttccttccttcctccttccttccttgctttctctcttttcttcctctttctttctctttctttcttttctctttctttctttcttattccttctctctctctctctttctttctttttctccttcctcttccttccttctttccttccttccttcctttttttgaaacggtctcactctgttgcccaggcagaatcatagctcactctagcccgaaactctggggctcaagcaatcctccaaccttggcctcctgagaagctgggagtataggcacgtaccctatgccttgctaatttaaaaaaagaaaatctttgtagagatggggcctcactatgttgcccaaactggtcttgaactcctggccttaggtgatcctccagcctcagtttctcaaagtgctaggaatacaagcatgaggcactgcacttgatcctatgtttttctaattagttttctacttttaaatgtaactgtaagttgtaatcaaacattatatatattatcctttaaaaaattctgaatttattgttatggttaaatttttatcattagtttccagactcaatgagagtcatttttctattaatggaaaataagggacagacctttcagcttacctggaagtgcctcatttcttttttgaaaattcctgccatggtactgatcaatgttgatatatatgtgaaaaaaataaagaggagacaaacagaggggatggtatttaataacaagagaatagtagagaaggagagaagacagttttaaaaatgagcattcatgggttgggcacagtggctagcactttgggaggtcgaggtgggaggatcatttaaggccaggagtttgggaacagcctggacagcatagtgagacccctatctctataattttttttttaattagctgcatgtggtggcggatgcctatagtatcccagctactagagaggctgaggcaggatgctcacttgagccaagagtttaagactgagtgatttcaccactgctgttatcagtctgctgtgattttaggtgtccaaggtgggagtgagtgatgaaaatctgaaaaagaattaagaggatgttctctttaatttacaaatatatttttgaagttgattttttgttatagcttagaaatctgtcatatattattattgcttcctctcacatattgcagtttttctttccaggaagatttcattttttagtgttgttttaggttcacagcaaaattgggcagaacgtgcagaaatttctctcatactaccggttctgcatatgcacagcctctccgttatcaacaccaccagcagtgtgcatttgttacaactgatgaacctacattgacatatcaataacgccccaaatctatagtttacattcgggtttcttttggtgtatacattctacgggttttgacaaaggtatagtgacacatatccacaattgtagtatcatacaaagtagtttcactgccgtaaaaatcctgtcctcctattcattccctcttctcccttaacccctcacaaccacttatctttttactttctcaatagttttgccttttccagagtgtcgtgtagttagaatcaaacagtatctggtgttttcaaattggcctgttcacttaatgtgcctttaggtttccttcacctcttttcatggctgatagctcatttctttttaccactgatattccattgtctggacacagtatagtttatttatccatttacctaccaaagaatatcttggtgactttcaaattttgataaatataaataaagctgttaaacatccatgtacaagttttttgtggacataagttttcaactcctttgggtaaaaaccaaagagttcaatggctggatcacatgtgagagtttgtttagttttgggggaagccatcaaactgtactccattgtgactgcttcaatagtaatgcatatactatatccacaatttattgaccacacaacttttttttttttttttttacccagcatactatagcatcagtatctgtcacagtgagggtttgcacttttcaggtagggctgttcttccttgggcaggactgtgctgagccctgcaggtcgtttattatccacggctcctgcccactggatgcaaatagcactgcccagtcatgtgacaaccccagctgctcccacataatccaaatatcacctggaggagagatagcaccttggttgtaatccaaaaggctagaggaacacaaacaggtcttaccctcttatgagctggccatgtgggatgctccaggagtgaagctagtggaatgtttttagtgactgaaagtccttaagaaatgtgaaaagtggttacctggatttatacatatgtaaaagtttgctgagctgtacacttaagttttgtgcattttagtacatctgagatttttatttaatttgaaaaatagtccctacaggaatttcacagctatataagttgttttctgagaaataactcagaaaataacttaatgttgggattattctccatccctgtagtcaaatgaccatgaatttccgtaattttctttcttagtctccactgtgaaacaatttgaattagatgtcattacagtatactattttttaagaatcttacatgtataggtgggaaaacaaaaacatgtatatacataagtttttatataacctgtatgtatatataggttatattcaattatattccagttagagttcaaccacagtaatttgctatttaaataaatgatattattaatgatattagtttatcccacatcattattaactaaagctgacattttcccaataaaatcaatttgcttataataacatcgacattcctttgatctactgtgtacaaaatgtgccagctctgcagggatgatgagttaacactctaagcagttcttttgtcgtgtcactgcggtgttatgagacatgaaagagtgtttgaatggatatggctataatgcacagtgtttcctttgttttcagagtaaaagccattaacagttatttcaggattactgtgtttatgacacttgtaaattgatttatggtattagccaggcaggtgattgaacaaaagccttttaatgtttgtgtatgtgtttatccttctcagcttcacaatgttgagtgattcagatcacacttcaggcttatggaaatttgctggacctcctccccataagaactgattccaaaccaggggaatagtttaacctagcctgataatcacataaaaaggagtttcataaagggacacttgaggtcagagagaagtgaaggtgacatccactccatcatgaaaatgtcaaatggctttatataagacatcttgcttgatgcagctcagtgattcttaagccattttatcatggagagaaaagaaaatttaaacatttccgagttatagcactgtctcagactattatacaaatccattgagttatttttaaaactataatttggatgccagtgtcataaaatatctcttcctgctggctataataaaagttgttgatctatttcaagcatcctgagtagaaaaatgttgtttaatgattttgcatgcatgaagttaatttctacctctggaactcatagtagctgaaacaacttaatgctgtttcttagtgaagaggaatgtcaacgtagcatgcttttttttcccttcttttttggctgtgtgcattccatgttgtcaatgaaaatggcagatggactgtcactgacatttctgctttgtgtagttgctgccatagaaatgaaaaagtttttaaaatggtgacgataagagtcaccttttgttcactgaatttgctgtgttatattttcttcttggaaatttgacctaaaactgtttgtgaataattattcagaaaaaatgtcaaggatttttaaaaatcactaaaataaaatgtgctatgtcaaaccagctgcctttctaagctgctttttgcccatgtatcacactcatcagattctatttccctctaggataaagtagaaacctctttttttaaattccagcatataaatttgaataatgttatttgcaaaagggaaaatcgaagcatttactattcattagagccattagagaaccatagtgccaaaggttttgtgtaaacatgacatcatgactgttaggtgaaaaaaacaagtgattattaggaaatgattattattcagagtacattaacaatagccttgggtctttaaagtaattttaaaataatttgttttagtgttcagtttataatggtggaatgatctataattgtccaaagtgaaaacttagtcttaaccatttgtatgcattgttgcctttctatgctttattattggaatttaaacagtctccagtggaaacataatgcaaagttggtgaattaaggatcaaagcattaaagaaaaatgaacaggcatcatgtatactaacagctaccaagacttaaatgatggtgtactataaaatgggcttacattttctttaggtgggctataactttcaaaactcttaaaccaagaaagaaaaagcaatgagttacattagttgcttaaactaaatatgcagaacatacacactgatgtttaaagaaaccccacattttctcatcttgttccaatagaagaggtgcagacagtatggtagctttaagaaagtctttttttctgtttgttttttatttttattttagatgtatggcagcaggcattctcaagattttgtctaccttttgcctaaagaatctccttactgctgttgaaatattttaggctgatttctgatttccaaagactgaataaacattaaaaatgtttccattaggaaaatgttaaaatgcacccccaatagaaagattagcataacctccccccaatcttgcactctctctctttctctctctctctctatgtgtatatatatatatatatatatatatatatatatatatatatctgcttcagcaatattcattattgcatcaatttgtttattctatctcttctacctaaattagctatttctaccttgaaaaccatcccaaaacactgattcaataaaggaaacatttattattgttcctaagtctactgtttctttgggagattctgctgaacttagccagtcttgactgatactgaccagctggttctagcatctgtgttcagctgacaggttagtagggcagtctcatctaggatggctgccattttacgtttagtggctggctggctgttggccaggatgatggggatgatgggcaaaatgtctcttatcttccaacagggtagtgcaggcttctttttaaaatagctgagcagagttttcagagacagagagaaagaggaaaaaggtgcaaggcttcttgaggcctagactagaattcatcctagggtcaaaagcctaccagattcaagaagtgaggaaatagcttcttaggaggagctacaaagtcttattacagagagtgtgaccacaaagaggggaagagaatcagagaagattttgcaatcaatctactacactctcacacttttggggagagtattttatatcaatcaatatcatttcaccactatatactttagagaatttgcctttattttgtaagttgttatgattttgtaactctaatagcatccacaaagttaaccatgctccttggatcagaatattagtaggagggactatatcctcattgccactatcaacacaatgatcatcactttcactagtattagcaaattttatttatttttctctgctaatgacacattacctcacttaaatctcataagtgtgctatacagcagcaactatcaccccagtttgtacagctgagtgagcaggctgggtaaactgcccacagccatctagcaatggtggctttgaacccaggtcatactaactttcccatggtctcatcactgcacatcactttgtcatgtgaccagtcaggaggccacagtagctttgcacttacttgggaggccaagtagaatggacaaagacttagccatctctctcctccatttctcaaggaataatatgaatttaaattaagggagcaagttgtttctagatttgccaccatggagcacttttaaaaacatcaaggggatctatgtggtcactttataatactcatgatgtgtatgttagaggcttctgttttgaagaggcaaagaattttatttcctttttgttgtgttggaagttgccctaggaggtacgcacgcttgtccatgttaaactaatgtcttgaaatcagtgtattcttaattcttatcccactagtcgtactggagaacctgagggagtcaggaaggttccattgcattgaagcgactgcattgtctggggtaaatacctggggttcattgtctcatgtcaagaaaatttagaacatggacacatatgaggagtttagaagcagaggtttaataggcaaaagaaagagaaagaaagataaaggaaaacaactctctctctagtgagagagaggggcttcccagaggaaaaggctggcctgctgcggatgcactatattttatagacaggcttgaggaggtggtgtctgatttatgcagggcccacagattggttcgatcaggtgtgacgtttacatagtgtgcagaaaaggcttgccaccctactcttattaccctaatcttatgtgaatgggctttccagttgaccggtgccatcttgtctgctccttactgtacatgtggctgggaagggaagatggagccaccatttttgaacatgattggcacaactgccagggtctatgtctgcagctctattttacaggttgctctttgttagaaaataatttgggggctgcatttcattgaaaaggaaaaccttaccgaggactctagtaccctcactatctgcctaagtaatttcttcttaactcctatgtcagtaagatgtgacagtaagatatgtattatgttggtgcaaaagttattgtggcttttgatggcaaaaaccacaataacttttgcaccaagctaaatttttcttttgaagtggttggcagggatgttttttttcctaaggatgagctacgatcgtaggaattaaaatttaacccagtttacccagattcataaaaattaatagatttctttgtggatctgagttgatatcattaatataagctatcagacatcagcttcatgtgacttaacttcaaaaatattttagtaagagtatgactggaatgtttataacacaaagaaatgataaatgcttcaggtgatggataccccaattaccctgatgtaattattccacattgtatgcctgtatcaaaacatctcatgtaccctataaatactagatactcatagaaagtaaaaattttaaaaaaattagttcttgtcttagtgccagctccatcctgagtttcaacaattgctattatctttgaggtctagcatgaggcattaaatgccattgtttcaagaaagataaatgggaatataattttattgctatcttactgttgcaaaatggaattcctaagaaacataccctttatgaattctggcaatgaaactaagactgactttccgttttcaatctgaaagctattttggagctttcatcgtcagctaatggagtcttacttgaacggggtcacatttaaacttctaataatttttatgttgtagcctgtgaacatacaaatttcaggtaaattgaagctaattcctgcaggaggtaaggtcatatgtagaattagtcattattcatattctgaaaagtgatgatgtcattatgggagagaatttcttgggtcaagaccatgcatttaaaacgattaaaattcaaaaaatgggatcaccattactgaataattagtatctataagctactttactaaaattagagaccagtgaacttactgccctaagtcaagagattaatggaaattgagagtgttctcacttatttggctatctagttattcttgttccctatttcagaggtgagatgatgttaaatattaatctggaaatacgatctcctagtagcataatacttgggaaagtcttgctccttacaaataaaaggcaactcataaaacacatacatgagatgctcttaaagccatcagcattgaaaactaatggaaccgagtattaaataataactagattgcaagtaaagattgatatataataaacaatgactttagatgactattaccaaactgtttcagaaaaaaaaaaaaacaggaaaaagaaaattcgaaggggcagggcattgatattttcctcaaaattttcatattaataatagctacatggtttaatgtctcccaactttgtacaaatacgtaggactcaccttttgtagttaaggcagtattttgctttttataatgaaagcatttttccatgttttatttcattgattaggataactcatttcatcagaagagtagtgtcaattaacatagtgacacattgaacatatatgttaaatttaccagtagaagttaaattacaagtataagttatttgtcattagaaaatattctgaagcatacatgagtcattttttccaattcccattttaagatgggtcagttgaggtcagccagagtagaataatgccattactctaattcaggacaaagattcacaacttttttggaggtgggagggtagtattttcttttatgattaatataattttgttctcaaagtaaagcataaacagtgttgctgttccttaagactgctaaaactgtgaaacaacagccattagttactactttaaattttaccaatcggtacatatatacaaaagatacaggtctataatatcttaagatgcaatttaaagtgaaataataaagcggaaatacttagaatttaatgtaagtttaaagactttactatctctgtgttagctaacttttttcaccagttctaagtgaacacatagagtaattgatttttagaaaacaaaacaaaattacatacctgaaagactaattctcacattttggagcaaattattgtattattacctgcaagaatacatgatagacaatgtataaacaatgtttagacatctattaacacaatgtttcagaaaaaaattgaaattgtaagagaaagtaaaaaaaattaaaaccttaattcttattctatttctgtaaactttgaaatgaataaatattctgtttaaatgagaagcatcttacgcctttgtcttctgcttgaaccaaactcacatttgtaaatttcagttaaaatggtggcctttattcttttgttctttattatttctttcctctatcttgctggaactatccatcttctattagtgtgaaaactttgaagatgaaaagctatttcaccggaaaaatcattgatgtatttgtgatccttaataatgactcaaatgggaatagatatctaatatgaggaactgagtaaaaaagaaccactttttaaataaaattaactaaatgaagttattgtcttagccattaacactcatcagtcatatacaccatggaatactacacagccatataaagaacaaaattgtgtccttgcagcaacatggatgcacctggaggtcattattctaagcaaattaactcaggaccagaaaaccaaataccacatgttctcatttagaagtggaagtccaacactgaatacacacggacataaagataagaataatagaatattatggacataaagataagaataatagaatattatggacataaagataagaataatagaataattgtggactactagatgggggagggtaagaaggagtgaggattgaaaaactacctatcgggtgctatgctcattacctgagtgatggaatcatgtatacaccaagattcagtggcactcaatttacctatgtaacaaacctgcaaagttacctcctgaatctaaaatagaagttgagaataaaaaagaaaaaccactcatgtgtataatatcataccttccaagtaaaacttcctctgacttaggattttttggaatagtctgtggtttacaatagagtatatattcgctgtcctttattttacatacaaagaggaaaaactaatttcattcatgcggagttatgagagaacagtttcataaggaggaaacatactgccaaaccaaaaaaaaaaaaaaaaaaagaaggtatttaatttgttctgttgaaattttagagtttgtgaactaacatgttattctgtttgtgtttttagtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcaggtaaagttaaaacattcagtgcctattaatggaatttcatatttgcattttgatttttaagtagaatacttatggattgaggatgtgacttttctaccatatttctatatattctttagcaatctgtcatgagaattcatatctatctttttcgttttgtgggtggctgatacatgactgctgtaattattttgcaacccaggcttttagttccttatgcaaacttagaacataacaagaatagtaacctatagataagctagtatttttccatatgtcttggattatctgcaatattaccaacaacttcacttttgtatacttaggttagttaatcaagattcagaaattactggcattcaacaaattatgtcgaaaaggaattggatgaactttgtattctttttcaaaatgattatatttaagaatgaaaacaatgaattagcaaaacaataagccattttacaagtaaaagtataagatgatatgaactctcaaaatttacggcattatatagtgtgaattcatattaagaggttaaacagtagtctgatggaaatatataaatatatattctaacatatattggtaaaatggatgcagatttttagccattataaatcagtttgaacgaaccatggtaattaatagttaaaaaaatagatcagcatcagcaggacatggtgacacatgactgtagtcccacctatttaggagtctgaggcaggaggattgcctgagcccaggagttcaagactatagtgtgcaatgatcacacctgcgaatagacattgcacgccaacctggacaatatagtgagactttgtttttttaaaaaaataaaaactaaaaaaatctgcaaacagaacatatgtaatagtatatcaagtctgccatgtatagatcttgcagatttttcttgtattacatgcatatgggttctaaaagacccacgagaggttattaagacatttttatccgtatcattcaggaataatctctattgcatcttctgtatataatttggagggttattatattagaggtgttggttgtttattagaattttagcattgcaggtgatatttgtggattttctaaattctagagaaataatcttgagctcataaaatttaatacatcttagaaaagtgttgggacttaactaaaacgttgcttttgaagtgctcagacagactgaatgtcaatagaaaggaaacaactctctgactatctataatataatgtatttaaaaactattctaagggccaccttaaattacttgatgtacctattttatattatgcactttggaaagaactgaaattgtagttccatccccccaggtagaaatcccttctctattatttttaacagataagtaagctctgttttgacatttccatttcttaagaaattccacttatctgacctacaaatatacagacttaaagtctgctttacatttggctgaaatctttcggcctacacaatgtattagatttcttcactgaccagcctttttgtagaaattctggtcgggagtctaaagtaccttcatctttagtgaattcttttgctttgagtatgcagtagcaagttaagagcaagcttcttggtaatcctgtggaaaaatgttaataatttcacattgtcttccgaatagcaacgaagatgccactgagattactgattcagatttttgaccataatctctggcatacacatttattcttcatcatttcttactttgtcagtggtgaaggatgtgaaattttgtattaattcctggcccacatttttattctggttgtctcagttacttatgcattttcatgctgtaaggtccttagacaacaattgttataaaatattaatggcatattttcagaacatctgaatattattcatttatttcagggctctagagcactcacaaataaatgcaactaaggcagatatccaatttgaatgtcaaggagtctggtgtctctgtaattggcttaattatagaggaaaggatttataatgtagaatatatattcttataaacacccaaaggttattagctccgttccccaaataattagttattgctgagcctttacaaccttagcaaatttaggaaagaataatgttctaataaacaagttgttcacaagttattagctgatatctaagggactgtggccactgtgtatcatccctcaccgtttataactgcaataaaatttaaataatatgaatttgcaataagctcaagtcctgctctacacagaaatagtagtagtcagaaacaaagtaaatgtgaatgaaaatacagacattttgcatgttggtttatgaatatccagtagataaacactgaacttgagctaatatccataacctggtaaaactcacttatcagatttatcgggcaataatgaaaaattaaaaaaatagaattaatagaaaaaaattagagtttggaaaggcatttagtttttattctactctggctgtcaatgctcaaaatgtggtttccagaattcttggggtcccagggacacatccagatggtctgtgagattaaactgtttttatcataaacctaagacgccattttttcattttcactgcgttgtcatttgctctgatgatacaaaagtaatgagggctgggcgtggtgtctcatgcctgtaattgcggcactttgggaggcttgaggtcaggagttcaagaccagcctggcaaatgtaatgagacctcatctctaaattatatatatatataaaatatatatatatatatatatatataattatatatatatatataaaacgaatagctgggtgtggtggcttatacctgtagtcctagctacttgggaggctgaggcagtaggatcatttgagcccaggaggttgaggctgcagtgagccatgatcatgccactacattccagcctggcactggcatcaaatttactggtagtcaggtgatatttaatgtccatatactcagagtaaaaaactctcaaaacaaagcaaaacaaaaacagttttgcttatgattataattgttgaagcacttaaaaattattaatgttattaattatctaccttggaatacatactttctaacattctagtgaactgggaagtagatataaaataattctgctatgcgtcaaagtattatgacaatctctatttcttaattgcatcattgcttgagtcctgagctggacatcatctttactttaaagttatgactgacaaattatggttgttcagatagatataggtcagatattttcctgaaagtgaaccaagtgagcccattcatttcaagataaacaactgaccatatataaggtcattgattaaatgtgagtgttcaagaaaacattagaattgtggaggacatgtattgtccactgtaagcttgagagcttcccgatacttaatactgctgattagatcagtggcaattctaacaagtgtcaatttttgatattctataatgaaatgcatcaatgtttggaagacacaaaattcagtgagcgggtattttttccaaatgaaagctccatgatgttacaaaatcatttgtagattaaaaaaagtaaaatggtttaatggtacacagtatgaaaagttgattgatagggtttagatttcacatttcaatgaatgtttaaaaaactacacttgtatctacaatcatcagaaaggactctaaaatttcccatcattttttaactacgttatctgtgtacggctggattttctttatatctttgaacaaatcaaccctatttcaacagatgaaatgcagaagcagataaaagaatccatctgccttctcaagaaattgcagagatggcctttagttctagccactcgaaaggctgaggcgggaggattacttgagcttgggatttctaggctgcagtgagcaatgatcctgccactgcactgcagcctgcatgagtgagcaagaccctgactcaaagaattaagaaaaaagcaattacagagatttgcaatcatgtaaagtaatgcccttcttctcataatatttaaaggttttcataaaatatgtgatttactttaacattgaattattttaaataaattcataagtaaacattttgaaagacattttgaaagactttttcagtttttattcctgttatagtaaatattgttagctataccccacatgaacaaatgctctttgagatgtcttgtaatttgtaagactgcaaaagagtcctgagaccaacacgttgagaacaatttatctaggctaaatccttaatattacaaatgagaaaacagagagtggttcagggcctggtccaatgtcacaggttttagggcctcatttgcaactctactgtggaatagtacttatttaagttaggctctgtgcctgtctccaaattgcttttctcatactttatttgccaaagtcaggtccctgctgcgaaacagttttcatttccttgtgaatcaaccctgtctttttattagagattctaagaactgtactaaaactgggatgtctccttttgaaaaatattgagtgctcatcagcagtagatctttacacacttcatgatctatgttttatttcaaagcttaatccaagttgtatttccagcattagtaaatttattttatagttgtaattctcagaaatgtaatctcgctgctctactaggtgagaggcaaaatcacttcctactttatttatttatttatttatttatttatttatttatttatttttacttttatgaaagagtctcactctgtcacccaggctcaagcgcagtggcttgatcacacctcacaacagcttcaacctcctggtctcaaaattaatccagttaatttttacatttttttgtagggataagagtctccctatgttacccaggttgttcttgaactcctgggcttaagtgaccttcccacctcagccacccaaagtgttgggattacaggtgtgaggcaccaagtgtggcccactccctactttttaaaattgtgtttgtcttgtagattacttatcaaacactaacagagtttgtcacaagaggaggggatatttgaatatgaagaatctattaatgccattatgcatcagttattattatataataatggttattagtaagttaaattctctaaggaaacagaacaaaacttccaatagataagtgagaaaaggttataaaatgaaaacataaatgaggaataacaaacactaaacaagcccatgaaagaacatttattacccaaaaaaaaaaagaaaattaaaataaagggaataaggagtttatattttcctttgtaataaatgctaaactattttattattttgaaatgttagcattcactggtggcaaaaatatagagaaccactctatttttgttatttgtgtatatattctgtggtgaaatgatatttacaatttacccagagtaattaccacttgtgtccatgcctggaaatttatcataaatcagtaattcaaaaaaggaaaaatctatttactcaaaattcctattgaaatagtttacctggaaagaaaaaaaatggataataatctaatgaccagtaatagaattattaaaaattatagcatatcagtgggaagaaataatgtaaaagcagtacattaattataatgtgtttatagaaacacggaagattacaaacagaactttcaaagtgactgaactaagtaaaaatgcatatgcatgctaacatagattgaatgccaataattttaataatatatatttttaaattgtgatgacatagcaacttttcttctgctataaaaatcattaaattattctgggtttaaataaaatgaacatatattaaaacatgaaatgatggcagtgaagtgtattccttagaagtaagtacatgttgcaaagagagagtgagatttattctgattttcacttttgtatcatcctttcacttatcagtatacaaaagaggtttaaagtgttttcgctatagattaaccttgcctgctgtttgaatagtgtgtttttaagtacatattttaatatttagttcaacaggttccaacaatcataaaacagtcaaaagtccaagttgcctttcccttcgatgagtattttcaaattgaatgtgaagctaaaggaaatccagaaccaacgtgagtattgtttcaaacgaagtggttctttaaatgcgtgctgttctttatgctgctctttactcttaccatcacaagcctgttggactatgaatccacgcatgattaaagctaagggtttacaaaaaatcatatccatgcaaacaaaaaaaaaatttggttatttcacatatgtttttctgccacttgaatttattttgaccataaactaagggctgttattaaaatacttagagtagtctttggtacagcagaaatactccacaatcccttagtctacaaataaataaggtagctgaaaactagaagatcctttattctacttagtaaaatgtagcatttattaagtcaaagtttgtaaataccattctatacatatttataattgtgcgtctttaaatttaaacatcttattttgtggataggttgttacttgattttttttaagttgtcatagaaatattgtcatctcaggtggcagagtactattgcatgatatactactatctagtattattttattttagaattaaataattgttattctaggtgaccataatcactgatgagctttttcaaaataccttctatgtttggggaggaagaaaaaaatgtggatgtattggaagtgagaagggagaggctgtgggaagaattcccaatattaaaactctacgtgattctaaaatggaaagcaaagctacatacttttattattctgcatgattatcttatattcattaagaatatccatatttaatgaaaattgatgattttcaattgtatcatgactattattattgcctgatgggttgatatttaataatcattagtgacccattaacatgctaaattataattatttctatgtttaaccaaatggaatatattcaatcaaaatatgtaagtatggatagaattacaatggaattaaggataatttattcaatcaatatggatatattgatcaatatcatgatatattaatattaattagctgaattattatgtcaaaaggtaataccatacacttgtcaacagtgaaatataagacacacagagagaagtaaaataagtcaggagggtggctgggtaggcctactcctaatgagaatacatgtccattgaaggtttgttattcctgttggaagaataatcacatagattagtgtaagaatatggcgtcctgaaatatacccaaatttgcatgggtaattccaatatacaatgctgaatacaatctaattgggaagtcattgtttgtctatcagactgataaagatttaaagagacttcttaatgtcattgttcatagaactgacactctagcatactggggtgggaatttaactgtgtacattttttttctagaatataattttgcaacatttatcaaatactataaaaagtttttaattattggtttattaatcttatttctaaggaactggcatattgaaatatttggacaagtaccaaagaataaatatatagggttgtttctcacaatattgttcataaaaggaaaaacattgaaatggttaaaagtaattaaattagtaaccatatgacagaagataatgtagctataaaaattgtctttagtatcattataataatggaaaaattcagttggccaaattatatattcagtgtggtctcaaatatgtgacaaaattctaaaaatactaataggaaatattagcaagtgtaataatactgggcttatctgttttgggattttgagtgagttccttacacacacaaatacatgaacagaaattatatatgtttcttgtagtctccagaatattaataataatcttgtattacctttctaattaaaaataaataaataattttaatttaaaaaagcaaaagctaatttcaatcttaatcctctcatttatcaagctgttttatggacagtaatatttctcagattcttctgagacccttatttatatcctgttatattccattaagtatatactttttatcataaaatgtcttggttttgtcaattttatgcaattgttaataagtactctaaacatatgtcattatttttcaggattattaagttcagttttatgttttagattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtaagtactataacgggaatttcattttacaagtgttttagtgaagtgttaaataggagttagattgggttccaatgaaataaagcagttattaactaaatcaacttatatgtgtcttgtattttatttataaggaaaaatttcctccaggtcttgatacttaaaatcggatgaccttagaaaacaacataatttgactctgtttcagtaaccttatatctaacatggaaaaatataatatctgctttgccttataagatgagaattaaacatattattagttaaacttggctaaattctatgcagtaatagataaccccaaaacctctatgtaaacataaagttattccccgataaagcaatttactgtgggcctggcaactctttcatgcagccttcttgctgatcacagctaatggagacatcgtcattctgtggttgcctcttgtgaaacatgccattttggtcaaagagtctgggacgaaacatgaaaaattgtacactggctcttaaatgcttctgacaagaagttatgcaggcaactcctactcatgttttgttaggtggggcaaagcaagttgcatagtcccatctaacatcaatagtatgatgctcattaggaaaggagaaacagctattggtaatgttaaccgtaaataaaatttgtgtaaaactgcaagacactttgttgttagaggtgtatttatcagtaatcgtcccctgaagtagcgtactttattcatagcttatttgccctatgtgcatgggatatccatgaccaccttttatattttatcacgttttccccctgttcttaatatatccaccattacacaattttagccaaagcctttatagagtaaattggtaagtataaaactgtcagccagcttctattcggtaatttcttcttttagagtcctagatatgaaagtatttcaaagaaagtcctaggacttgcaaaatatgaacacttgattctgggggtgcagaatggccacaaacttcagaaaaacaaatgatgaatctttaacccaaaagttcagagagggcattgtatttaaattgtcctaaagtccttatataattctagaggaaggaatataggtcaaatttagactcggaagtaaggtgtgcatcttaaaatttataagtatgtacactaaaattataagaaaatagtattatcacacaatgtggttgatgcagggaagaaaaaataaaggagagaaaaaaagtaagacaagcagaaagaaaaagagatagaaataaattcaaatatatcacaaatgaaagacaaaagtaaatagaataaatgctctgagttaaaaaaaagctataaactttttacaacacatctatctaaaccttaaggatacagaattgttgaaatgaaaaagacagaaaagatatcccagacaaatgctttccaaatgaaggtaggtatgaccatattaatgtcagtcataacagactttatttgtaaaagccttcatggaaattaatttactagacatatataatgttaaaatacctgaagcaaaaatagaactacaaagagaaatagacaaattcaccataataatgagatattaacatatctttttcattatttgctcactcaagcagagaaaaacatcagtgagcatatagaagatttaaagaatacaatcacaagctccatctaatgaaaacacatagaatattgtaactaacacggcaaaatgagttttttcatacacatggggtaaaaggttatatttgatgatatattgggctatgaggaaaatatcaaaatgtaattaagttagaaatcaataataaatagaaaacttaaaaaacttatatctttgaaaactaagaaatacatttctaagtgagtcttaggtcaagtaccaaatggtaaggaaaatagaatatattttgaagtgatgacagtgaaaactctacataacaaaacatgttgaatgcagtgaaagcattatttagagggatctttatcattttaaagacatattagaaaaacataaaggatgaaaattaatgatcttagcttattaggtaacataattttaggataaaaatgaatgagctaatttaaggcaacagaataaactggagtgaagggagaaaatagtataaaagcagaaaataaattcaacaatgtggtatgtaatctttgtagtgaaagtatccatatttattaaaaaaagaaaaaatctagacaaatagaaaataagtaaactatttctatttattggaagaatctatacacttaaaatgctcattctcaatgggttgatatatagaagaattgaaatcagaacgcctatagtttagtttttgtttctgtttgtgaaatgtgaccagctggttcaaaaatatctttgaggaacaaagggcaaacttcagtagaaattattaaagaataacaagtcataggggattcttgttttcagaaatcaagattcagcttaattcaggaattaagccattatggttctgtgcagggttacacaaatcagaatagcatagtaaacccagaaacagaccatcacatgtgtaaaaatagttgagggaattggcatgttagcatggatctctctctctctctctcccccactctctttactttgaactaaacattgtggaacaattgataattcacacagagaaacatttatatggacttccacctcatatcatataaaaatcatctcagagtggataaaaggctgaacagtgaaaggaaaaaatgttttaaaaagtgagactatttgaacaatacgtttatcaccagggtcattaatacagagaaagatttcttttcctttcttttcttcctttctggcttttttgtttgtttgtttgtttgtttgtttgtttttgacaggaactcactctctccaggtcaggctggagtgcagtggtgcagtcatggcttcatggctcactgcagtcttgaactcctgggttcaagtgatcctcccatctcagccttctgagtaactaggactacaggcgagtgctaccgtgcctggccaatttttatttttatttttatttttgtagagatggggtctcactatgttgccccgggtggtcttgacctcccagcctcgagcaatcttcctgcctcagtgtcccaaagtgctgggattacaggcatgagccaccatgcccagtgtgggatgatttctttagtcatattaaagcctcatgaaggaaatcatcaagaatacattctcctacatttgattttagatcctttttttattgaaagactctaggaagaaagtacaaacaaaaataagccacaactcagataaaaattattgataatgcatataactaaaaatggtatgtattcataaataattttacaaatctttataaaaaaggaaaaatgacaaagtggcaacatatataaacttgaacctcagactggagggccaataaaaatgtgaaaatgtgttcaacctctttagttaccagaaacagacctattgtaaccctagtgataaaagcatttgatcctacccaattgggaaatatcagaaaatccaaaagtaaaaattttagattgcaatatacatccaacagaatacgtatccactactgatgacagtccagtttactgcgtgatctttggaaaacattttctaatcccctccttcgttgaagatgctcttacttatgaccaaacaattccgttccctagctcatgtgcatgtgcctcttgtccatacataccaggaagatttgtggtcacattgtttatatttaaaaatatgctggaaaaaatacagcagtccactcaaagtagaatggatcaatgcattgtgctctattcataccaaaaatactattcaatagtaaataaaacgtcaagaatatgttgagcaataaaagtaaatcttggagaaagtttgaaatatgtaaaactgactacaattttgattggtataattttattgttaaattataatgaaaaataagagaatgataaaaacaatattcatggcagtaattacctgtaatggaagtaaaaattggaaaatggaagtgggggttgagatcagcacctgacaaaaaggtgatgacgatattcctattttgtaaaatgggtagtaagtgaatggatttccattgtgtttctttctttctttgtgttttttttacatttattctataaacaattgttttatattcttaaaatgagtaagtgtgaagcatcccgtttgtctcaagtggacatttctgagttactgagatattttagaatcagaccagtgacatgtcaacctgaaaattgttctcaggagtttggatttgaattgactttcagtaggaaatgtccatgaattctggattagaaagtattgctatgaaaattgtggttgatcatcgttaaactgtatattacatttatatacttcactgaaataagttaagaccagagaaaaggacagataaaatatcttttgtaggaggcaagtcatgaggatgattcctaacctaaattctaggggttgctatggagacacaaaggaaaaggcagcagctagatctattgcaaagaaaggagcggcagaatttggtttaagattctgcaattaaaggatttcagtttttttttctgtcattatctaggcagaccaagtgaagacatgaacaatataaggataattctgaccagaatatgatatgagagtattgtattaagagctgggagttggatctgagctacgttgttggataattgctctattttttttattttttttttttgctgctgctgcagaaaagagcaaaataaattaggtttcttatgcatcatttccagcctctcctgaaattacttcatcatctgacagctttctgcaaccatctatatattgaatagtaacccaacccaatacttaggagtttataaatcagagacaatttaaagcttcctacaatctttaatcgattcttctcttaaactgtagagaattggttcttctcaaagattgatagaaactttgtgattcaaatgttacagtttctacttctcaatctcctgttaacaaacagaaacctttgtatacaatgtccagttttctattttcaacaacattgcagttaagtttcctagggaaagagtgaaagaaacaacaacaacaagaaccaaacaaacagaatgtaccatttttatatacacgaaaaactatttaactaaatgtattatccaagacatggcacagggattttgtcagtgagttattcaacaatcttcctgaaactcccataatacaccagccactttctagtaatttgggatttaacagtgaataaaaacaaagactgtcctccagaaatatacatcctgtgcatgtatatggtgattgggtctggaaaggaagggagctactctcttgccttcattatccaactatcagtaaggttaaaatgataatataaataatcctaatttgactgttgaatactactcacacttcagtgcacagattagatttctccacttagcattcctggcctattccagcctagataatttttttcctttttctgagtttttaaacaacttgtttgtttgtttgtttgtttttgttttgagacaggatcttgctctgttgcccaggctagagtgcagtggtacaaacatggctcactgcagcctcatcctcctgggctctagcaatccttccacctaaacctacccagtagctgggactacaggcatgtaccaccatgcccacctataaacatcttttttgaagtataatttacatatcataaattttacttgttttaagtgtataattactagtttttatacattatttatttatttatcttagagatggggttttgctatgttgcccacactggtcttaaactcctgggctcaggtgatcctcctgcttcagcttcctgaatagctgggattattggcacatgacactatgccccaccaatgacttttttagtaatttttttagtgaagtatcattataatgtagtattaaaacatttccatcaccacaaaaagatttcttgtgcccatttgcagtcactctctgttcccatctccaggccttaggcaaccaccaattaattttctgcctccttaaatgtacttttctggacatttcatataattggaatcatgtatatggtctttttcatatgtcttctttcacttagcatgttttggaggttcatccatgtagtagcatatatcagtagtttatttctctatattgctgaagagtatttcactgcatggatatcatttcctgttaatccatccaccagttgatgaacatttgaattatttccacttttggctattataaatagtgatactgcaaattctctggggttattaaagcatttagttgtgtactgttagggacagtctatcaattgtcatatgtattaattaggatccttaagaatgagaaaaaatatcagacagactgtcatatccttcccgttctgcattgccttgtagatgtcacaagaatgtgtattatatttatttcattgatttattggttgataggctgaaaaataaaagaatgaataaaagtaacactgcaatttgcacatgctattaaaatagtctacgaaatgtctgacaaagatgaaattttctatataataatttaatgaaaactaattagaaatattcatgcactaggtttctacatttgtgttaacatacttcctcagattcctcaggacaatttccttaagataaaccctggctttttaccaccctgattttggagggggagtgtaggaaacctggatgttgtagcctgtgctaaattctcctaagtgcaaatcaacaaaaacagatcaatttgttcaattaagggtgcaactttgaattctaaagctttaattaagttcgaggattttactctgattcaccaaagtatgtgaatgcctgtaatgaaatgggctgaactgggtgtccttccttagcatgaattcattatgagctcatggactgaaagccagtgttatttctctgtagtcctaagtggattaatgggatgttctgcaggaaatgggaatcaattaaatctctttaccaaaggaaaccggagttagaggtgataaagtatgtgcactcagtagcatgcagttgtgacaatgatggcagactgtgagcaattcgccaagcatatttaagtgaaatgtacggccctggaaagctcaccaggccagtcctgtaaacggagtgccaagtcaaaatagataaagctttttggtataggaagattcgtccaatgatggaaaaagggaaaataattcaataaacacatcatatgttctacatgaaatgaacaaatgaacaggattttcttccttctgtccttctacctcctctgaaaatgttaattcaaataattgcacaaagtcacagaagttgttgagatgcaggctatggagaaaatcaggagcagcagcagaagaaaactccctgtccctttggcctaccttgtctctgtgcgtttggctgtaccatgcaaagtgaaaatatttgaggagtagccaagatgtattgaataatttttaagtgcttgctcctattttaatcgattcatgtgaaatatttaaatttcaacataaatcaaatgagttaggtgttattacatttcccacttatgaatgacgacactgaaacatattaagtagcagattcaaagatcgcataggaagagaagccaggacgcaggcccaagcagctgacttcagtgtttatggataatctgatgctacagtgttgtctgtactttgagactcaggtaacacatgctacagatgagcaaaaaggcattgtacttctttgttgaaaataccttgatactagattacagtatcatctagaaataggaaaatataaggaaaccttctattttgttcctagagtgccggagaatctgtagtgttgcataacatggtagcggttaagatgccagtgttttttggtttttgtttttttcatcacagtggttagttagcatgaattgtatttagttaaatttccctgatggcatttcactactactcttcactattaaacatgttggcatgatgggattacacagcttaggttttattatatctctacccttaagaagcttctaccctggtgaggtgtttgaggagcctagagagatgaattcaaaggattctaagacaccaaaggaaaacaaaatgagatacagaaaaaggtaaagatattggtctgaatctttgtaaccagttagttttctagtgcctgggctagaacctagtttatgctgtaggatatcctatagatataaattctgttttcagaagtcttctttatttcaggaatgaagatgctatttttctgtatattatgttgaaataattgggatgatgagttttcaaaactcattgacagcatctgaagtcatagagctcctgcaaattttgtatctgcaggttggttgtgccttgatagttgtggtaataagactcctgtgcagctagcttgtctgtagggaagtgtttccatgatggatttcaactggggaagttttcaaaaacctagatgtgaatatatttgaatgtcacttatacccttggtgttagttgttgctagaaatctgtctatgacactgaataataaatgtgaaagcctaatggagaagagtgaaaagatagatgctgtgatatgcttgctttgctgatgcaaatggattaatagtggcattagatagaaaggaaattgatctcatctagacttggttataatgggatttccaaacattcttttgtttttgtttttttttttttttttgagacggggtcttgctctgtcgcccaggctggagggcagtggcacaatctctgctcactgcaagctccgcctcccgggttcccgccattctcctgcctcagcctcccgagtagctgggaccacaggcgcccgccaccacgcccggctaatttttttatatatattttttaaattatactttaagttctagggtacatgtgcacaatgtgcaggttagttacatatgtatacgtgtgccatgctggtgtgctgcacccattaactcatcatttacattaggtatgtctcccaatgctatccctcccctctccccccaccccacaacaggccccggtgtgtgatgtcccccttcctatgtccaagtgttctcattgttcaattcccacttatgagtgagaacatgcaatgtttggttttttgtccttgcgataatttgctgataatgatggttttcagcttcaaccatgtccctacaaaggacatgaactcatcatttttatggcttcatagtattccatggtgtatatgtgccacattttcttaatccagtctatcattgttggttccaggacatttgggttggttgcaggtctttactattgtgaatagtgacacaataaacatatgtgtgcatgtgtcttcatagcagcatgatttataatcctttgggtatatacccagtaatgggatggctgggtcaaatggtatttctagttctagatccctgaggaataacactgtcttccacaatggttgaaccagtttacagtcccaccaacagtttgaaagtgttcctatttctccacatcctctccagcacctttttttggcatttttagtagagacggggtttcaccatgttagccaggatggtctcgatctcctgaccttgtgatccgcccacctcggcctcccaaagtgcaaacattcttgaaattctgcttagctagactgttatgtgcaagttgattctgatccctttgcagagaggccattcaggatcaagtccagtcttgttgaaacaaagttaagtgatttttggttttggtgttgatgaagtacccatgtgaaatatattggcaagataaaggagtgtaattacctcatttaccgaaaaaaatatttttttaatttacttttaaaaatattactgttgtccaaactcagcaatgctaatgtttgtcaccagataaacacagtaaatgccactggttggatttatttttaaatggagtcatttctttatctgaattgaggtagacttcatgttagctgctgtgttatagtaattaaagttcacatttatctgtgagtgttaaaattttcactttttatcgtgccatcaaactcactaaatagtttcagagtcaaaggataagacataaaaaattcctgaaaaattaatgccatttatatatcttctaaaaccttaaatttattgatgtataagtatgcgtccctgttttccaatattcattttgtatttagttaaaagctgttctgaagatttatggcacgcgatagcagttttggtagagttataaattttcttttcttttttattgttggtgccttagaagccagttgaattacaaatttacattttcagaattagaattgtataatctagatttaattaatgcaaggatgataatgcttcagtggcagtactatctgttcgaattgctaggttttttttaacgctctcagggagcagctctccaattagggatttatacatcttattaattaactactttacaatagatattatccagtgaactgtgtattcatattagggactgtatagtttgcttgttatcgaagtggattacatgccctttccattttctaatccatattttatttcctctgctgcctcttgtatctgagtatagatagattcaccaactacccaacagcaccactgacttcaatgccagtgtttactgggcttaagttacagcgaataaaactaaataagtggttcaatttggagatttgggtacataaacgttttgtatattactatgccttatgtctataaggtgtactttctgcaaaatgttttccatagcatttgatgtcaatcaaagccgaggctttaccaaatagctggcatgatgttttatctacaagctcttaatgtagtgaatatactaaacatactttcccgacttttgagggaaatttcatgctacctatagcaaaaatgtgattcaaagatggttgctatttcaaaaatgtttccagagactttctaaaaggaatcttatagaacgagttgagcaagaggaaacccactaaaggactgtcacatggctgaatgtataaagagaaccaaagtctgccttccgaaattgcaaaggcagtgtaatagccacaccgccccctgcaatgttaagccttggaaggtccttgaatttagacaaaaagcaattcactgtaaccagctggtgcatcgataagagaaatgtcagcaaattccctcaacctctaaaggcatggatgggggttgaggggctataggacaaatatataggaagtgcacaaagcttctcaagaagaaattttacagtaaatgagtaaacctttatatttccaagaacaatgaaaatcggttgtgaatcataatttaagaatgaaacatacaaataaataccttctaatgaattccatcaagttgggactgttataactgccttcctaagatccttctcctccacaagagactgtgtaattctataatgcaaattcccccaccaaaagttgaaagatatcaatgtaatgctcaggaagaatacattttgaatatccttataaatatcaatacttccataaaaatattaaactttggtgttagatttcaaattctgcacaattctgacttatattctgattataactgcattgctcttttaagaaattgactccagtgtggggaggaaacaataggttgaaatattgacaagtctcatttcctacatcaattccatttcatttaaatttttatttaatgggagtaatttcaatgtggctggctctttttgcaacttaaagtggtcaaatttggctttccattgcattcttaccattttctccatatgggctgggaagtttttatttagtgtggttaatgcactggctggaatatttgccaatcacattcaaggccttcccaataaagcgagagatagagaatatgcaaccgcccaaagtgaaatcagtgtttggagaaaaagatttcacatctatcaaagctaaagcaagaaaatcctgtgactctgggtttatatctctgctcagagaaatatgcacaagtatgttattgccttattgttgtcgcataacaaaaacattattgtctggggtttcaaaatgcagaaatatttttaaagttgtgtaaagatgcacaccagtttcttaatagtatttaactctgaaggggagatgtaagaaccaggatctgtagcatagaatttatttaaattgctgaattttgaaaaaaaagaacatattaagatatttgttgttatagtcaaagttaattttaaaataacacattaaaatgattttttacaccaggtgttccaaaattcccaaaagaaaaaattgaccctcttgaagtggaggagggagatccaattgtcctcccatgcaatcctcccaaaggcctcccacctttacacatttattggatgaatattggtaagtaatgctccgttccatcaaaaaagggggacattttaattctatccatcatatcaataacataatgaatccaaagacaaaataaaaaataaagatctcttaattttttcatatttgaagaggagatgctactaatatgataagatttgtctgtgaagacaatacttcctatatttcaaacagtgcacttacctttggaatatagatcatgtgaaagctgaggatggcatgggtttgtgttgctagcttcatctttctattttagtaatgctctacctgctaattgcagtcacctaccaggaaattagtattaacttttttgcttaattttctaaaaggtttgctgactctgatctgaaaatctagctttgtaaagtctacttctagcatatgccttagcagtgatctctacatgttttctcattgtgaaccatagagaaaaatgctatttgcacagcactcagaagaaagcaaatgaagctactcttaggtacagccaattgttccagacatcagttcccctagaaccttccaggctgcaaccagaacagggagattaatatcacggataaaacttttggagagctttttgttttttctttttaaatcatgttttaaataaacgtgattctcagaaaatacaagtgttaattaggtcattgtctgcattgatcagttttcagttcagccaattcagattcatagggcagaggtggagacaaagatggtaaacagagtttaccactgtttgtctactggtggacttctttggttaatggtaaaaagtatcctcccaagggttttgctgctgtttttgttttgttttgttttcctatttgctcattgttcctgtagtaagaccagacttgagaggaattaaagagcaaacaggaaaaaccaaatgaaataataatgtaaaagaaaatgaaaaaggaagatgaagcacagtaagggacaattgcccttttcaatggcaagatatctcttttcagaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagttgtaagtccacataatttatcgtttcatcatgtatgctgaatgcaaatgtgtctgtaatttccttctggctgaagccatttaaagctgggttgatattttgcaccattgtgcagttcaactctggagacttcttccagatgaaatagacatctgcagctgcagattcacggtagctctgtctctcacagccaggaaatcacatctcaattcacaggacaaatgtatttcatctgacatctgcaggatcttgtcattttcagtggatgaaatatacaatgaaattccagggttttctaagcaaatcttgggcatcgattcactgtgatcttggataaactggcagactgaaaatgggggagaaaacaacagaggcaaaaagatggaaatttgtatcaccaaactggcaaacttacttgaatcaccctttcccgacttgattctgtggaggccagcctgggttcccaaatgggaagagtaattagagggaggaagaaccgtaagattcaaagggaagaaataatccccaacagtttgctgagcgaataattggccctggtatagttgaaagttggcattaccatttcattgtttaatttggtccatgattttttcatttttatgtgtagatatgccatgccagggcttcactataacattcttctagtagcctcagttctcttcagtggagctataacttgaatcttctccacctggattcaagattaaactcactataattattttctatgtaaaactatattcccaaaggcaatgttctagtgaagcatggttctacatcattttgtaatttttctaagacaaaaatatgacttttcattctttattgatatcagcatccaccattatgtttgtgttttttccttccgtttttttatttcagtaaagcatgctaatgactcaagttcatccacagaaattggttccaagggtaagttgaacccatgtggagtgttggcatttgtgtatagctcattgtcatctcagattttgaattttttctttaatatcctcttaagtttattacaatactgttattatgaaaaacatctgaacttagagggttctattgccccccatgccctcttaaatatatgcaaagggagtgatttttataaatatataactgtataaatataatgaaatacttatatataatgcattgaatagacagatagagatatttaatggagtaattattttgggtctcccaaaacgtctcttatggtatataaggttgatacttttgcagaaagaaaagaaatggttaagtgtcaaaagacgtagagaaaacactgcgtttaagaaagttaagtggatttttttcttgcaaggctttttgaaatatttgacatgcaactgtacattgtggctttctgagaaaaaaacagtttgtagcatttttcaagttcatgtgtctgcgtgatctttttatttaattctttcccccatagaacgtctaccagaacttgtgttctatggaaaatgcctgagtaaatctgagttgtatagcaggctagttctctataatgagaagagtcagttacataattgcagcaaatattctctataaaatgtggaccagtgataacttagataccttgcatacttgcaagttcagtggaggaggatgtaagctccttttgaagaaccgtcagttttaaggtggactgattcatccccaacatcatttcctttgagattaataactcacacatatatagtgctatattttcacagcactcaatgaaaaatcattgcacatagtacatattcaacaattatttttcaaaaaataaacacgaagtatagaagactgtctactgctaaagtccctttgaagatggaagtcttctaatttgccattgtatttgaaaaatattcttaagaaaataagaaatgggacacttcaatatgcaggtagtgaggatgcttactagtcatttcctaaaactgtgtttttctttaaggagctgagactacaggtagagttgccgaaagagcttgataaattcatagatgcctagtgtctaccacagccttcctcagtgagaatttctgagtgcaggagtgaggaagctgtttttagcagaaacctcgttaaattcttaggcaatttaaattaaataaaaacataaacataaagtcattgcacatgacatgattgaagtatagaatataaaatcatagattttcaattaaggacttctgtttgaccttctgagttagcagatatggtataaataataatatttataaaattttgcagtgctacgctcagtaaaaacatatgagggacaacccatgcttcatggtaagagagaagaggagtctatttaaatggaaatatgtgaaatgtgtatagaacacacacacacacacacacacactcgtgtgtcggattttttgttttaagaaagatgtggtgtcacagaattttatgtatattaatttgaaaaaattctgacttttcttttctattttgtagcaaattccatcaagcaaagaaaacccaaactgctgttgcctcccactgagagtggcagtgagtcttcaattaccatcctcaaaggggaaatcttgctgcttgagtgttttgctgaaggcttgtgagtaacctgactctcactcatgactttgtccatccagttctgtaaagaataagacatcaagcacattaagactgtgcttgcaaagatattttaaaattatttccttaaaaaaattaaattctgccgggcactgcagatattctgctcaggactgttattccaggtacttaagaggctgaagcaggaagattgcttgagcccaggagttggaggctgcagtgagctatgataatgccattgcactaaaacctggatgacagagaaagacctcatctaaaataaaatgaaattaaaattaataaaataaaataaataataaacataaattctgtcattatatctctggaggaagtaatttgtacttcactctacagacttcaggcagtaacaggctcataaaattagatctctctgtcaatttatgatattgtggatggaggggatgatgataacattctccttagttaagtttaagaagcctgaggttgttggtagtcagtccctcacttttggtgctgagttttctctctatgctatactacttgccccactcctgtttgctatgttacttactaaatctgctgctttgcaggttccaaggagccctatttatatctatttttactctgctgccctttgcacacatggaggtccagaccatgtaatttaagagagttttacatcaaaatctaattaagtgaactttctttacacctgaaaaagcaatccatttatttatttatttatttatttaattatttattcatttattcatttatttatttttttgagacagggtctcactctgtcacccatgctggagtgcagaggcgcgatctcagctcactgcaacctctgcctcctgggttcaagcgattctcctgcctcagcctcctgagtagctgaagctacaggtgtgtgccaccacacctggccagttttttgtatttttagtagagacagggtttcaacatgttagccaggaaggtctcgatctccggaccctgtgatccacctgagttggcctcccaaaatgctgggattataggcatgagccaccgggcccagcccgcaatgcacctttttaaatcctccaagaaaaccctaaaggacctcacttggtcacctcttaaaattgttccatttattaactactgttaagtacatgtaaacagggaccatcttatttaatatttaatcatacagggtctcctatttttaccactatccttccgaacttacggtccttccctaccattgaggataccttgggaaaatgcattccagcttcctagcacctgggattactcatttgaaatataatctgttcgtaagctaagggctttggggactctagttagtggactaggatttgaaattcaaaaaatcatattcattcataatttagagtacattctgaacgactggtttagaaatggagcagattttattggttttacagcccctaagctttgtaagtttctctttccaaccaccaaaaatatcaaagttgcttgtctgtcttcaactcccaatgtgtatttacataaattagttagaagtactatgacacagactctgtttggaatgtttggtctgtgtattattttagaagaggaaagtctcatattgagtttgaatcatgatggcaacaacctgctctactggttgtatttgtacatgtttacagtggtagaaattacattcttgcagagttcatcactgtattgagttgggcagggtgatcctttctgtaattcttttttcttatttcccacaaatgccttcactgacctcttggattgactagcaactgcgcagaatgtcttcaaaataatgaaatgctctcatgtgctttttagaaaatgaagagtcatgaaggaatatataaaaacagagtggatgaaaatatatgttgttgtgaggacatgaaaattcttgatgcgctgtcctaagacttttcacctgaagtagtttcttcttactcatactgattttgtgttgggtaatcctgtctgatctgggtcgtctctcagaagatgatacatttttaaaaagttttttgggtcctttaaaaaactctttctaagaagttttcaagccattaacctcctatagtaacaaaaataattataattaaagtattgtactattattttgtgtcaagcactatatttgggtctttgaaaactagtctaattgtctaatacattttacttgaaagaataaagtaaaatgattatctataagtgtcaggtgaacatgagatataatttatctcaagataggtctatatcttggcaagaatttccagctatattcttgcaaatgtttttcatttccttttgttttagatttaagggatatttaccaacagtatctgaacaaatgtgttttgagggaaaacttataaaatggccatagatggactcatgtgcactgctcaaatagtttttttttctgttttgtaaattcgtgggtttaaagtaggtataattctttcacaagatactactttataaatagagaaatatgcaaataaaagttggccagacaaggacctgaaaaaaattgagattatgaggtagtgtattttgtgtgcaaaaaggcattaagcaatatattttccctcaaaacacattgcttaaatgctgttagtaaatgttatttaaatttaaaaaaaggcaggaggtataaaaaaattggcaagaatagagctgaaaatttttgccatggtatagacctatcctgagattaaattatatctcattttcacataatactttagatcattattttactttattctttcaagtaaatggtattagaaaattagactagttttcaaagacccaaagactagggagtccgggagatcttgctgaaagtgagttacttgctctaataaaggatggactcttgaaaaaatcctgttttaggggaagtgagttccagagcagcctataacttggcaaattgtcattttgacagatggagtgaaaagccagcagttaggagacttgagctatgcatcctcttaggtggtgtgctcagaaagccagcagctaatatgctctcacagctgtctgcccaggcatcattaccatttcctacacaagcgtgccatgtgctcttagcctggtaaaatataagattattattccaggctgcacagcacgttagtgtttgaggcttgaaggaagaaggaaaagagtagatatatagagattaaagagccttcatctttacctccaattttttttgcataaataactgaattattttaaccacaaactatcaatacaaataatttgagaatattgacacacacgatttcaaggaattgctcaattattacatagtaactaatgggcaatttgacaggaagcatatattctaagactatagagttaggaaggacataggttgaaaagcacaaaataatagaacacactgataaaaaaggaacaagtttagagtagacaaatataagttggggtatatcatttattgctccagtgaccttaagaaattaatttattggagcttcagactccttactgttaaatgatcacaataatatgcccatctttagaactcaccaaataacctacagctactaataacaagaagaaatatggagaggaaaagtgttgcatcaataaaattagcaaagttgtttctcctactcacttatagaacctgactggggaagagaaagagacagtcatccttcatttagaaccaaccctttatgctttccacataatttttaaatcaaatgagtcacagaaggtatgacttctgcacttgtctgcttttcatgaggaggggtttttcttaatgtagctgccttgactccccagtccttttttcctccttactaaggtggggaaagttatcatgctggtgtgtaacaagttatcatgctggttttgttttgtctttactttcctgtttgttttgactgggtgagctaatcttttgaaagcgctaagcaagggaagatttggttcattcctcctttcctctgcttcccgacaagggcgagaacgtgatccaggaggcagtatctgtgctgcagattccagcttgccctggaataggctgttcatgggtctaatcgacatgtccagctttcacgcaggagccccattctccatgatcagcatcataggattaaaagggaaacttctctctgctgactgttaagtcccactttactgtgttttacacaaacagggaatagggctgttatcactggctgccccaaaccacccactgggagattttcacacttggaaaatatcttggtaatattatttcaatgagctccagctatttttccttcgctcagccacacctagtcagcacttacatgtagttagcccttgtaatagaggagagagaagacttccaaggagacagaccactggaggaactttcagtgaaagagacttgcttcaacaccagtgttcactattgttggtggtgggtgtgtctgtccactggtaaggatgacgtgattcagtggaatatgagcacatgtgtaaaagcaccctgataaaggatgtgtcctaaggttttctttgtattttactttccgcttttaaaaaaatgtttatttatttaactattttttgcaggccaactccacaggttgattggaacaaaattggtggtgacttaccaaaggggagagaaacaaaagaaaattatggcaagactttgaagatagagaatgtctcctaccaggacaaaggaaattatcgctgcacagccagcaatttcttgggaacagccactcacgattttcacgttatagtagaaggtacctttcccatgttggtctatttctctgcttttcaaaaaagtaactgtatacatgtagtaggccttgcttctaaatcatacatgttaaaacaggtcagcagtttcaacttttaattgtagtgcgggcattgaattatattacacttcaactaagcaggtttgtcatttacgccccaaaatgacatagaagggacaaatgacaagaaaagatctcatgttagggattaaacacagacagtttacatgatttattcaaatagtcattaaagctagtctcctaaattatttttattgtaatacacatatacatttcataatattaaatcataaaagcagcagtaaggattatgatgaaaggaagtattaaaatgagcctggaagaaagcttggatttaacttgctgtgccctttgccatttatttcactctccgtacctcaggctcttcaccaaagaagtgaaagaggcaggcaaattgttgtgtcagctctttcctgcatataacacttttgtaatccatatcttgggttcagatgataaattcagtatgttacttacaggcaaaaaagaatagactgtatgctataatattaattctctcaaaaagtgcaaaaacattatattcaagtcatcttctctctgtaaattcagagattttgatcaatcaaggttttattggtattagttacatttataggaataagtaggcaaagatgataccatttaaatgtggaatgtagttattagtgctgtgactggctgatgtgaagtttgtctagtcctctgaatgtgattgacacagactattttctgtggatccaatcacactgaggctttctatctacaatgtagttgaccgtattgatcaaattaatggaatgatgactgcatttgtacttatttagtgcagtgtaagcttagctactgaaaggaattattctttttagactacaatttagtgaactagtgctctaggcacccattaatattccagtaaagttcacctcttaaaactttagtttccacaaggaacacctaagtaatggcctgttgtttaaattaatggaaaaaaaaaaggactcagacacaaattctcctcccaagtaaatgttaacacagttgatttaggcaaacccctgtttggaataacactgcatttccaagccttctccataatgcatattattatttaaggtaggaagaatagaaaaccgaagttgagaattttattttctttgacttgacaaaagcaaaacttatatagatatgcattaacgtcaacatctgccaaacagtgatatattcctttgacattaaattattcacaaagaaattcaaggaagaagagtttgaaagatttatgttatgtatatttttagtcatcatttgatgtttctatataatttggctacatcgtgcaacaggggtatttttctgtaaccccctcctcccctccctggcacacacacacccacgaaccagacatatctaattgttagattctcctccaagttgctgactattagaaacacttccagatggctggaacatagctacggtagctgaatattttaacaatctggccacagttttcttgactataaaaccaaacctttcaaaagaattgcaagggttgcaaaaaacgaaatcaaagatgtaacattaattatgcaatttaaaatgttgactataggactccaaaggaatatagatttcctgaacaaattgttctcactactcataaaacagctattagcactattgagatgtaaatgatgtttttatgaagaacttttaatcctctctctttagtaagaaactattaaatgtaccttcagttgtatgtttttgaagtttctctttacctatacacatgaaaaacaaattgagcttaagaagtctttacttttttttctaaagtgtggaggtaataaataaaaactttgttaatcatctggatggatgagctcgtgtttattcaattttttctgccttcctgcaccctctccttttccttttttgtctcttttttagaagcccacattaaataataaggatttgccatgtgagaaaatagcaatgctattgtatattttgaaaatctactccattctgaaaacacccattgtgcttaagtaaaatcatggattcgattggattctttctgtatgtgcaatgtctttcctattaccaaacataatataatcaaatactatgagcttgtaatttaggttgcaacatcctaaatataaaatcagactgcacttcaaatcctataatatgtatgagcaaaagcagccaggatgtcttgactaggtacaactgtatattctaaatatctaagatatgattaattacacattcaataaaaagagatatattatagtgacatctaaaacagtctacatccagaaatcaaaatataatcacaatcacatttcaatagactatttaaaaataagctcccaccaataatttttatgttgtcaacttttgaattatttaaagcctttgaattttagtaagtgaaataggaaagcatttatatgtaattatagagccatagtataatccaaaatgtttttgcattttcaaaggttgtcataaaatcaaatgcaactcagtcattaatatacttgagaaatccttgttttcaaataacaaacctatttctaaaatgttgcgattaaatccaatttttgttgaacctaacaagttttgatttattaaaatatagattttaataagaacctgtgaagaaacagttttactaaaaataaccagtgttgtatgttctataggtaccaagtttgttttattttgtttttttcctagtgataaacatctctatttagcttgcttaatatatagtcccaatgttcagacatttgcatctgtttccagcaacatgagaaatatttatcatcttatttttgtatttacaattatgagaaaatgcataaagtttcaacataagcaattttcatctgttaccatatgtcttaggataatagataaaagaatgggtttctatgaggatggtatttttcctcagaatttttggttttaaggctcaagaagcagctgtttctgagcagaacaagcttgactcaagtccctcccaatattacatgattcaggaccagcttacttctataggagaaatggatgaaaagcattaaagtaaattttcaagcaattataaagaaagcttataaagaagggttaaggtaaagtatagtgaggaagcctagtgaatgctcagaacttcttgagtcagttgataaatattgggggagcttggatttggaagcataaattgggctggccttctttcctgtctttgatacaaattcataagataacactaaattagaaacaaaaaccacatgacttcagagtctaaatgctgctcatccatagttgctgtgtatttatctgtggaatggcgagaacaggaactggagcttcctttgctggtgggcctgggcaagttaggcaacttctccaaagctcagccctctgtctgtaagatgaaaggattggatgacgtgataatttggaacctctttcagtaatactaatattactaatagtcctaatagtaaatatcctaatggcaatagtaattattcaagaagatttacagaaatatcattattgcttgattttctttatttctgcatacgttgaaagcaatagttgtaattttctattataaatatgatatgccataatgttcatgttcatggaatatttttctctaacttacagatatttagttttatattggttgtattaaaataaccagaaaaaaagtaaggatatcattaaaaaaatgcaaaatagacaaaaataaaccttcacctcagaaaatgatcgcagtttataatttggactagtgtattttaaaccaagtgactaaacatttacaggtagtacagcttatgaatacagatatttaacttggaatttaacaattaagtccacaccctgtggagtaattacaaaggcacttatctcacttggacttgaacttgaacttgccaaggctagttgtgtacttttgtttcctctgatgaacttacagttctttcctttttacataatcctctttttcttcctttacttagaaaaattttaatgatattttttcattgtatacatacatatatctttgaagactttcgtttttagctaaaaatggaaatctaaaatatctttggggaaataaccaaactacacttgatgggagttgctacctgcaggttttgtgcaattttctctgaaatcaaattatccaaaccatcaacactttaatctaaaccttttagttacccctgacatagcaatattcatgaagttataaaacatagagttataaaaacatggaaatccagtaaaatgtgtcatctgtttctgacatactttgtagtattgttacactggagcattagggcatagaaagatacaggtaattttaaggtatattttgctgcattgttttgactgcagaaagctaaacactgcttttgggcttctctctctcccctcttacaaaaaaactctaggaaataatatttttcaagtagattatatgtataaatgctataagatcactaagaaatattcaaaataagcattaaatattttaattagttttatttttaaaattcttacaatataattcttgtgtatccacctttttagatgccatgctgcagcttgaaaataacctgtagtgagctctaaataaactcaccatctgcttattcttccctcattttttcctagtggggtagctacttgtatagctaaataaaatggttgtatataactattttcagtatgttgatgtatgatacatgctgagtccaaattaaacacaagcacacacacacacacacacacacacaccatacaacacaaaagcagctcccaccttgctttgcagagcaagtttaccaaaaagagctactatgaaaccctttgtggtgtctgccctctgctggtgcaaagtagaaatacaggccttaacatttttggactttttgacatagataacatctctcatgagctcttcactttacatccagagcctcctcgctggacaaagaagcctcagagtgctgtgtatagcaccggaagcaatggcatcttgttatgtgaggctgaaggagaacctcaacccacaatcaagtggagagtcaatggctccccagttgacagtaagtttaaaaaccaattgcaatgcaatgctgaaggccctggtttgacgggattaatgatggtcagacgtgtgtaaaatgaagttggtatgtggttggattagcaggacagatacaaccagcaaatcagagattgtttatttctaagcaatttggttgttaagacttgatattcatggaagagccataaataatatttatactgcctgtgccctcttataaattatatataagaataaagatttttaatttttaaaaagaaaattgaatgagaaagaggatgcatccaaggaaaaaagccaattattgttcctgtccctgagaagaaacagaacagtagcctagcagctgagggcacaggttcaaagtcaggacctcctttaggctcaggcaacagcaacacctgtcctgggctctgcccttttaagggacttgctctgatcaccctctggtcccgcttgtctccatgatttgaaagcatcctcagggaaaaggaggcatcccaagtctgaacatggtcccattactgcctatttgctaccaacctcaagcacaaagacctgaaaatccccatgcccggtccaccctgagcccactccaaatgggctgggcggggaaagacaggaatggcccagcactgagggccaactctccccatttcaccatgctcagcatagagctccaaggagtccccaaatcttccactggaacctagagctcagattattttggatgtccttgttcaggaagaaggatagaacatatttttacgtgtcaattgcttaattaagagcaggtacgatagtggcttccatttgtccttttgctctggggcctgcacaagtcaagggtgagccacttggtggataacagacctcgggtcccgtctaggatgtgcaccttgccagctgtttcatcttgaggtgttttctgaatctccccaagcttacgttttttaaactgcaaaatggagatagtggcggttggttgtgcttgaatgaaaaaaaatgtggccagctgcctagggcagtgattcatctgtagagcactgtgatggtttataaactctggagccagactgcctgggtttgcatactgactctaccacttactagctgcgtgacggggagtatcactgaccctcttcaaacccatttcttcatcagtaaattgggataaaaataacactgactcacggggttgttttgtggattaaaggaaacatcatgcagagaatgcttagcacggggactgccacaaaaacagccccccgtaaggtatggttggttggtattgttttcccataacagacactcaggaaaccttagtcctcattattaactatcttcagatttgggatttttctcttcatctctttagggaacagaataaaaaatgaaaaataataatgaggttttgggtagacgaagggaaatgaaagcaacttttgtttataatgaatgttcaggttacaaaagtaaggaacgcagattctccggaacacaaaatcataaaatattatatttggatggtatttggctgtttacaaaagacattcacaaattacttagaatcctcaaaagaactttataaaggaggtgctattattcatatttaactgattcgttcattcaataatatttatggggtactttctatgttcccggcactggacttcatgcttgagatatacaacagtgaataaaatggatggaatccttgctctcctgccattagacaaataacacatgagtgtgtgctatggtgtgataaagcagaaaatagctgggtaagggcagtgcctgaaagaggttcaggacccagagttgcaatcttaagatcataatagtaagacccctgtggtaatttacctttgagtggagatgggaaggaagtgaggaagtcagccacctaaatagcagggaaagtgctgtctcagtggagaggtgtgttgaggaggagaaaagaggtgagtgtgactgaagctgagggagtgcaaggggcagccctaggccaccagatccgccagcaggggaaggggccagagctcaggtaaagatgaacatcgaagtagggccttgggattttgagaatacactaggcagctcttggagaattttaagcagaagagtgacacaatctaatttacatttttacaaggtattttcctggcctttgaatggagaatggactgtgtgattgatactaggtaggaggccatctgagaggctctgcgctcagggctagattggtggcagtcatggttggcttctggatttattttgaaattgagccaataggtttgttaatggatgaggaggtcaaggctgaaaataaacttatgcgagaccacacagctgaataatggtagacttcaaaccaaagccaggtggctggaatccaagctcggtgttctgttcacagcttttggccctggctctacttgttgccctgcaaacaggtcgtaaacttttataggctgggatatttgatgacagagtgttggctagaggatttgaaacctctttaagcttattttagttttagaggttatatatcctttccccatgttatttcaaaattaaatcaaaatgattgctattattgattatcggactaacccttttcacatgctttgcatatgatatttctgaacctcgtagcagcttgaaaaatagattctattattctccattggcaactgagactcagagaggttacattacttactggagaatgcaacccaggtacatttaaaaccaggaactaaacccaggaaggattaactccagagctgaagtttcgtccattttattgcatgatttctcacagggttgaccaaagacaaaactgagaaagaatttctgaagtatgtcaggactagtgtgttttataaagacttggccttcttgaatcctgggagcttctgttagcctttgtcaatacacaacaatttccatacccatgccaacaggcagatttaagcaatgtttaattacttaaataaagtatcatttatatagtctaatttcttacttttgtaatgcagtgttaattcagagccatgcatggatcagacgggataaggagaactaaatgggaggatggcgttaactctgaaagtcttaggaccctgagtggggtgtggaagtgaagagtgggattagagactcagtgctttgcagcattcctaaagagtttagcctttaaaaacttggaagagctactcatcttgctaatttgcaagaaataagtgataaattgttcaacaggattgtattagttttctaacattgctgtaacaaattaaattaccataaacttagtgtcttaaaatagtgcatgtacactattttacatttctgtaaaagtccaacacgagtcttggctaaaatcaaaatgtcagcagtgccatgtcctggaagtgcttggagagcattccttcgtttgccttttccagcttttccaggctgcccacattcctggctcccttccgccattttgaaagccagctacactgcatctctctgaccatccttccatggtcacatttccctctgaccatagccaaggagggccttctgattttcaggagctttgtgattacattgagcccacttgggtcatccagatgtaggaaataattttcctacctcaatgtccttaatcttaatcacatctgcaagtcccttttttccatgtaaagtaacaaagtcatacattctgggacttagaacgtgtacatctttcaggggctattgttttgcctacttacaggggcctttcaggaataaaggttacccaacctaacattttaagtcattccaataagtatttactggctggattttctctggtagctgctctttgggcagtggggacacactgcacaacctcacactcaggtcctgcccttagagagctcacagtcaagtgaaaaaaatcttcatttgtgactcctaggcagaaaaagatgtgtaagtcttttatttcaatatgtagtattcatgttttctagaacctaaagcttagtatagtcattatctcgtataatggagagacaatcagaaaagtagaattcgattgattattaatcttgtaatgtcctttaaactaaaaatttttgcatttgtgcccttcccttgacatttccagctaacatgttttccttcccactggatttatatatataaaatatatgttatatatatatatattatatacggatattatatataatataataatatatatttatatctatatatatactatagatatagataaagatatacacatacatagtatcatagcaagggcagggcttttagagtcagaaaagtggccaaatgttgtgggatgtgtcatccaacttctctgtaatccagtcccctcacctttaaaatggccatgtaaatgctgatccatcgagttctgagcagtgtcagtgagatcatgcatgtgccacatccagtagagtttttggtccttaaatgcatcagaaatgttaggtattcttttttttcttccttttctttttcttcacttttattttaaagtctctctccatcacccagtctggagtgcagtggcgagatcttggctcactgtaacctccacctcctgggttcaagtgattctcctgcctagcctcccaactagctggggttacaggagtgcaccaccacacctggctgatttttgtatttttagtggagacagggttttgccgtgttggctaggctggtcttgaactcctgacttcaagtgatccatctgcctcagcctcccaaagtgctgggattacaggtatgagccaccatgcccagcctcatgttaggtattctcatttccaaaagatattcccagaattatacttggatcaggagtggggaaggttttattgccccaaagtagaaaatctggccctttttctcaagaagagtttagtcttcctgggaaaatgaaatatacaagcaatgtacatgaagtggttaaatagtgaagcaaggcaaatgaaatcaatggtgcagatcagaaaactgtagagaggcagagaactgaaacgggaacaaaagcgtcaagggggaaaatagcagccagtactggtagctagggagatcgtgatgtgttgaccatgtgacttgtgccaggcagcatcagtgtctaaattcagaagagtaacagagtgtcacttcatcataggtcttgaatgcctaaaggataatccagaatagtgccatgagtataggtatggaaattctgggaggtccagatgagcagatattttgttgctaaatattaacttgaaagataattgaaaattcacatggatctggaaagaaaagtccatagttgatgttcagaaaacctaaagaattggcttcaatgaactattagtcaccctaaactggtttgaaaatataaatactgtgtgacacatttaataaatggtgtataaatattttatgtcctgttccttatcaaactgacattctttaatctctttcagatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtgggtgagtgtgcctgggagctgacttaacatgctattttcctaaggaaagtggtcaaggtcatgttcagaagtgtattaactcttgacacataatatatggagggaaaaatcaaactacttttcaccatacatttgagttttagacttcacactgaaattgtactttcttttttttttttattatactttaagttttagggtacatgtgcacaatgtgcaggttagttacatatgtatacatgtgccatgctggtgcgctgcacccactaactcgtcatctagcattaggtatatctcccgatgctatcccgccccccctccccccaccccacaacagtccccagagtgtgatgttccccttcctgtgtccatgtgatctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcatagatggacatttgggttggttccaagtctttgctattgtgaataatgccgcaaaaaacatacgtgtgcaggtgtctttatagcagcatgatttatctttgacaaacctgagaaaaacaagcaatggggaaaggaatccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccagaagcaatggcaacaaaagacaaaattgacaaatgggatctaattaaaccaaagagcttctgcacagcaaaggaaactaccatcagagtgaacaggcaacctacaaaatgggagaaaatttttgcaacctactcatctgacaaagggctaatatccagaatctacaatgaactcaaacaaatttacaagaaattgtactttcaaaaatgtattgaattgggatacttctataattcaaaacagacaccataatattctgctgttttctgtttgtattcgtatgactaggacatagaaaaatttaatttgcatatctttcttccacaaaagtttaaaactgcgtttatgttattttcaaatagatgtccgtccattgatacaaaccaaagatggagaaaattacgctacagtggttgggtacagtgctttcttacattgcgagttctttgcttcacctgaggcagtcgtgtcctggtaagccggtggctcatggttttcttaagagaatgtcaattgtagatttgaccttgtttcttcatccgtcatttgacaggctgtattgtgtctatattgttacatgtacccagtacctctgagacataaggtaacaaacttaccggtccaggaaattagctctactgaaagcattggctagatttctaggattttctcacatagagacatacagagagccacttgtgttcataaagaaaagcagagaattgaagagattacagagacaattttaaaggtagttttggtttttcattatgaggtaccacaaggtcatgttttactctattgttgttgttttgggattatctaaatgattatctaagctcgaatttaattccaaatgcatgtgcttaagacttttccagcattcattttgattttaatttcaatgaattaattggtatcataagtccaaagacattatcaatatggatctaccttattagttgctttactgaaaaagcttggttaaatagttcttgaataattttgtcattggtctgtagggcagtgtgagatgagtgaccccaggtcataaatttatagggtcagatattgcctttattttaaatcatgatacgtattttgttcatcgtgggttttttgcattattgtgatttttcaaaatactagattgaaatattatttaccttgcttactgagatgtttggcaccctgttaaattttgcatctggggcaagcctcccacttgcctcagcctagtccctgtcctgtatgatcctacatggaccgcatccacagcttatccttaaaaaaaaaaaagaaactcaagcagtcgcttattgtcaaatgtacagggtaaatcaagctgtagcagcaagggcttggaaatggctgaatgttggaggaaatggctctggggttgatagggtaaatgtaatccatgtccacaggacaggcaagactccccagcttataatatttctgaatgaccaatgttctcccaggacagcaggaggtttgaaaggttcattatctctttcaattactagctttcccatttagtaccctggagcaatcattaactaaagagttcaccatcaataagccagaaaatatttattaagctctgaggacacatgcaaaccggtgctggtggctatgacaaatacagcagaagcactgagcatggacttggattttctatagccacagtctatttgggtagataagatatacaatcttggtccattttgagaaaaatatgaaacccactggaacatttcatgaggttttctgagctattgaaaggggattagcctgaatgacgtcactgactagtattaaaaagcgtatacaattttgccctacctcagatggatgtacgctttctttgtccataggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaagtatttttatttcactgttactttgcatgaattgtcacatgggttcagtctgtcttcatttgcccaaatggaataataccatttaagttggagtaccagataaagttctttgaaccgtttttcaaaattcctagaatgggtttcatctaaaagattattgcaagaactacagggtatgcccatgatatgtgcacagcttcatcctattttaagaggcagccaggtgtctgtagtgacagatggctgtcaatatttaaaaattacctattaaccatactacaccatatttctgtaactatattttatttccaaagctaactcaaggtaatggtaacagtaatcaagtttttgagctaaagatttcacaaactcataactttataatgactgaggcatgacagaatgaggagggtttttgatcctctttttgagtcataaacagctttgtattattccttctcacttcagggcacagtcctgggagctgttaatagtttcttgggcttcactgatattttgattttaatattgctcagagaatcttcaagaaaacacaaaatggaaaggatcttcggtattaataaggagcatttttgtttcttctgtcgtgtccatatcccagcctgcttctcacttccacctagataagggagagcatatttgtttgatcatctgttttcactgatgccacttttcctcatacatatctgctgttgtatccactgatgtcttgacatttctttctctcttcccatatatatccttccttccttcttttttcatcctgttttccttttcttttgctgtacatccttttcttattttatagcatttgtctctttctgtgccctgagtaaatcagtgtgccagccccacagactatatttttaaagcactcaaatactctcccacaatatctacttatctctgatgtcttttacattttcaagtgtcatgtacacttttcaagatgccctcatgaagtcactgaagatggtgatgattgtttttatacttcaaaaagtaaacctatatcaaggttaagcaactcagctaggtgtaaggagcgtgaagcctcgaatccaaatggaactttgcactcctattgcccaatacagtgcttggcccaaaatggacctcaaaactgctagtggccagagagatggacaagtttagaaagtttcaatatgctgtagtgtctattttatatgttaaaaatatatacgaatcgtatcaatggaggattaaggacacttttttttttacatatacaaaaggcatgttgagaatggagttaagtgagagcctatatagtatagtgattgagagcatgagctttagtctcaggcagatttgggttcaaatcctggttcagcccattcccggttaggaaaccttgtcttatggctcaatttcattttagccttaaattattttctctgtaaggtgggagtattaatattcataaagttgttataattataaaatgccacaatgaatatgcattacttagcagagccctgatagagaagtgtttattaaattgtatctattattattaaatgaatttctggctttaaatttagaattagaagtaggatgtcaaataattcacttaaaattaattcaatttaatagtctcttcaagttttgtgcctggaataacaattaattttattaatactttccatttttagccagttccttgagaaaaatgtacatagccaatatcagagtataattatagaattggaggtcagcttgtgcagttggtctctgggaggtccccaaaatgccaaatgccacattaagagtatacttacttttaatagggcattaaagagtaaggattgcacgttttgaaacaatcataatgaaccaaacattttcttaaggcagccataaaccaatctttgagtttcataatgttgataactacaaatttatttttgtttcaaactatcactccctgtaattcattcaaaaggagacttaacactatgtattgaatgcctacggtgtacaggctcccttctaggctctggagacactgcagtgtcatgaaacagtcacaggccctacttccctgaggcttgctttctagttccccaccttcatgttaatagttcatccattcatgggcttaaacatttaccctcaggtttctgaattaataataaacaccctaacagaaaatcaaatatctttcccttttcctttacagtgctttgattatatatccagaagcacttgaaggagaaattatgttattttcaacttctagagacatttgtttgcttatactttgcttactcccttccccaagaaataatgagggaaattcctaaactattagttgatatttccacttaaattttgtcagatgtccaagcctggatggaaagaaaataataatgacatacaatgttaggaaattacagtgggacaaaccctgcatgaggattggacagttatggtgacaatttgggttacttaacttgcaggcacttaataacaaagtaagttacgcttagttctaactaatatctttgtttggtaaaaacagatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggtaggtaaactattatgatatgtcataatatttgcttggggtaaacaacttgcatttgatttaaaaagttctaggtcgggcatgctgactcacgcttgtaatcccagcactttgggagaccgaggcgagtggatcacttgaggtcaggagttcgagactagcctgaccaacacggtgaaaccccgtctccactaaaaatacaaaaattagccgggcatgatggcacgtgcctgtgatcccagctactcgagaggctggtgcacaagaatcacttgaactcaggaggcggaggttgtggtgagctgagatcacaccactgtactccagcctgggggacagagagagactctgtctcaaaaaaaaaaaaaaagttcttaaagcattcatacagaaacaaaaacaaaaactgagtaatatttctgtcttcaagtcacttcactctgctatcatatgtttatcatcctgtttttgctactgacttttcatgtaacatgtaccattctattagtgtgtgaaatggaaaccactctaagtaaccgaggaagaattgcatgggcttggatggttgcaaaaaaaaaaaaaaaaaactggaggagctaggcctagaagaggctgcatactagtcttctaggttcttgatcacaaagcactgcagctgcaatccaggtgtctggaaactgctgccatcttcatggccacctcaccccattggtactactcgtgagtcctgccactgccacctctcatgtctgccagaaccactgtctgctcccactggcccagagaagatggcatccattttccttctacttttcaatctcacatgagtttatttaactcactagcaaaacctaaatcatatctgggattcttcctgccagagagtactgagaagtacacctttgagtcttccaaactctgtatagagaatatagacaaaatataaaagagaacatatagaggaaagtgtgaatggatgcttaatagcactagatgatattaagtacatcaaagaaataaaaagtcagcatttgctgaatgtctactctcttttgaaaatatgagaaagtcagcttcgcgtccttttgcattgttactaagtaagggttaaaacttaaccatcttggagccaaatctcccctctcattaattttgtaatttattaccctgtaaaactacaaatctgaaaatgtttagataggacatgtgctgcttgcatgagacagcaacactgccatgggtaagatcatgaactctgaagctcaatggctcagattcaaatctcagctcagtcacttattagatctttgaacttagacaagctgcttaacatctttgtgctttagttttaaatcccataacatagtttgaattaaaagtattaaaaaggtactttcattatagggttaacaataccaagtacttagaaaacattaacatacagagcacttagaaaataccaactgcacagtccatttttgcttttgtgatttgtactgctaatttcttcatttttttccttatgacaaatttctttttttaatttttgtttttctttacatcttcattaaaaaatgggatacatgaacagaacatgcagatttgttacataggtatacatgtgccatgatggtttgctgcacctattgacctgtcctctaagttccctccccttgccctccacaccccaaaagtccctggtatgtgtgattcacctctctgtgtccatatgttctcattgttcttctcccacatgtttgctgatgatgatggcttccagcttcatccatgtccctgaaaaggacatgatctcattcctttttatggctgtatagtattccatggtgtatctgtaccacattttctttatccagcctaccactgatgggccttggtatcggtttcatgtctttactattgtaaatagtgctgcaataaacatatatgtgtatgtgtctttatagtagaatgatatatattctgttgggtatataccaagtaatgtgattgctgggtcaaatggtatttctggttctagatccttgaggaatcaccacactgtcttccacaacggttgaactaatttacattcccaccaacagtgtaaaagtgttcctttttctctgcagcctcaccagcatctgttgtttcttgactttttaataattgccattctgactggcatgagatggtatctcattgtggttttcatttgcatctctctgatgatcggtcatgttgagctttttttcatatgtttgttggccatgtaaatgtcttcttttgagaagtgtctgttcatatcctttgcccatgtttgatggggttgtttgtttcttataaatatgtttaagttccttttaaattaagaatattagacctttgtcagatgggtagttgtaaaaattttctgtcattctgtaggttgcctgttcgctctgatgatagtttcttttgctgtgcagaagtgctttagtttgattagatcccatttgtaaattctggcttttgtttcaattgcttttgccattttcatcatgaagtctttgcccatgcctatgtactgaatggtactgcctaggttttcttctagggtttttaatggttttgggttttatatttaagtctttaattcatcttgaattaatttttgtttaatgtgtaaggaaggggtttactttcagttgtttgcacatggctagccagttttcccagcaccatttgttgaataggagatcctttccccagcgcttcgatttgtcagttttgtcaaagatcagatgattatagatgtgtggtgttatttttgaggtctctgttctgctccatttgtctatatgtctgttttcataccagtaccatgctgttttggttactgtcgccttgtagtgtagtttgaagtcaggtagcgtgatgcctccagctttgttctttttgcttaggattgttttgtctatatggggtcttctttgattccatatgaaatttaaagtagttttttttctaattctgtgtagaatgtcaatggtagtttgatgggaatagcattgaatctataaattactttgggcagtgtggccattttcgtgatatttattctttgtatccatgaggatgggatttttttttttcatttgtttatgtccttttttatttccttgagcagtggtttgtagttctccttgaagaggtcctttgcatcccttgttagctgtattcctaggtatttgattctctttgtagcaattgtgaatgggagttcatttatgatttggctctctgctggtctattgctggtgtaaaggaatgcttgtgatttttgcacattgattttgtatcctgagacattgctaaaattgcttatcagttcaaggagttttggggcttagacaacggggttttctaaatataaaatcatgtcatctgcaaacagacaatttgacttcctctcttcctatatgaataccctttatttttttcttttgcctgatggccctggccagaacttccaatactatgttgaataggagtggtgagagagggcatccttgtcttgtactagtttgccaagggaatgcttccagcttttgccaattcaatatgatattggctgtgggtttatcataaatagctcttattattttgagatgtgttccatcaataactagttaattgacagtttttaacatgaaggaatgatgaattttatcaaaggccttttctgcatctattgagataatcatgtggattttgtctttggttctgtttatgtgatgaattacatttattgatctgaatatgttgaatcagccttgaatcccagagatgaagctgacttgttcatggtggataagttttttgatgtgctgctggatttggtctgccagtattttattgaggatttttgcatcaatgttcatcagtgatgttggcctgaatgttcctttttttgtgtgtctcttcctggttttggtatcaggatgatgctggcttcacaaaattatttagggacgagtcccttcttttcaattgtgtggaatagttttagaaggaatggtatcagctcctctttgtacttctggtagaattcggctgtcaatccatctggtcctgggctttattggctggtagactattaattactgcctcaatttcagaatttgttattgctctattcagggattcaacttcttctggatttagtattgggagggtgtatgtgtccaagaatatgtccatttcttctagattttctagtttatttgcatagaggtgtttatagtattctttgatggtagtttgcatttctgtggggtcagtggtgatgtcccctttatcattttttattgtgtctatttgatacttctctcttttcttctttatcagtctagctagtcatctatctattttgttaattttttcaaaaaaaaaaaaccagctcctggattcatttatttttttggagggtttttcatatctctgtctccttcaattctgctctgattttagttgtttctcttgtcttctgctagctcttggattagtttgctcttgcctctctggttcttttaattgtgatgttagcatgtgaatttgagatctttctagctttctgatgtgggcatttagtgctataaatttccctcttaacactgctttagctgtgtcccacagactctgatacattgtgtctttgttctcattggtttcaaacttcttaatttctgccttaatttcattatttacctaggagtcattcaggagcaagtttatcaatttccatgtagttgtgtggttttgcgtgagtttcttaatcctgagttctaatttgattgcattgtggtctgagagacggtttgttataatttacggttttttgtatttgctgaggagtgttttacttcaaattatgtggtgggttttagaataagggtgatgtggtgctgagaagaatgtatattctgttgatttggggtggagagttctgtagatgtctattaggtctgcttggtccagagctgggttcaagttctgaatatctttgttaattttctgtctcattgatctgtctaatattgacagtgggttgttaaagtctcccactattattgtgtgggagtctcagtgtctttgtatgtgtctctaagaacttgttttatgaatctgggtgctcctgtattggatgcatatatatttagaatagttaactcttctggttgaattgttccctttaccactatgtaatgcccttctttgtcttttctgatctttgttggttttaagtttgttttgtcagagactaggattgcaatccctgctttgttttgctttccatttgcttggtaaattttcctccatccctttattttgaatctatgtgtgtctttgcatgtgagatgggtctcctgaatacagcacacagatgagtcttgtctccttatctgatttgccagtctgtgacttttaatttggctactcagtgcatttacatttaaggttagtattgttatgtgtgaatttgatcctgtcatcatgatgctgtttggtcattttgctcattagttggtgaagtttcttcatcatgtcattggtctttatattttggtgtgtttttgcatgactggttctggtttttcctttccatatttagtgctttttttcgggagatcttgcaaggcaggcctggtggtaatgaaatctctcagcatttgcttgtctggaaaggattttatttctccttcacttgtgaagcttagtttgacaggatatgaaattctgggctgaaaattcttttctttaagaatattgaatattggcctccactctcttctggcttgtagagtttcttctgagaggtccaccgttagtctgatgggtttccctttgtaggtgacctggcctttctctctggctgccctgagcattttttccttcatttcagccttagagaatctgatgattatgtgtcttagggttaatcttctcatggagtatcttagtggtgtactctgtatttccttaatttgcatgttggcctgtcttgctaggtttgggaagttctcctggataatatccggaagtgtgtttttcagcttgtttccattctacccatctccttcaggtactccaaccagttgcaggttcagtctttttatgaagtcccgtatttcttgaaggctttgttcattcctttgcattcttttttctctagtcttgtctgcacactgtatttcagcaaagtggtcttcaaaatctcatgtcctttcttccacttggtagctttggctactgatacttgtgtatgcttcatgaagttctcctgctgtgtttttcagctccatcaggtcatttatattcctctctgaaatggttattctagttagcagctcctgtgaccttttatcaaggttcttagcttccttgcattgggttagaacattctcctttaggtcagcatagttttttattacccatcctctgaagcctactcctgtcaattcatctgcctcatcctccatccagttctgcgcccttggtggagagacattgtgatcactgggaggagaggggtttttagcattttttttgttgattctttctcatcttcataaatttgtcttccttctatctttgaggctgctgacacttggatggggttttttgtgggagattttgttgttgatgctgttgttgttgctttcttttctttcttttttttttttctttcaatggtcaggtctaccttctgtagggctgctgcagtttgctgggggtccacttcagtccctattcatctggttcacgcctatgcctggagatgtcactcaaggaggctggagaacagccaagatgggtgcctgctccttcttgtgggatctcagacctcaaaggtcaccaacctgttggcagtaggatcactcctatatagggtgtctgacaagccctcttggagggtctcacccagttgggtggcacggggaataggacccatctaataaagcactttgtcccttggtggaggggatgtgcttcactagggggaaaccgacttgtctgggctgcctggattcctcagaactaccaggaggagacgctaagtctgctggtctgcagagaccatggccacccctccccctaggggctcaggcccagggagatctggattctgtccctgagcctctggctggagttattggagttcctgcagggaagccccacccaaggaggaatgatgggtcagggtcaggcctgaaaaggcactcagggtcaggcctgaagaggcattgattctgccacagtgggtgtgttgggctgtgggggacgtgtcttgggaccaagccatccagcctccctggctccagcaggggagaaagcacagcctggagctacagatatgaatgttgcctctcccccacccagggagcttagcgtgttaggcagttgtgattcccagtgctggctgctgcccctcttctaaggagctcaaatggcttaggaagcaggcagctgcagctgtggggctggccgcccctccaccaggagctcggtaggcttaagcagattccagctgaaaggctgttgagaatctgtggggcttcggggttgtgatgctagacccagtggctggagtttgtgagtggggtcttccaatccatgggtttcacagttctgtggaaaaagctgggtagcacattcactcaccgcctcccttggctggggggaagggtctcccctgccccgtgcggctctcaggtggaccactgcaccacactgttcttccctcctctccgcggatcatgccagcctcctagtcagttcttctaagagaaacctggataccttggttgccagggaaggattcacacacttactatagttcttttccatgggagcctccgaacacagctgtttctagttcgctatcttggtcctgctccctgcctccgcctcccccagcccccaccgccccactgccttcatttcttcatctgcttgtctcatttctgttgcttgcttggtctatgttggtatttatgtgtgagccgcctctatgcaaaggcattggtctcagccttggttcttgatttattctctcccctccttccgatatatacaaaggtttgcagaaaggcagtgtatgtattacaaccagttctcattgaaacacgagattaattatatacctctaaaggctacgctttgcaatacagatctccagcctcaggttaggtctccgctgatctgccaactgctcagatatgcctaaattctgcctcttttgttactactgcctgactatccggggtcttccatgtgacctctgggctacagccaagaagggaatcagagacccatggctggtgggtaatatgacatggacatttaggctttgaccccagaagccctaagcaaccttttcatgtgacccagttttacagttcctgcaggatcccagagctgacactgaaatgaacctctggctatctgagtggactgagcaagtgacacagatgttctgccaatttccctaaacaagtaacagggataaaggacaataaccttagctcagaagaggccccaggagcaaggaagcctgggagtaactgctgctggctggccttgactgctgccaagggcatgcacggtgatatagcagggagtagaagtcacaggtatctgctaattttctacaaagccatatcagtaacctcatacttcttaccttctgctgagacaccttctccttattactatgcagaagaccggaagctttaacctaaagggaggttaaacttctaatcaaatatacatggtgaacaatgagaagtgaaaattccttcttctcttctcgcttgtcccctttcttgtgtagggatgcagtaagtgctgggaactgccactctgaaccattagacctacggggcttcatgttatgttagtacttcccatacatgctttctctctttaggcctcccaataatactattaggtagattgaaatgcccccccaggaattttctgtggatttcctacctgcaggtggccatagaccatacaggctatagaccatacactatggttatgaaaaatgaaatggagcatggctatgaaaccatttttagaatttatatcgtgcttaacaaaggtaatggggactgttcatgactgtaggcaaagggagggacctagtcctgtgggagagaccactgtagcatgaaaagtgggatatactgataactaggagggcgtgggaggaaagggcattgagaatccagtgggagggtttttccttggcaccaaataggagctgcttttttccccctccagaaatagtggcaaattaatgagggaaggggagaagttgaagatgcaaagatgaagatgcagtcatagtgaaaggtctctttctaacaaattaggaaataaggtaatttgttcaagcagagaggcaggagaaatgggagttggggacattaaaacaccaaccatgagaaatgtgattagcaataagccaaaaatgaatgaaatcaacttgattaatattattagtaacactctctgagcacatactctgccaggctgtatgcactaatcactttatgtgctttacctcatttaattctcctaaagagaaagaaaatattgttatccccatttttcagataagatgaattaggctcaatgttttgttcaaggttgtacaaataataattgatggaactgagccgcaaacacaggtctccaaagagagaatcgttttgtcatagtgccttcagggaaacacggatattactcagctgaacagggtaagacaacaatggctgctgacatggattagggactagcagactggataccgcagatgaaggagtcgagtggttttagtggatagatttctcaggcaaggtaattaagcagatgaaggcaaacagaggaaaagattggggcacgaagatgtgaagaggtttttagcttcttctaagagttcaagtgttatgagagtagaaatgatacaactttttaaagcagaatcccagctgacctatgatgggaacataatgtgagggaggaataagtgactgttttcttgggcatggggaatttggagctgtctgttactgcagcacaccatagtgtgaccccgtgtgtgattttctgtgtgaccctatgtgtgacaactatttgtgattttgacatgtgacagaattatccaggcttcatgttcaaatgcaatggcccttgccccatctccaaatgtactgatttggaacctggactgaggctggaacacgacatttttaataagttctttaggtataccatacctaccacatttcgaggactagtgaggcacccaacgttgattaattggaggcacctaagatacatttgtgagactggaaacaaggcatagtgcaaccatgacttgccaaaaaaattggtagctttcttctctggcctgaaacaccccgtgccagggtataaatcttggcaagatttcagctactatgggccctcgtgcagggcacagaagtcctatttcaagaggttattaaagtatattctttcatctaagaaggtacatttttcaaaaattgtcaggatatgcagtattctaatattgtatcaaatggacacctgagtaacatgacctgacatgttaattcatgtcaaagttttattatgtctagaattatggtgagattcttgattaacaattcaaggtaatattggttggcaaatctttctattattggtgtaggaataagggctgattctgtctataatcaaaataactatgtttcattacactgcaatttaaagtaggtttatataattcaaaattctcagcattttatatgaaatgtacataaaaatattaattatgtgagcctcctttcctcctcacaaggatgacactatttaagttatttcaacaaaatgctaattattatgaatacattttaaattttacggaacttgaaaaatactttaatagttatctcaacaatggtacggggtaaaaggtgaagtttataaagaagcagttttctcatagtaaacctgatcacaaattggtaaaaacaaatgataaaaagtgaggtgaaatgatttgcaaaaagaagtactacactgccatcttctgttcaaataagtcatatgcttcaattgctatctgatcttaatgtgcattgtacttgggagtggaggggcggagaaaagagaaacttgtgaaaaactgagattatccgactccttctcaggtattctggttctgtggaatggagatggaattcaggaatctgcctttgtaggaagcactccaatcgagcctatataggtgattccctaaacataccttaagaattactcaaatatatcttggccattgtgaggtatgatgcactctttaaacatgccaggcaacatacagttccatcactgacccatgcaaacagatggttagatttcataatttttaatgtgattttgtttatggctatgtagacagttgtgtatgctagaataattctttatctccaggtttcaactgtggcattctctaatcaaatttgcattgcataaagtcatctttcactcttagattgttttcgataaggaatatgcatttttaaaagaattgggtttctatcatttctattgttttccttctcatcatgtactcactttttttctgataggataattattgatggagctaatttgaccatatctaatgtaactttagaggaccaaggtatttactgctgttcagctcatactgctctagacagtgctgccgatataactcaagtaactgttcttggtaagtgcactaactaatgagaaatctgttcatttcttcatttctgattaaatcccatcgttcctggccaataaagctaatgattctttgagcccctgcacatatattgttagtttcaaatttttgtttaaaaagcaacacaacttcaaatcctttctccttttttcatataaaagaaattaattaatgcttaattttttttccctacatgtgttaatttgccaatagcagtgggaggtaagtgatgctatccgcagaaagaaaaataaagcacgcttgagttcctagcactcttgagctactctttcctggtgtacaaagaaatggggctgaggaatggaggtgggctagactggaggatctcgataggggtcaagaggtggatgcacggtggtcatctctaaaccaaaggcacagactgagttcccagggttccaggaaggatggagaggaacttccagcattctacaaaggaatgtctttgatttttgtcgttgttgttgttgatgaaagtactaatcaggaaacagtgtgcacacttcactagtataatcaatgcaattactcctgaaatcaccaatgtttaaagctcttagaccatctgctggatgttttccaaaatttcccttccagattcactctctaccagctctttgacctagaaaggttgcttttaaggacaacatcagcaaaccactttccttccagctattatttggttcagcaagtggagggccgtttggagtgttgtactgattctccctactccatccctgtggactggctgtgtcccactgccaaagtcatggcttctgcagacagggtctcctcacaccattccttctgatgaggctctagcagctgcatcccaccaccaatatttcaagtctctctcacacccaacctactgaacatcctgcccacatctttttaaagacgttttattaaaacattttggaactatcgtaaatttgtgtgagttattcattgattttctgcagggaccctaacagctacagacatttgttctgtttcggtggccaccatgtagtctttcttttagtttgcagacattccttaaaagtgttggttttgcctacccttctttatcatatgtctacattaatcactgttatcaacagacctttgtgtctttagcactccagctgttggggccacctgttaggttccaaacaagggaggtggtggtacagaccaagggagaaagttcagtctcttctgagagactgataaaaaaatgggtcaacaggctggatcccttcaagtaaagcaaatggccaacctgtctcgggcgaaacaaatggccatcaaggttgggttctaaaataaaagaacagtttccacttacagaaggtatggacttgtagagttgtcgagtcggctcagtagaattgtacctttaggcagaatgtttggccattgggtatttgagcattttcaggtctttacaagcagaaaggtttaatcccctaggatgatttcaacaataattcatcagataaagtagtcgagcttcagataaactggaattcatcccaggcctagtgagtagaggggtaagtgtcaggctccgtgcgctttgtccctaagtattttgagcagtctcagccaccaaaaggaccgggtctcctactgcttggtgctccccttctcaatttccttacaaaatttaaaagttcattcttgcgattaggctgccatttttggaactattaatttttttaattctacataaattttacctacgattatatgtactggttatatacgcagtaatctaccagtgtttacagaataaaaataaaaataaattttggagaatattatgtttaaaatttacattcttttattttttagacaaacttctgatttaccaaagcatctctcgacaattgacaataaaaaaataattatatagacacatacgaggtttctaaaagactatgttttaccccctggaaaacaattttttaaagtacatacttgaccccctttaatcaaaagttatttttaaaagccttgacataaacatgctttcaggatatcattttttaaaagtttcagttgcaagttcatcagttctagctccatacgattctcagaagagccagattttaatatcagatgcaatacacagccttagtttattccaggaagcttcagaaatcagtggactcagtaaatactgaagagaaaccaaagtcctctgagctcagagattctgaaacctgttgaagaattaactttttatttatggctttaatgtttggacacagtcatgaaccacattttttaaaaaacatgttctctcttctgaattggaaacgatgctttttgtcaatgtaaatttctaacaattagcaaatattcaggaggagcaatggacggtgctttccacttggagaagaaagagcccattgaaaggctacattagataatatcttccttttctcttctgctaaaagataaaagtcctccaatgcttgagagaattcaaacccaattttcagagtaaataccattagaaataagatttctttttactgttgctttattttcaaagtaccagaaattttcattttctttagtactcaaaaatttgtgatcatttacttacttaattttccagtttctgtcacaacatttaacaatgccaaatctccctgttctgatataaactgccttcctactctttttgagaactccaggttaagacggtatcaaagttgctataatgaaaattcattgttatcaataatgataaaaatccaacacagttgcagaaaagaaagcagagctcatgatctctttttctataaccataagacctaatgtttattgctttaatataataattatacacatgattgaagtaataatatctttttcactgatttatttagttataaaacatttatgtgtgaggcactgtgggcaatgcaaagcttaataaaatatgacccctattcttggagatgaatcaggcatataaacaaatatgtactggacaaacagaaatgattcatttgagatacatcatgtttcccagacttgggtatacctaatccccatccaaggaacttgtttgcaaatgcagattcctgggcccaccttcctcagtaagccagaaatagggcctaggaattttcattgttattaactactcctaaaagaattctgatgtccctggtcaaggataaccccttgagactgtaatcagagaagagggaggtaatatggtccattggggaggacatgtggagatgctgcattttacaaagaaccccagaccccagagcctgatgcgattgaacacagtggagacatgggcccagaaaagaagggtttttatggaaccaaactggggtccaccaacccagtgcagtaagaccaggtatctatactgaggtttgcagtgggagaaaggaagacacttatctgcagggcaccaaacaagaactggtcagctcatgcttaagtcccaacctccccagtggcttgcaggtgaaggtatttaaaagcaggagtaaatttcaggagagcaaatgctataggcaaaatagtaaattagtacattgaggttacacattgctttatgcctaaaagggtgaggtatcttgaactggagttggggcatggcttacaggtcataggtggattcaaagattttctgatttgcaattggttaaggaagagaagctttgtttaaaaattgggagtcagccaaaaagaatattagctctggctcatggatgtggctccctttaggccctcaggaagaaatttacaaaaaatgatggtcagaactcagacttcagtttccccttatctgaggtctccatgccagcaaagttatttggtgagagtctgggttccagaaaaacaacttagagacatatattaagatgttatcttcagtttctataggagaaccaaacatccctgtgattccagcttccttggctattgtttaaagctactattacctccgttcttatcaagttgtttatttacttcttagggctagctaggtgcctgaattacccttgaaactccacctttcccttccatatgtggggtggggggcgggggtgcttcccaggtccctaagagggtggtacctcctctgtctccgggtagctggcaatgtgtctgaggaagggaatcaggtaaacaaaggcaattatctacattttcccttcctttattaattagatgttccggatccaccagaaaaccttcacttgtctgaaagacagaacaggagtgttcggctgacctgggaagctggagctgaccacaacagcaatattagcggtaggaagacttgggataactgttttcattactctagatagtcaaaattaatagcgaagtcactttttaaccactcttactggtttattcttcttataacatccttttgaacttttaatattgagtataaattttggtataacttatccatactccatacattctaatattttttccctgtttatactaccagagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcaggtatgcaggttctcacatcaggtttctaacaaaatatttgtttgtccccatctttgaacatctaaaaaaaaaagattgatagagtaatgtaggattttagatttctccaaatagtgttaacagttctctaaacagcacacaaaatattcaaagcacacaagtttcagaagtgttacatacgagttcgataaaagcaggaaattaggggagtgacatatgaaaaaaaaacattactttcagtaattttgtgatggctaaatatcaagtttaaccagatatcatcaagtaagttctaaattaaaattcaatatgtatgcatctaacattattaatttttatgcattcagtgtcttttcttgtgtctcaacatcaatctaaatttccaagatgcgtttgaaaaaatctcaaggatgactgctaaaatttgtattactgaattgttattgatcatcaatgtggtcatagcatgatattttatttttccttggctaaaataaatactctaggacataatttcctttttggactgagaaaaagcaagtgaaggttataactggatcagatagaaattaacacttgtgtgattttagtgcatgtcaacctttgcactaaactccacatttagctatttctaataaaacgaatccatctaaaaatattcatgactactgtacaggttttattcattttgatgtccttaaaacttggctgctgatattaatacatggtgtttactttattcttctacaggcaaatattcacaacatatgtttctaatgacaattctaatagaaaaaatagagcaggcttaaattaaaatttttttttaaaaaagcaggttcagaattttaaaaagcagttttaaaaattttaaaagcagattcaaaattaagacacatatactaaaccatctactctccactggataataattatttcactccaagaagactgttttactcttttaaataaaatacatatttaaaatctaccttaaatctttttaggaactggaccagatataaattaataagtacaatcaaacttacttaattatctgtgtttttggggggcaggagttgtgatatgatgacttacctatgggttaaaaggaaaaataatgttaatgtttttaatttttcagctccagataggaatccacaaaacataagggttcaagcctctcaacccaaggaaatgattataaagtgggaggtgtgtatttcttaatacgttatgtatttctttgtgcttttctcttcctcttaggtctgcatgctaactacaatgatagcacaacatttttttaagaacaaagataagatttggaaatgaaattaacttgtgagtcatcatcacaaattttaaagatcattgtgattaaaatgatgttatgaaatcgagtttaacactggtcaacaatttagggaagattatacagattgatttagttgtaatacattaccgaagtttcaaattattaataatttaattaacaatattctagattctcttccattcaaaaaatactgaaaatctttaattaatttagtataatctactagatattatgcatatcaaactgatgaacccccataaagtattcactactcattaaacaccagtagacattttgtattctcctttctagtaattctgaggatggtcttgtgaagaaagcatcatgaacgccttattctagatctggagatggcatccaggattatgaatgtcttgcccatcaccacacaaccagaaatccgcaaagctaggatttatgtatgaggatctttggactccaaacctcactttttcctcctttacatatctcggttaaatgttattaaatagacttcaccatttgaattttgcataaaaatgcccatctacccagataattttaattattctagggtcatttccaaattttttctgtaacagtggggcattttattttctctctactacttggatgtatttaatgaccagtatattggcctacctaaaaggaaattatcattcaaccattctgatgagtaataggcctccaacattgaatttataaaattttgtgtaaacatagaacatttttaatgtatgctgaaatatactaatttatttccacaattcattccaggtataatttttgggagaattttagaatgcacaaagtttagtttgctttttatcctcatatgttggtctttgtactcattacacaatcacatggcccatacctgcaaaatatttagtcaatattttttagatcaaaattagatctttatttccacttcagtgaaattaagttttacaagtttaagatgtggaaaactttttttaaaatggtaatacatagaaatgaaatatattcaataatattatttctttccttgaatgtgtggttatagttactactacattgtcttgataattacttaatttatagtctaaaatgatgttagtcttttagggtgtatctgtattatcctcccttaagttccatagaaattttcataaagtagataatatagttggttagatatcagtaatactgtgtatttgccagtcagttcctcagagaagcacatcatgttccagtaacattagctcattaatcctcactactcctttgggagggctgtggtccatgatggtgtcagtcttatatgtcataaagagaaactgggaatctcagagtttaatgacctcacccagatgccatgggctgagtcatatggaaaaaaggccagaaatcttcagtctttttgactgctcctctcactcataagtcattttttattaccccaaagatacacaagattgattattaatgctctcttcttgtaagaatgggactgtactaagaaagcatctatggccaggtgctgtggctcatgcctgtaatcccagcactttgggaggccaaggcgggcagatcacaagatcaggagtttgagaccagcctggacaatatggtgaaactgcatctctactaaaaatataaaaattagccaggtgtggtggcacatacctgtaatccctgctacttgggaggctgaggcagaaaaatatcttgaacccgggaggtggaggttacagtgagttgagatcatgccactacgctccagcctgggtgacagagcgagactctgtctcaaaaaaaaaaaaaaaaaagcatttaaaattggtctttgaggagcaaacgacatgtcatttagtaattaattgactagaggaaggaagtagtcacaggatttggatctaggctgacagttacattcccaatatgtcccatggtgtctcctattatcttgatgtgtcagagatctaatcactactgacacagccagtgaagtttaagaacattcattcactgagtatggttctgtatggatcatcctgcggaaaggagttagactccaggtttttcccagtttcacaatcagatagtattgtgaatgaattaccagaccccctccagagatgtactagaaataattcctatctacatgataatggtcagagggacataatttgaaaaaaaaaaaaaaaaagctgatctttcccaaaagaattaacaatgaagatgagcagtaggaacagactggacatccctaatttttgtttatttgtttatgttttacatttaacattaaacatgattcaatttaaagtaacattacaatttaacttaatggtagaactaggctttttagttagcattaccttcagacattcacttctcatatattaagtcggtcatgactcactcatatattttgagtgttcgaacatcataatgttctacttgcaaaacaggacaaaagagtctactgcaaccttatcagttaaatacctgtatcaggataatttttgcttgagagtttccattgttcttaagcatatgtatgtgaatttttaactttgctcagcaaaataacacatttcaaacttaaaggacaccaaaagcaaaaccaaaagcccaaaaccccactaatgttgggaagcaggaacatctttaattacctggttatataatcgcatccaagatagttaactcctaatggatctaggttttattatttataatacaagtataataagaagacctactggctttaaaatgaaaataagtggaattaaatgaaatattgtataacataatgactatagtagataacaatgtattgtattcttgaaaattgttgagagactaggttttaagtgttctcatcataaaaaataagtatatgaagtaacatatattttgagtagctcaatttagccactccacaatgtatacatatttcaaaacatgttgtacataataagtagatacaatttttgtttctcaagaataaataaaaatgttcaacaattttttaaaaaatggaatcaaggcaggacggcagtctttctgttttctagattaatagttataaccttgcttgggtcatagatctctttgaaactatgttggacgtgcaagctctttttctagaaaattacacacaaaaagtcatactaacaatatcattggtttctcagatcctctaaaggatacacatgtaccccatctagagattcctacaccccacgttaagaacctcttttctaaagactccttcctcgtgggctccttcacgagaggcagagggaagggaaggctggtggcctcttcctgcttactctgccctggctccttttgttctttcttgaagagattatttgggaaatgtctgaggctcagtaggcattgccttcaagtcaaatacaaagcattcaggctgtttatttgggttcccaggtactaaaaaggccgctaatatagctaaaatatttttgtttaaagtgttatggtttattatttatttatttaaaatttgtcagagaactttattaaatttaactcctttctttggagcaaaatgtgtaaaatgaataatattatttgcacacacttattgtcagcagagactgaagaaaactatcattccagattgcagtacggcactacaagcccatggcctaattcactgggacaatgctaaagcccctggtgaatttatatccatttcacactctaaaatatcttggagcaaaactttccaatgaatccaagtattaacaaggtctgcagaaaatctcagaaagttttcattttgttttgattttttttttccctcagttagtttagtttattcaccttggaataggaatacacttaaaattattttgctgatatgtcactaccctttcaacttaattccaagcaatgcctctaataagtgttttagtaaattagattaagttgagaaggattacagattctgtaagaacactatgtatgacattgttgactcactcacatatccagagaaaattactgtttatataagtgaaccttaaatttaggattaaaatcgtattttaaacttattttatataactgattcatttcaatgcacaatcccattatctttgaaagctaaacaggcagtttaaaccacattattgtttttaaattaaagtgttgctcaattaaaaactaaagtggaaataaacaatttcccatactagaaattattcctccaggctgggtgctgtggcccatgcctataatcccagcactctgggaggccgaggcaggcggatcacctgaggttgggagttcaagaccagcctgaccaacatggagaaaccctgtctctactaaaaatacaaaattagccgggcgtggtggtgcatgcctgtaatcccagctactcaggaggctgaggaaagagaatcgcttgcacccgggagatggaggttgccgtgagccgagatcacaccactgcaatccagcctgggcagcaagagtgaaactccgtctcaagaaaaaaaaaaaaaaaaagaaacgaaaaaaaaagttattcctccaaatatttctatggagaaaaataaagtgggtaagggtgacattttttcttaaagaaaaataaagaatggtcaaggagctgggaaattataagaaagaggagctactgtttttttgtattaaaatatgaacattcatattctccaaaaatatttacatgatctctctcttcttatagaagaaaaatggagaaggatagaaccaggtgcaagaaagagttctcttcaaaaagccatgggagaatcccattcacaaccaaagaattcgtggccatattattttttatttcagcctgttctttgaaaatgaaaaggcggaatgtagtggaaagcataagcaaaaagctaaaacactttgtggaatttctttgtaacttccttcgtgtgtaaaaacttaagactttaccatgaggacataatccaggcatctgattgtaggcttctcgttacttggggagttaagggattaattttcatacttaagctcatatgatgacaaaactttttcacaactgtctctaaaccaagaagggggatttaagatctctcaacaaatgaccatttcattacattgttccttattccacttagggtggttcaccatcatctctgagtcaacacatctgtgatcagactaaatgagtcttgccttctgttttagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactgtaagtgatgcacctaaaactgctaagcacgtcagtaactgttgctttcaaatatattgtacttcaatcaacaaatatttgtgaacaactactgcatgcaaagaggatgtactagccgtgggagataaaaacaaatataacacatgacttctatcttaggattgattgtaggacagttgatcgtatagagtaccaaggaagtatgttgaaagttttcattttattcagtttcctataaagctctttctacattgaaaattgaagacctggaattatcactgcaatcatttaaagcagcataactgtcataagattttcaagtacatctgccctttgcccttacttgtcaaggatcccctaagagccacttgctctcatgccctgggcttcagtggcatgtctggagctttcctaatactgatgagatatatacccagatttatatgtagaattatatgcacacacaccttctgatgccatagtaactgctgcaaataggttattggaagaagaaaaaaacactgcattctgtattgctaatactgtgaataatattaggggttattctcattgcctttccagcatctaaaggaataatttgatccaaaaatagaaaaggttcagaatgagaaatagccaactcattactcacctgccgtctaaattcttctacccaaataa

SEQ ID NO: 609 - DNA, 381385 bp, Homo sapiens
ctgattcagacacttgaatcaggcactcaatttggttaacattttgccaaccatgaagggggtcctcttaatggagtttagaacctttgacctgcagtgcttcttttgttcatgctcagtaccaactatagagctttagttgtgaccagtcatgtgactttctgagaattggatcctactttctcttgaggtccctgctctctccgatttttttgtttgagatctgagttttgtttcttcatggaactcctctcctcatggagctttgctcacttcctaaaaggaacatgagtttcctgctcctgtgacaatggagagccgactacagcttggtccctgctcaactaaggagctggtttggggtttttagaatttggtagctgcaggataaggcttattactacttcattctaacctctccttatgcttagagtgttcaacagtatgtaaatagtgcagtcgctatttgtgtttttggtttttatcattcttcctttggatttgaccaactcttcaccttgtctaatgtccagaacacctttcacttggtcaaatccaaatctaacaggagctctaaattatggtgaagcaggcctttaaactggctaaaattctgtaatggcagaacatccaactccacctctagaaacacctgtttgttgaagaaaataacaatattttaacccgcaatatatttctttgacaaattttgacatgtctgtcagagggccagcaaatagaagtggccctgcacagttgccttttgtggaaaaaatctacatcatagagaatcattattaatgcaggcatgtcttcccttatctggatctgggaaaaatggactgaatctgataccttaaagataaacaagtttagcattgatttttctctgagggctgctacctgcaaggttttactgacacaagaccagctttgctaactgaacttcctttctttctcccattacctgtattaccactaaaacctgatttacctccataacctcgttttggacatgcagaaatgcagaaaagtaatcagccagctaaagggtaaaaatgtattagtctcaagtttcctggcttccctctgtgcattctttccaattggatggtaaaaatcactgtttcctccaccaaattttgattaatgggagatttgtgttggactagtcttggtgtagtaattctggtgtactttttagtaatgttggggtatgagtattttgattgtttaatccatttcctcccagaagtagtcttttcctttatctctttcattctgtgttgctcataaagggaggtactggataaagttttctctcatcttgtgatatgtccttgagggcttgatttgtgaccaagtcagagcactcactcttggtctccaccatcagggggaggagtcatttttgagtcacattaggtgaccagctgtaacatggctgagaccctgaggttttttatttgttttgttttccaaatgtgttaagctcccaggagggcttgtcataagaagtcccatccaggctgggtgcggtggctcacacctgtaatcccagcactttgggaggccgaggtgggcggatcacgaggtcaggagattgagaccatcctggctaacacggtgaaaccccgtctctactaaaaatacaaaaaaattagccgggcatggtagagggtgcctgtagtcccagctactcgggaggctgaggcaggagaatggcgtggacctgagaggcggagcttacagtgagccgagattgcatcactgcactacagcctgggcgacagagtgagactccctctcaaaaaaaaaataaaataaaaaaaaaaaaaataaaaaagtcccatccatcagggacttttgtcattcccaagtcttgttgcttggatagggctgtggcaacaagagtcttttgctttcctaagcctattcctgagagtacatattttattttgtggtgggggaaaagatcattgggattggcttttcactgaagaggctgttggattgagtcacttagaatcaatacaccactggaaattctaattgtccatggccagaagatggattctttaaattgggacatctaagttaaaaaatattttagagatctcttattccaaacagttgatcagaggattgaatttcaaagaaagacacctgatagtgttatggctagccttaaaatttcttttgactaaattacagagcaaaaaatctcacctaaaacaaagttatttttttgtaagctcaaactgcttgacttagatcatctgagaaaataagaatagaagccactttaccttgtcattgaatagttaaaatcttatgcttttactgctgcagcctggatttaattttgggtcagggaaccagccttacttgttctgatatttgtgtgatttttgagtttttgaggtgctccttgacctctttggagatgcctcatacatccttggctaagccataatcttggttaaggcttattagtttcatttgggaggatacttttggttaaaaaaaaaaatcaaaagccagaaatatcagctgtttgtcctacctaaaatctgatatgaagaagtctgaggctgggcacggtggctcacacctgtaatcccagcactttaggaggctgagacaggcggatcaggaggttaggagatcgagaccatcctgtctaacacggtgaaatcccgtctctactaaaaatacaaaaaattagcctggcatggtggcgggcacctgtaatcccaacggctcaggaggctgaggcaggagaatggcataaacccaggaggcagaggttgcagtgagccgagatcgtgccactgcactccagcctgggtgacagagcgagactccatctcaaaaaaaaaaaaaaaaaaaaaaaagaaaatctgaaagtgtcacagtaggtagctggttagacatgagcagggcaggagagagctttccacccccacacactagaaatgtcaagtgatcatcaccaggtgatggtcaagtcaggtggttgttaactgtctctaaagtaataattggttgcaggtagtgccagggagatatagtctcacaatagatagaaaacacctgaaacaggtgatcagcagcttcccaataagttctcagaagttgagcaagtgggctcaaatatacacattaagaggcaacataatagagtttctggtatatgaccttctagggacttttttttttttttttttacattttagaagcatcattttttaggaactatgtttttaaattttttattattttattttatttttaaatctgtaaatcttttatttccataggtttttagggatttggtatttaattacataagttctctaggggtgatttgtgagattttggtgcacccatcacctgagcagtatacactgaattcaatttgtagtcttttatccctcacccccttcccaccattttccccaagtccatcgtatcattcttagatgatacagagcttagctcccacttacgagtgagaacatagtgtttggttttccattcctgagttacttagaataatagtctccagtttcttccaggttgctgcgaatgccattaattaattccttttatggctgagtagtattcaatcatatatatatactacaatttctttatccactcatttatagtttacattcgcaccagcagtgtagatgtgttcccttttcactgcttccacaccaacatctattatttttatttatttatttttgagatggatggagtcttgctctgtcgcccaggctggagtgcagtggcatgatcttggctcgctgtaacttctgcctcccaggttcaagccattcttctgcctcagcctctggagtagctgggattacaggcatgtgccacctcacccgggtaatttttttgtatttttagtagagacagggttttaccatgttgtacacactggtgtcaaacccctgaccttaggtgatccacccacctcggcctcccaaagtgttgggattacaggtgtgagctaccgcgcctggccaacaactattattttttcattttttgattatgaacattcttgcaggagtaaggtggtatcacattgtggttttgatttgcatttccctgatcattagtgatattgagcattttttcttatgtttgttagccatttctatgtcttcttttgagaattgtttattcacattcttagctcactttttgatgggattgtttgtttgtttgctaatctgagtttcttgtagattctggatattggttatctttcagatatatagattgcaaagattttctttcattctgtgggttatatgtttagtctgctgactgttgctttgctgtgcagaagctctttagtttaagtctcacctatttatttttgcttttgttgcatttgcttttgggttcttggtcatgaacttttcgcctaagccaatgtctagaagggtttttccaatgttatcttctagaatttttatagtttcaggtcttagatttaagtcctagattcattttgagttgatttttgtataaggtgagagatggggatccagttttattctcctacattcggcttgccaattatttcagcaccatttgttgaatagggtgtcccttacccattttatgtttttgtgtgctttgtcaaagataagttggctgtaagtatttaggtttatttctgggatctgtattctgttccgttggtctatgtgtctatttttataccagcaccatgctgttttggtgactatggacttagagtattgtttgaagtcaggtgatatgacaccaccgcatttgttctttttgcttagtcttgctttggctatgtgggctcttgtttggttccatatgaattttagaattgttttttctagttctgtgaagaatggtggtggcattttaataggacttgcattgaatttgtagattgcttttgtcagcatggtcattttcacaataatgattctattcatctatgagcatggggtgcattttcattttttgcgtcatctgtgatttctttcagcagtgttttgtagtttttcttgtagaggtctttcacctccttgtttagatacattcctagttattatttttttataactgctgtcataaaaggggttcagttcttgatttgattctctgcttggttgctgttggtgtgtagcagagctactgatttgtgcgcattaattttgtatacagaaactttgctgaattcatttgtcagttctaggagctttttggaggagtctttagggtattctaggtatacgattatatcgtcagcaaacagagacagttttacttcgtctttaccgatttggatgccctttatttatttcccttgtttgattgatttggctagggctttcagtactctgttgaataaaagtggtgagagcaggcatccttttcttgttcccctgctcagagtgaatgctttcaactttttctcattcagtatcgtgttggctgtgggtttgtgtgccaattttgctgagagttttaatcataaaatgatgctggatgttgtcaagtgcgttttcagtgtctattgagaggatcatgtgatttttaaattatgtttatgtggtgtaccacattattgacttgtgtatgtggaaccattcctgcatccctagtatgaaacctacttgatcatggtggattatgtttttgatgtactattggattcagttagctagtattttgttaagaatttctgcatctgtgtgcaccagggatattggtctgaagttttctttgttatgtcctttcctggttttggtattagggtgatactggattcatagtatgatttagagagaattctctctctttctagcttgtggaatagtgtcaattaaattggtaccacctcttctttgaatgtctggtagaattcagctgtgaatctgtctggtcctggaatttgttttgttgttaattttttaattatcttttcaatcttgctgctttttgttggtctgctcagggtttctaattctttctgatttaatctaggagagttttacatttccaggaacttattcatcccctctaggttttctagtttatgcacataaacgtgttcatagtacctttgaatgatcttttgtatttctgtggcattcgttgtaatagctcccatttcatttctgattgagcttatttggctcttctctcttcttttcttggttaatcttgccaatggtctatcaattttatttatttttccaagaaaccagctttacattttatttatattttgtattattttgtttcagtttcatttagttctgctctgatcttggttattttctttcttctactgggtttgggtttggtgtgttcttgtttcttgagtttctagaaatgtaaccttagattgtctatttgtgctctttcagtctttttgatgtaggcattaaaggctatgaacttttagcatggtctttgctgtattctagatgttttgataggatgcatcactattgttcagttcaaagaatttttaaattttcattttgatttcatatttgacccaatgatcattcaggagcaagttatttaatttccatgtggttggttttgaaggttccttttggagttgatttccagttttattctactgttgtctgagagagtacttcatataatttcaattttcttaaatttattgagacttgttttgtggcctatagtatggcctatcttaaagaaagttccatgtgctgatgaatagaatgtatattctgtggttgttgggtagaatattctgtaaatatctcttaagtctatttgctcgagggcatagtttaaatctattgtttctttcttgactttctgtcttgatgacctgtctagtgctgtcagtggactaatgaagtccctcactattattgtgttactgtctatctcatttcttaggtctagtagtaatagctatataaatttgggagctctggtgttaggtgtatatatgtttaggattgtgatattttcctgttggacaagtcctgttattattgtataatgtccctctttgtcttttttaactgctgttgctttaaagttagtttttttgatataggaatggttactcctgctcactttgtggccatttgcatggggtgtctttttctacccttttaccttaagtttacatgacactttgtggttaggggagtctcttgagggctgcagatacttgcttggtgaattattatcaattctgcaattctgtatcttttaagtgaagcatttagaccacttacattcaatgttagtattgagacatgaagtactgttccattcatcctgctatttgttgcctgaataccttggttttatatatttatttattgtatttttgttttataggtcctgtgagattcatgcttaaagaggttctgttctgatgtgtttccaggatttgtttcaagatttggagctccttttagcagttattgtagtgcaggcttggtagtggcaaattctctgagcatttgtttgtctgaaaaagactgttatctttcctttatttatgaactttagttttgctggatacaaaattcttggctgataattttttttaaggaggctgcagataggtatgcatgctcatttgaggtgttcttcccttattaaagattgctaaaatcacatgtgttgaaaagcatttgggattatttacttaattgatgagtactcatttatttttgcattaatttgataccatgtataaacaatatataaacataggtatggacatatacatatatgtgatacaacatagaacatatacatgtgcacataaagatagaaggagacagaaatactttagatttttgattttaaaactatgcatagaacccataaaactcactattaaaaaaaagttggatttaaattgtgcttttgtaaatagaaaaagttaacatttatctgaggaagcccttgctgagttttagagaaagtaggtagtaaatttacatctcaaagcacagagagagagagagagagaaggaatttgggtgtgttcaaggaagattaaaaatagatggcaaggtaacacaaaaatgatagaaatttataacaggattttataaggagaccaattttatttccatacatagcttttattttggtctctattttccaactgtactccagggaacacactacacaggctcccttaagtgctggtgggccactgcacatgcagacagcccactttaagggaagaatcgggggagaagagatgcagaccccagaattatgccaacatacgaaagcctaagtcaaaggtcaaaccacacacttgaaatctcatcgcctgtttggccctgttttaagtgtactttactttctttaatttctgctctaaagcttttaaataaactttcactcttgctctaaaacttgtctcagtcttttcttctgctttatgactcttggttgaattctttcttctgaagaagcaagaattgaggctgctgcagacttctacagatttgctgccactaatatactttagtgccattctacatgatagaatatatatatattcttatatttatacatagatatataatatatgtattcatagaggccttgaatctacattcttgctccactttatgtaaacaatccaggtataagactaaaacttattttggaaatacattggtcccatatgatttctatttcataaaaatgggagacaggagggggaaaattatttttcagaagaaaacaacagaacaatggttattgaattttagatctgttctttttttcttgaactttgttatttacctacaatttggactgaatcctaaattttttcctggctacaaatttcaaaactaatggtttcagaattttcttccatttttcttccattttggtatattgtaaattaaaactgtgatttttaaatttttatctttttttattacacttttaagttctgggatacatgtgcagaacctgcaggtctgttacataggtatacacgtgccatggtgttttgctgcacccattaacccatcatctaccttaggtatttctcctactgctatccctcccctagtcccccacccctcaacaggccccagtgtgtgatgttcccctccctgtgtccatgtgttctcattgttcaactcccacttatgagtgagaacatgtggtgtttggttttccgttcctgtgttagattgctgagaatggtggtttccagcttcatccatgtccctgcaaaggatatgaactcatcgttttttatggctgcatcgaattctgtggtgtacatgtaccacattatctttatccagtctatcattgataggcatttgagttgattccaagtctttgctattgtgaatagtgctgcaataaacatatgtgtgcatgtgtctttatagtagaatgatctataatcctttgggtatatacccagtaatgggattactgggtcaaatgatatttcttgttctagatccttgaggaatcgccacactgtcttccacaatggttgaactaatttacactcccaccaacagtgtaaaagcattcctatttctccacatcctctccagcatctgttgtttcctgaccttttaatgatcaccattctaactggcatgagatgatatctcattgtggttttgatttgcatttctctaatgaccagtgatgatgggctttttttcatatgtttgttggtcacataaatgtcttattttgagaagtgtctgttcctgtgctttgcacactttttgatggagttgtttgtttttttcttgtaaatttgtttaagtttcttgtagattctggatattagtcttttgtaagatggatagattaaaccttgcaagctgaaactagacgacttatgtaaacttctggagaaatcatagcaacttatatataaacaacttttgtgcctgctgatgtggactacacaaaaggttcacatgaacactggattcagactgcaattcagaaatgtgtcagattgccgttgtaattggaagatgcttcagaaactctagaaaacctagtctatagactgctccagacattacaggtgagccaacatacaactgaaagggttcaagcggtgtttgccaaacgaattgctctaattgaagcagcagttgtgtgactttaataaggttccaggattatactgtcccttttttgctgtgacttccctttgcccttttctgatttgtcttcatccccttttccatggggcatgacttcttaagaatgagccttcctagtgatgtaggatgagatgaaacatacagtcacaaagtcatgtcttctacaatgctttctctgaaagcttttgaagaatcggggggccaggtgtgctggcacaggcctgtaatcccagcactttgagggtctaaggcaggaggatcacttgaaaccaggagtttaagaccagcctgagcaacaaagggagaccacgtctctacaaaacataaaataaatcaaattagccaggtgcagtggtgcatgcctatagtctcagatacttgggaggctaaggtgggaggaccgcttcagcccaggagttcaaggctgtagtgagtgcactccagtctgggtgacagagcaaggttgtgtctctaaaagaaaaaaaaaaaaaaaaaaaaaaaaaaagaaaagaaaaagaaaggggtaaacaggaaagccaaagatctcgagcatctccagatgattgcctgaacaaattgttttttcttggcttccaaacctttcaagatgtatattactttgtaaaagaaagacatgccaattgtaactttaagtgagcaatcaaaatctagctcctaaaactgaagtattttaactctcattctgataatttattttctgaggcacagaagaaagacaagattaggtcaattgtttttatgcccactccatctcttccaacctgccttctcccctttaatcaaatgtataaacactaagcctcctgaaacctcttcagagaaaacacaagccacagaggttttttgcaactcatgttttcccagggtgcaccatcaagctctggctcgataaaactcaattggtcaagacccttgcctcagtcagtcattctggataaccaccatgagtcctgcaaagcccttcagtaatctattgcctgcctaggtgatgtgtacccaggtgagtcaggtcttcatgagtcaaacactcgtcttccttttctgtctttcccaaccctaccactcagtgctgtgtgctctgatctgaccccagctcccaggttgtttgtattggtctaagaaagcaagaccaggaggggcaggttgagaaggaagtaagaggccaacagccatggaaagtggcaggtggggctgtcattgctcaaagccacacaccctgggtgcattttgtgaatttttctggattcggaatctttttcctgtgtgtctgtctagaaactcaccttcttcctactttcttctcagtacactttctgtttctagtgcactcatttatgtccagagaatggccatgcaaatagttgacaatagaataaaaaatgactttttatgagacttggaagctggcctttcttttttccaaaagagattgaggtttccataaaaactagcttttatgcagggctgtgtagttgtgagtgtagttttagggaacaggtgcataagtgaagggtgagacagaaaacaaaatgctggctgtttgtcaaatcctgaaagtaggggggctgaaatcatttttgaaggaggatgtcattcaggagaccttgtacatcttagagtgtcctcttaccagatgaagtggaggatgaggttgaattagggagttaggtgacagtgggcacatacttctctgcctcagttttttttttaaatctgtaaaaatggggatgataacactcaggattttttggtgaggactgtagttacctggaaagcccttaggatagtgcccggtgcatagtgagtgctgcatcagtgtgagctattataattatgggaataggcaaaggtgccaccctggccatccagagtggagaggtattttctggtcagggtccaggcaggccagctggagatgaagctgattagtggggaagcttaacttccaggagcggaagaatttaggaggagtaaacagaatgcacaacattctgtaaacatgcctttacccaacagtaggaatactcagagtgggtgtggcttccatggcaatcattatctcctgggaatctaagaatgtgtcctagagtcaagtggctttgatgtaagccaaacctggaaatgggcttcagggctgccttgcacatagcattcattcatcttgaaaaaggaaagcattcatcttgctaaaggaatcccctcttctggtccaggccattatttttgcttttgtactatcctaatttttaaggtgtaaggagaaagaccaaagaataaaataatgaagtacctgtatgaaataacagggtagaattgagactggtacgtgtaagttaagagaaattgtgtataaatttttgtgaacagaaaaaggatttcttgttgcaaactgacctctctatataaataatacccattgccttgaatggatggcagaccgcatcacaagaacattccagcagagtcatgagagaatgggtagtgtggcttctttaattggcaggttagactgagtaagttactgaagagaaaggagttgaaggagaagatgggtgagggcaagaaaaatgggaaggtgaaaggaaaggactgaaaggaatgtttaccaagggctcatcaggtaccaggctctgtgactaatgtcttacacatgttaatttactcttccactgtcattttctgatgcagtaagagtcagtcttacactacaggtgaggaaagaggctgagggaggtcaaatgagtggcccagggtcatccagccacttcatagcagagctagtgtgtttcactgtggtttgtgcagacagaaaagtgagacatagaaggaaggcaaaacatttttgttgtgggtgatgtttatgaaagtgacccgtatgaggcagaataatggcctcttaaaaatgtccacatccgggccgggcgcaggggctcacacctgtaatcccagcactttgggaggctgagacggtggatcacgaggtcaggagttcgagaccagcttggccaacatggtgaaaccccgtttctactaaaaatgcaaaaattagctgggcgtggtggcgggcgcctgtaatgccagctacttgggaggccgaggcaggagaatcatttgaacctgggaggcggagattgcagtgagctgagattgtgccactgcactccagccagggcaacatgagtgaaactctgtctcaaaaaaaaaaaaaaaaaatccacatcctaactcttggaacacatgcatttacttttcttggcaaaaacactgttcaaagttaatgaagttgagtatcttgagatggaaagcttattctggcttatctgggtggctcccagtttcatcataagtgtccttgtaagtgaaagagaaaggcaggagggtcagggtgagaaagatgcagcctgagagactccactggccattgcttcctgtgaacatgtgtgataagacaaaattacaactaatttagttacagatgtaattggcttttatttgtgatttatgatttggggcagctctccctctacagatgcctcagcatcccaagtagctgggactatattgcgggatctggccagcagcctgcaatgcaacggggctctttctttgttcccaggcagatcagcaggttgagaaataaaagacacacacaagatagtgaaagctgggtccagaggggtcaccgccttcttgtcctgcaatgctgccaatgcactggatataccagcatttattattaagtttagtgagagcggggttaggttagtgagggatttagggtcatttataggctctccacaagcgttgcattccattcccagagctatggacatctgcttttctgggataggaatcttggtaatgtgaaacctccctgactgcacgtctgttcataggctctctgccgggggaagcacatcacgtgctgttggctcattctggcagtccaacctggcatttgtctttacacaatcctgcatgcaattttgtatttacaataatcaggagcatttcatcttttattccatagcaatagtttcagggggtctccctacatctcccccttttctctgatttaaatgaaccatagcaatcatagcttggcactgatcacgattggattgaagaatatttttttccaattttacatatgaacaataaaccaatagcacaaattatacacagaacaaaattaacgatagtggatcctcccaaagatattacctattgaatggggttgagattagataacccctcagagatactgtctaaaacttcagcactgggtaaagcagttaagtgtgcttgagaggcttcaaaaatctgttcttttagcttgcttatgtctaaacttaaattatcttcacttccttgtaaatgggattttactgattcccaattatgaacagactcattatattggaactgagttatacaaaaatcagaagtattcctatcacactaaatttgtaatctatgttctaaactcataattctatctcccatccatataacagaagcacatcaagcgctgtaggctcattctggcagccaatctggcattgtctttacacaatcctgcattcaactttgtattgacaataatcaggagcatttcatcttttattctgtaacaatagtttcaggggttctccctacaggactacaggtgtgcaccaccatgcctggctaatttttgtatttttagtagagacagggtttcaccatattgaacgggctgatctcgaactcctgacctggtgatctgcctgccttggcctcccaaagtgctgggattacagatgtgagccactgcgcccagcccataaatcacacatttctttgagtttttgtaattccagcccaagagaaaccatttgatatttcaagaatggctgcacacaaatattttcacacaaataaaaacatctgtagattgcaccacacgagggagactaccagtatgactatcaggaggaaaatatcaagagtttggaatatgcaccttaggaaagatgcaaaccaactacaataggatagatcaaagaagaagccagaagagtctagtcattttaaccagtcagcaaatttattgatttttacaaccaagtctttataatacccaatgtatttatccatgtgcaacaagaagtgtcagaaactgcacaggctccccactgttcagctggtagagagcaattctattatctattattgcatgtctatgttaaattaaaaaaggggaggtgccaagatggccaaataggaacagctccggtctacagctcccagcgtgagtgacgcagaagacgggtgatttctgcatttccatctgaggtaccgggttcatcttgctagggagtgccagacagtgggcgcaggtcagtgggtgcgcacaccttgcacgagccgaagcagggcgaggcattgcctcactcgggaagcccaaggggtcaaggagttccctttcctagtcaaagaaaggggtgacagatgacacctggaaaatcgggtcactcccacccgaatactgcccttttccgacgggcttaaaaaacggtgcaccaggagattatatccgtcaccaggcttggagggtcctatgcccacggagtcttgcagattgctagcacagcagtctgagatcaaactgcaaggcggcaggaacccaccacagctcaaggaggcctgcctgcctctgtaggctccacgtctgggggcagggcacagacaaacaaaaagacagcagtaacctctgcagacttaaatgtccctgtctgacagcattgaagagagcagtggttctcccagcacgcagctggagatctgagaacaggcagactgcctcctcaagtgggtccctgacccctgatccccgagcagcctaactgggaggcacaccccagcaggggcagactgacacctcacacggcagggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcgcctctcctcctccaaaggaacgcagttcctcaccagcaacagaacaaaactggatggagagtgactttgacgagctgagagaagaaggcttcagacaatcaaataactccgagctacaggaggaaattcaaaccaaaggcaaagaagttgaaaactttgaaaaaagtttagaagaatgtataactagaataaccaatacagagaagtgcttaaaggagatgatggagctgaaaaccaaggctcgtgaactatgtgaagaatgcagaagcctcaggagccgatgtgatcaactggaagaaagagtatcagcgatggaagatgaaatgaatgaaatgaaacaagaagggaagtttagagaaaaaagaataaaaagaaatgagcaaagcctccaagaaatatgggactatgtgaaaagaccaaatctacgtctgattggtgtacctgaaagtgacgaggagaatggaaccaagttggaaaacactctgcaggatattatccaggagaacttccccaatctaacaaggcaggccaacattcagattcaggaaatacagagaacgccacaaagatactcctcgagaagagcaactccaagacacataattgtcagattcaccaaagttgaaatgaaggaaaaaatgttaagggcagccagagagaaagtttgggctacccacaaagggaagcccatcagactaacagcggatctctcggcagaaactgtacaagccagaagagagtgggggccaatattcaacattcttaaagaaaagaattttcaacccagaatttcatatccagccaaactaagcttcataagtgaaggagaaataaaatacttcacagacaagcaaatgctgagagattttgtcaccaccagacctgccctaaaagacctcctgaaggaagcactaaacatggaaaggaacaactggtaccagccactgcaaaatcatgccaaaatgtaaagaccatcgagactaggaagcaactgcatgaactaaggagcaaaataaccagctaacatcataatgacaggatcaaattcacacataacaatattaactttaaatgtaaatggactaaatactccaattaaaagacacagactggcaaattggataaagagtcaagacccatcagtgtgctgtattcaagaaacgcatctcacgtgcagagacacacataggctcaaaataaaaggatggaggaagatctaccaagcaaatggaaaacaaaaaaaggcaggggttgcaatcctagtctccgaggaaacagactttaaaccaacaaagatcaaaagagacaaagaaggccattacataatggtaaagggatcaattcacaagaagagctaactatcctaaatatatatgcaccgaatacaggagcacccagattcataaagcaagccctgtgtgacctacaaagagacttagactcccacacattaataatgggagactttaacaccccactgtcaacattagacagatcaacaagacagaaagtcaacaaggatacctaggaattgaactcagctctgcaccaagcagacctaatagacatctacagaactctccaaccaaaatcaacagaatatacatttttttcagcaccacaccacacctattccaaaattgaccacatacttggaagtaaagcactcctcagcaaatgtaaaagaaaagaaattataacaaactatctctcagaccacagtgcaatcaaactagaactcaggattaagaatctcacttaaaacaggtcaactacatggaaactgaacaacctgctcctgaatgactactgggtacacaacaaatgaaggcagaaataaatatgttctttgaaaccaacgagaacaaagatacaacatactagaatctctgggatgcattcaaagcagtgtgtagagggaaatttatagcactaaatgcccacaagagaaagcaggaaagatccaaaattgacaccctaaaaacacaattaaaagaactagaaaagcaagagcaaacacattcaaaagctagcagaaggcaagaaataactaaaatcagagcagaactgaaggaaatacagacacaaaaaacccttcaaaaaattaatgaatccaggagctggttttttgaaaggatcaacaaaattgatagaccgctagcaagactaataaagaagaaaagagagaagaatcaaatagacgcaataaaaaatggcaaagaggatatcaccaccgatcccacagaaatacaaactaccatcagagaatactacaaacacctctacacaaataagctagaaaatctagaagaaatggataaattcctcgacacacacactctcccaagactaaaccaggaacaagttgaatctgtgaatagaccaataacaggatctgaaattgtggcaataatcaatagcttaccaaccaaaaagagtccaggaccagatggattcacagccgaattctaccagaggtacaaggaggagctggtaccattccttctgaaactattccaatcaatagaaaaagagggaatcctccctaactcattttatgaggccagcatcatcctgataccaaagccgggcagaaacacaaccaaaaaagagaattttagaccaatatccttgatcaacattgatgcaaaaatcctcaataaaatactggcaaaccaaatccagcagcacatcaaaaagcttatccaccatgatcaagtgtgcttcatcgctgggatgaatggctggttcaatatacacaaatcaataaatgtaatccagcatataaagagaaccaaagacaaaaaccacatgattatctcaatagatgcagaaaaggcctttgacagaattcatcaacgcttcatgctaaaaactcaataaattaggtattgatgggacatatctcaaaataataagagctatctatgacaaacccacagccaatatcatactgaatgggcaaaaactggaagcattccctttgaaaactggcacaagacagggttgccctctctcaccactcctattcaacatagtgttggaagttctggccatggcaattaggccggagaagaaaataaagggtattcaattaggaaaagaggaagtcaaattgcccctgtttgcagacgacacgattgtatatctagaaaaccgcattgtctcagcccaaaatctccttaagctgataagcaacttcagcaaagtctcaggattcaaagtcaatgtacaaaaaatgacaatcattcttatacagcaacaacagacaaacagagccaaatcatgagtgaattcccattcacaattgcttcaaagagaataaaatacctaggaatccatcttacaagggatgtgaaggacctcttcaaggagaactacaaaccactgctcgatgaaataaaagaggatacaatcaaatggaagaacattccatgctcacgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaacagcctgcatcaccaagtcaatcctcagccaaaagaacaaagctggaggcatcacactacctgacttcaaactatactacaaggctacagtaaccaaaacagcatggtacaggtaccaaaacggagatatagatcaatggaacagaccagagccctcagaaataacgctgcgtatctacaactatctgatctttgacaaacttgagaaaaacaagcaatggggaaaggattccctatttaataaatggtgcttggaaaactggctagccatatgtagaaagctgaaactggatcccttccttacaccttatacaaaaatcaattcaagatagattagagacttaaatgttagacctaaaaccacaaaaaccctaggagaaaacctaggcattaccattcaggacataggcatgggcaaggacttcatgtctaaaacaccaaaagcaatggcaaccaaagccaaaattgacaaatgggatctaattaaactaaagagcttctgcacagcaaaagaaactaccatcagagtgaacaggcaacctacaaaatgggagaaaattttcacaacctacttatctgacaaagggctgatatccagaatctacaatgaactcaaacaaatttacaaggaaaaaacaactgcatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccacttagaatggcaatcattaaaaaggcaggaaacaacaggtgctggagaggatgtggagaaataggaagacttttacacttggtgggactgtaaactggttcaaccattgtggaagtcagtgtggtgatgcctcagggatctagaactggaaataccatttgacccagccatcccattactgggtatataccaaaaggactataaatcatgctgctattaagacacatgcacatgtatgtttattgcggcattattcacaatagcaaagacttggaaccaacccaaatgtccaacaatgatagaatggattaagaaaatgtggtacatatacaccacggaatactatgcagccataaaaaatgatgagttcatgtcctttgtagggacatggatgaaattggaaatcatcattctgagtaaactatcacaagaacaaaaaatcaaacaccgcatattctcactcataggtgggaattgaacaatgggaacacatggacacaggaaagggaacatcacactttggggtctgttgtggggtggggggaggtgggagggatagcattgggagatatacctaatgctagatgatgagttggtgggtgcagcgcaccagcatggcacatgtatacatatgtaactaacctgcacactgtgcgcatgtaccctaaaacttaaagtataataataataattaaattaaaaaataaattaaaacagggagtgagaataggtaagtatagaagtggaagcctaaaaaaaactccatacatttgaggaaaaagttgtgttacagaggcagctaacatcagcctttgggtggactaaaggatctctttttatgtaaaaatgcgtgggctgggtgcggtggctcacgcctgtaatcccagcactttgggaggctgaggcgtgcagatcacctgaggtcgggagttcgagaccagcctgaccaacatggagaaaccctgtctctactgaaaatacaaaattaggtgggcgtggtggcgcatgcctgtaatcccagctactccggaggctgaagcaggagaatcaattgaacccaggacgcggaggttgcagtgagccaagattgtgccattgcagtctggcacgggcaacaagagcgaaactccatcttataaaaaaaaaaagtgtggttgacatgatatatcggacactgttaacttactctcagaagctacttcttgtgaaatcctaagtacagcattattctgggaagcaaaggagacaggcagaagcaaggacaaattaagagaggtaacagtctcatcatgactgatagtcttgttctaacatcttgagaaaagctgtccacagtgtaaagtcatcaacttgtcgtggtttgcagtttgagtgtctctaagttatggtgttgaacatttggtgagctcttagtggcccacacttcagacacgagggtttctccatgaaatttacattgagttgtccatctccatcttatatggcttcaggaacagagctgctcttgttcttaatgatttcactggagaaaattaaattggaagaactaaaagaattcagggtccagtccagtctaccagtggattataagtactcaaagataatgaacagtggttcaatctggtaacaggtgtactacagtttttcttttcaacatagtttttctctttataggagtctctatttttaccaaagataattccagtaggatgaactcttttgcaaaataggttgagtctcaccgaacttgcccagattttttacctaagtgcggcaagagtagcgatggaccatagaggctctttttaaactcccctttgctggaagtttttagtaagaatctcagattaaacttccaaaaacctcttgagactaagaagccaaaccaaggccaacttcagactttgcctgcattccctatgggtttattctatgtatattctcaaatataacatcccagtcaaagccttggtaatataaccaatgttttcaaatgtgtcctgttataaagagagcagatccttactgaacttgtgcagataactttattaccataaacatatgaatactcctgaatagtttcccaattctggggcacttagggagcaaaagcaaatgtttcaatttttgtttacaaaagtatactttaccaattgctgaagaaaaaaagtgcataaatctggagaataaaacattcaaagaatcagcacattttcaaatagaaaattatgaaaacattgttttgactatttagtccaataaaattgggtttttttctttgtcttgaatttcatgaagtatcagcctgttcattaaaattttgaaagttcttagtccagtggtatgatcttgaagttatcaggaacttgtattcaagagtccttgtcagagtcttttcataaatctccttgaacaaaaagcaattttggactgtagctgatggtaaatactttgaggaagaatgaaagcaactgtctgggaatgacaaagatttaaaatgactatggttaaaaatctaatgagaatttattatggtaaagacacagctcacaaaatctagttacttctgtggcatatgacactatgataacatatttgatttccagaaatttcatataatttttagaatactcattaaaaaaattttttttttgagacggagtctcactctgtcacccaggctggagtgcagtggtgcgatcccagttcactgcaagctccgcctcccgggttcctgccattctcctgcctcagcctcctgagtagctgggactacaggtgcctgccaccaagcccggctaattttgtttttgcatttttagtagagatggggtttcaccgtgttagccaggatggtctcgatctcctgaccttgtgatccgcccacctcggcctcccaaagtgctgggatgacaggcgtgagccatcgcacccagcctagaatactcatattattaacattcccataaatattatttagaggaggtttagcatcacttatcacttatttgaaaatgctttctatataatttaacttatcaaataaagtggcttttccattcagcttctgtttgttaactggattactgagttcttggtgtagcccattcataaatagggccaaaaaagtatagtcttatgtatgttgaaaaaggtccttaggtaattccagtacttccagctgaacatcattgatttagttttaagttctacctattacaacaagagttctccatccttgttacatgttagtagtgtcagggaagacttaaaaattaccaatgcctgggtccctctccagacctttaaactggaactaatgggtggggcttgagcatccacttttaaaaatgttttccagtgattccaatgtgtagctctatttcccatcagatttctctgatttcttgtggcattcaattttttctattttggtatcatgattattttcaggtctcatttcctgtcttaggctttatgtctcctggcgtagggaccttgccttcatcatttctgtatcttttttaaacacatgaactggtcatcaggaaaagatctcaaccacacataggttgtgttctgagtctcaggttcacatgttaatcctaaagtcttagttctccacgaggtcagatgttgcttgtgatgaagggtgtggttaagtctgcagtgcagatggtagaggggatttcactctgttttcagacatagcattggaactaagaattttatatctatatgggtgaagggacaggggtgtgtaggaagacagttctaattaggatggaggaattatactaggaagtagcggtaaaggaagtgagaaggcttagtaaatagaagaaatgtgaacttatcaaagtggctagagtagacccctggagattcttgattaagtgaattaactagattttagaaaggtaatgaggcagtcatatgcaaggaagatttcaaagtctggagacaagaagtcaagcaatactttgagaagtggttgagctttatgggaatggagagaattacactattgagagatgttaaaaataatgaagagggtttcaccatgtgaaattgtgtttttcatttgaatctgagaaacaaatgagcagagagagaggctggagataattatgtctaaaagacagtggggtacagggagcataaaggccagggagaaagggaactgcaggaattagtgctgagaagcaggagttagtggaggaaggaggagatccagtcccagatacaggcaaataagtcttttccctctcccaagcatggcagttagccctgcaggaaccaggataagaggaaaggtcatcatacctgccagtcttcctgaaatacagaaatgacatcacggctgctataatggattaaggccaggaagatgtcctgttcctgaaggagctgtcatggaaaaaaaagaaaagaaggaatgaagatgatgttattttacatgggggagcctcaggaacaagcatgtaacatgaggtactctataattgtttcttcaaggactacgttatttctgttggaaaattgataggagatgattatattcttgcagtttttttttccctctcaccctgtttctcagttggtgatcagtcctctgtcaattctctactgtgctcagatatttggaaggctttcagatgtgagaaaggctgattgctattttctatgtcattagaacttgccacctttgcaccttttcatggttgcatctttttctcagtgtctctgttgtggcagtcatgaatgagaccctgccaggtctccatggcagagacttgattgacagaaggcccaggtcagtgcatttcaaattcaccacctcctttgcacagaaagcttctttcctacaggctcccagcaagggcgtgaaagcaagtctagttctctgaggctctctttaactctaatgggtgactggttggaggattccccatcagccttgcaaaaactcttataattgaattggtacctaaaacttctttctctttctttttcacaggaatcagctctgcatagtggtctgtgggttctcccgtactaccttcatgcctgccccacattccctcacaggtgtcttccctgataagttatcttgtatgtctaatcccatcttggatgcatctcagtcagtaaaaactaacataccaggcttgattctttgcacttagctttttttctttctctcccacaagtagtcagtaaccatgtcctagtgttttatgtgttacctctttttccatatatatatatatggaaaaaggaaggtactgttgaggggcacttcctatgtgccaggccctgtgctaaatactttccctgtatctcatttaatccacacaataaccctgtgaggtagacattatttccattttgccgatgaaaagacagaagcttagagtggtgtaaaactttcctggtgtcatatggctagtgacaggtggatctgagatttgattctaggactatttgacctctaggctaatgatgatggtagtcatatagcagctgacattggttccactgtgtgtggcatctcgttttattgactgcattaaacctttaaaagaaaggtatgaagaaagcactcttattgcagttttcaggtgaggtatcagaggttcagagaaattgagtcttgtgcaagaaatttataactgtaaactcttacattaaaaaagaagaaagatctcaggtcaacaacctactttaatacttcaggatatgaaagaagaacaaactaaacccaagcacagtgaatgagggaaaaataaggattagagtggatataaataaaatggagaatggaaaaagaatagaggaaattaatgaaaccaaaagttgattcttcaaaataaaatcaacaaaattgacaaccattaactagattgactaagaaaaaaagagaaaagtttaaaattcctaaaatcagaaatgaaaatggactctgagcatggtgggtcatgttttaatcctagcactttgggaagtcacagcagaaggatttcttgagaccaggtgtttggaccagcataggtaacctggggagaccctgtctctacaaaaaaataaaaaagccaattagctgcgcatggtgacatgcacctgtagtcctagcatcttgggaggctgaagaaggagaattacttgagcccaggaggttgaggctgcagtgagccataatcacaccactgtattccatcctgggctggcctacagagtgagagcctgtctctctctcttcaacaacaacaaccaaaaaaaaaaaaaaaaaaagaaaaaagaaaaatgaagcgattactaccaattctaataaactaatgattatgaaagtactataaataattgtatgccaataaattggataacctagatgaagtagacaaacccctagaaacacacaaaaatatgaatggaactataatcagtaataagattgaatcaataaaacatttgatgaaattcaatattttttcataataaaaactttctaagaagggaaggaaaccacctcaacgtaaaggcaatatgtgaaaaacccaatgctaacatcatactcaacggagaaagactgaaagctttccctgtatgagcaggaacaagacaagggtgcctgcttttgacacttttattcaacatagtattgaaaggtctagtcagaaaaattaggcaagaatttaaaaaaagacgttaaaattggaaggaaggagtaaaattatttctgtttacagataacttgaacttatatgtagaaaatcctaaagatggaacaaacctattagaattaataaataaattcagtaatgttgcacaatacaaaatcaacattcaaacatcagttgtatttcaatacactaaccatgaacaatctgaagggaaattaagaaaaaaaatttcaatttatattaacatcaaaaagaataaaatatttaggaatgagtttaaccaaagaggtaaaatgattatacctgaaatctacaaaatatggctgaaagaaatgaaagatgacatcaataaattgaaagacattttgttttcatgaattggaagactcaatattgttaggaggacagtgctacctgacgtgagctgcagattcaataaaattcctatcagaatctcagtgacatttttgcagtaaaaaaaaatctgtcctaaaatttatattgcatctcatgactctaaatagacacacagctttgaagaggaagaatgaagctggaggactcacacttcctgatttcagcatttactacaaagccccagtaatcaatacactgtggtactggcataaaggaggacatagaaattaatgaaatataataacccagaaagaaatgcttgcatatatggccaaatgattttcatcgagtgtgccaagatcgttcaatggggaagggaccgttttctcaccaaatgatattgggaaaggtggatatccaagggcaagaacagtggaacctttacctaacaccatgtacaaaaagtaacccacaatagatcaaagatctaaatgtaagggcaaaaactattcaactcttagaagaaaagcttcatgatactggatttcacaatgatttcctggttgtaacaacaaaagcataggcaacaaataaaatggataaatcggacttcataaaaatcaaaaccttttatatatcaaagaacactatcaagaaagtaaaaagcaacccacgaaatgataaaaatatttgcaaattatatgtgtgataagaaattaatttccagaatacatgaaaagctacaagtcaacaacagcaaacatccaaaaacccaattaaaaaatgaacaaaggattaaaatggagttttctccaaggaagatatacaaatatcaaataagcccatgcaaagttcctcagcatcaggaatacttggagatatgcaaatcaaaaccacattgttacaccacctcacacactttaggatggttttgataaacaacaacaatgacagcaacacaaaacaacaggtgttttcaagtagatggaaaaattggagctctagtgcattgctgatgggaatgggaaatgttatagccactgtaagaagtggtgtggctctctctcaaaaaattaaacaataaattaccatttgatccagcaattccacttctggacataatccccatagaattgaaagaaatttgaacaaatatttgtaaactgatgttcagagaagcattactcacactagccaaaaaatggaaacaactgaaaagtccattgaaagataagtgggtaggcaaatgaggtgtatctatacattgaaatgttgttcaaccttaacaaggaataaaattccaatacatagtgcaaagtggatgaaccttgaagatattatgctaactgaaataagccagacacaaaaggataattattatataattccatttataaaagatagttagaatagccagttacatagagacagaaagtagaatggtgggtgctaaggtttagggggagaaggagtgagagttactgtttattggctacagaggtttaatatggtaagaggaaaaagttctggaaatggatagtgtgatggttacacaacactaaattgcacacttagaaatagttaatggtaagtcttatattagatatatataaagtgtccagtagtcttaccctctctataattacacactttttggcactgcccctttcctgccatgcagagccctaggggtgaatctccctatttctccagctctgcatcagtcactgtcctccgtgctgtgtcccaggtgctgtgcccacagcctcatacagccggtgacttcagagccaggacacagctcaggagtctgccctgaggctccctctctttttgtttccctgcagcctggcccgggggaggcttggcttcaactggcaactcgatttagccaaattcaggacaggccaccagggctctttctccacagatgctggtcccacccaggtggagtcaggcagggccagtcaccagaggagcctggagcagagcaggaagcagagtctgagctgctcctccctcacccaaggggcttcctcctctcatctgggggaaaagtgtcagcttgtttcaaagcctcggatgttccttgtagctcatagaataggtacaagaaaacaaagacgtggcagaaggggatgtgttggtgacagcaagaagcaacttgatcttgaggactctccttcttgtccctctctgaatcctcttctaccacatagggctcagggctgataaagcccgctccgtacctttctcaggccagacacaaggtcagccatgagaaaacagaaaaacaaggagaagagagtctgtagagacaaattgggagggttcaggaggagaatttgggatttgcttgtgcccatgggacacaggctgggaataaaaatgttttcctgactcttctctgaaagccagagagactccacctaaaactctattgccaagcatgctgggatccacttaccagagactttgactgtcatggatttggagctttccatgccagtggctgagttacgaacagagcaagcatagagcccgctatgctttgtagtaatctgggggataaagagcttttgtcctgatagctgaaacttcccattaattgtccaagaatattctgctggtgggttagagtccgcgaagcaggacaagtagaggttttctcctgaatggtaataggtgaatgaagggtaaattctggggaggtctggaccatctggagcaaagagaataaagccacaggtgatgtcatccgagggaaggggatgctcctggtctcttaaagggacacagtgaccctctgagccaagacacaccctcaagtgccagccaaaccccctctatgttcactgagctgaagcctgaggtattcccctgtttctcccatcacaagctgtgggccccaagtctcccatgacaagagcgtcccctccccttatattcttggttaaggctgtgcctacccagatcttcccagggcaggaagttatggccagctcggatgtccagaagtaatggtatctatacttggaccagagagagagtgagaggcctggcctctggtcgttttgatttaagctggtgtcctggcccacagaggaacaaaagatactcacagaggacattcagggtgactgggtaactgcggatgccaccatatcggtcctgtatttcacattgatagggtcctgtttcatttctcgtgacactgggtagaatgaggatcctgttttcaatgggtcgctttaccctgggactgaccgggaggctctgaccatttagccaccaaatgtaggtgtagttctcactcttaggttcacaggtgaaggctaagacatccttattctccctggggtttaagttgttgatggtgatgtagggcttgggcagcttcgctgtgtggataacagagagaagattgtcctgtgtggcacctttgattcctccactggcatccttcaatcagagttggcatctcccacctctcagcccacccgagtccttgaaagccaatagctggtgcgtgtgtcacaagacagatgcatgatgatctaagggctcaaagactgtgaggccagctgctctgtcttagggaagcacagactttctcaagtgtcaattgagcagcagtgttgggtcatggacagacacgtcaatgggagtcacagcccctggtacccctcccagtccctccataatcagttgactggctggctcaccctgggttccttacctggaatgtgcaactggtgggccccttccaaattccatcctactttgcccccatagatgtgatttctctgcaacttccatttccaaggacattctagagatgagtaataatgggacttcccatggccctgaaaccctgaagatactgagcagcctggcctgggactggatgtttcagcagaaataacacaggggagaccagaatcaagcctggaggtcagttcagtcatcaggcagtggaggctcaaggtggggcagttttttgcaggtgtttcatgatgacttacttgaaccagtgacctctaaagatagagcagagtgcaaggaatgatctagaaagagtgaaggtgacaggcaagagctggtggctttggagcagaagcatgttccctgtcttgggttctttaagtttcctctccttctgcagagggcaggtgaggaccatgtggatctttccagaaatacatgtggacatttgcaaatgcagcactgactggtggaaagggtgggaatgaactgctggaaatctggtcctcatggaccatatgtgtttgatggatatgagacaaatttggagagaagttttgcaaatattttctttcattggacattctactcaatgattccatgggttcgactactctagggacctcatgtaagtggattccagagtgaatatgagaagagactgctggttgccaggagctgggagtggggagaatcagaagttgttcatgggtgggcagtttcagttattcaaggtggggaggttctagagatctgctgtagagcttgatgcctatagttcacacagattgagtatttcttatgcataagacttaggacaaaaagtgttttggatttctgacattttttgattctgaaatatttgtcatatacttactggtttagcatcccaaatctgaaagactcaaaatctaaaatgcttcagtgagcatttcttttcagcatcagattagtaggcaaaagtgggaggtgataagccaaagatattcttgccctttttttttctctcaccacttttctagcttggtgattagttttcggtgaattccatactggccatgctgcacttgtatatttttgaaggccttgggatgtgagaaaggctgattgctattttctatgtcatcagaactttccaccttttcatggttgcctctttttctcagtgtatctgttgtggcagtcattaataagagcctgtcaggtgagatttaggacagtgttttctaattctgcaaaaaatgttactgggattctgttaggtgttacattgaatccgcaactcactttgggaatattatctttctaacaatattgattcctccaatccatgaaaatgaaatgtgtttccatatattgatatcgtctttaacttgtttcagcaatcttttgtagttttcagggtataatcatttgactttttggttaaacttatttcaaaatattttattccttttgatgttaatgtgaactgaaattctttccttaatttcctttcagattgttcattgttagtgtatagtctaaagaatgatctagaaagagtgaaggggacaggcaaaagctggtggttttggagcagaaacatattccctgtcctgggtttttgattttccctctccctttgcagagggcaggtggctcttccctgatagctagatagacttcactggaaaacatagtgccaatgctccagggatccacttaccagggactatgatcctcttgattatgagatttgttccagcagtggctgagttatggatgaaacagacatagacccctctatatgttttagtgatttgggggataaagaacacttgtgctgattgctggaacttcccatcaatcagccaagaatgctctgccagtgggtgagagtctgtgaggcaggagagcttgggggcttcccctgtatggtaataggtgtatgaggaggaaatggtgggggcatccaggccatgtggagcaaagagaataatgtcataggtggtattgtcagagggaagggaaaatcctggtctgtggaagggccacagtgaccctgtgagccaagttgcaacactgaagtcccagccaaatccctgctgtgttcactgatctggagcctgagacagtcacctgttttgcccatcacaagctgtggacgctgagtctcccatgacaggagcagcctcttttctcctattgttgatcaagcctaggcctactctggtttgcctggggcagaaagtcatggccaggtttgatgtccaggggtaaaggtctctgtacttggacctgagagggactgagaggcctggcctctggccacgtgtatttgggatggcagactggctcacagaggaacaggagatactcacggaggagattcagggtgactgggtcactgcggctggcactcactgggttccgtatttcacattcatagggtcctgcagtgtactttgtgacaccaaatagaaagagggtccttttgtttttggacaactgcaagctgtgagtcatagggaggctctgaccattcatccaccacaggtagcttgcgtccggagtctcaggatcacaggttaagctcacagcctccatgtcctccctggggtataagttgctgctggagatggagggcttgggagtctccactgtgcagaaaacagagagaagattgccctgtgtggcacctttgattcctccaaaggcatttttcaatcagagttggcatttcccacctctcagcccacccaagtccttaaaagcccatggcaggtgtgtgtgttacaagacagatgcatggcaatctgagggctcagagattgtgaggctgcctgcttcgtgtgggagaagcacagactttcttaactgtgaattgagcagcagcattgggtcacggaaagacacaggaccagcagtcacagcccctggtgcctctctgagtccctccatctcgaagtgcctgcctggcccaccttgtggtcctcacttggagcatgcagtgctggaatcttcttagtttcagtcttactttgccgcccgaggtatgttttctctgcagcttcccttgccaaggacatcctagagatgggtgatggaacttccaattgtctttaaaccctttggatactggaaagcctgacctgggactgggtacttcagcagaaataacacaggggagaacagagtcaagtccggagttcagttcagtcatcaggcagtggagccacaaggtggggcagttttcccaggtgtctcatagtggctgacttgagccagtgacctctaaagatagagcagagtccaaggaatgacctacaaagagtgaaggggacaggcaagagctgatagctttggaccaagaccacgttccctgttctgggtccatgatgctcccttccccctgtagagggcaggtgaggaccatgtggatctttttggaaatacatgtggatgtttgcaaatgcagaaccgactggtggaaagggcgaacatgaacagatgatggaagtctggccctcatggaccatatgtgtttggtggatattagaccaatatttgggaagaagccttgcagatactttctctcattagacattctactctctgattctgaatttgactactctatgtacctgatatcagtggattccagagtgaatcagagtgtagaatagtagtttccaggagctgggatcaggggaatagggcgttgttctgtgggtgtgcggtttcagttatgcaggatgaggaggttctagagatctcctgtacagcttcatgcctatagttcatacagataaagtgctccttattcagaaagcttaaaaccaagtgttttggatttctaattttttttattttggaatatttacagtacatgtactggtttagcatcccaaatctgaaaaatttaaaatccacaatgcgccagtgagcacttctttttagcatcacatcagtggtcagaagggttgagttttggagcatttcagattgtggatttctggatttccgatgctcaatttgtaatactgtaattttcccataaaaatttgtcaggagtttagaccttatgttctgactctagtaacaacaacagcaaaaaatttggaggaaacattgaaatgttttcataagtggaaatttttactgatgatccaaacatctaagatcaattgctggtagtagtatttctcttgagaccaaaataaggtttaggtgtgccgtgaattccagcaggatcacattatgctcaaagaaagatgccaaaggtgatttgaaattagcaactccttaagtagagagagtcccgttaaaaggacagaactggttagtgtgtcaattgcataaagggaggaaggatgccaaactaaaagaagtgatgtgtgttatgttagtaaatatagaaagaacctgcttctaatttctgtgcagagttaggaaaaatggggaggaccccaaaacaggtatgtgaaatgctttcttcattttctcttaagctcaggaaacaccactagtgtttaagtttgtgtgaattagaaagagtctaagtgagatgccaatggtttgtgtgtctccccacacgcagaactccaacttatgaaaacggcatcatcatgaggaaacagttgtatgtggcacaggcagtaaagccatcagatagcacccacctggccacctccacctggtccccaaaaccaccagtattcccattacgtgtatcttatagcctttgtagttgtcccacagctacaaaatttaaaaattgctattgtcaaatcaaaatattaaatatgaagttgaaatgttgttccactttttttccccactcttgttgaactttcctgtttcagttttggaagtttctattgacatatcctcaagctagggattctttcctcagctatgttcagtctaccagtaagtatcaaaagcattcttcatgtctctaaaaacatttttttttttctgagacagagtctcgctctgtcacctaggctggagtgcagtggcatgatctcatctcactgcaagctccacctcctgggttcatgccattctcctggcttggcctcccaaatagctgggactacaagcgcctgccaccacgtccagctaattttttgtatttttagtagagacggggtttcaccatgttagccaggatggtctccatctcctgaccttgtgcctgcctcggcctcccaaagtcctgggattataggcatgagccactgtgcccagccatctctgagggattttaatgagttgttgacttttgagtttgttcagctttttacttagtgttagaaccgaggaacaaatttcaagcttgttatatgcctgacaggaagccagaagtctctaggaagtgaccggagaatgtgagctttatagcaggttgaggatggagtcacaagtgaaatgggtgaaatgagcccatggggtttggggactgcaggcctgtccagcctctgacactctggtgagtcagtgctaagattacaacagtgacagcaaactagcatggctgagtccatctggtatctagtctcaggctggctgtcctcactcattcctgggcataggccaggctaaccttgggaggaatttagtttattgtttaactttgaagcaagaatgataattgttcctctgtaaaagtaacacccttactttgcccagggactgcctttgtaaaactagtgaaagaccatgagattaagattataggagggaactgaattctgctaaaatgttggcagagtttttataatccttgactgctcaaatgtcgttgggccagagtttacaaaatttgtaactaattgctcctatagataacatcactattgtagaacgtgagattggtcttttgagatgtttctcattcttttgcattctggcaaccggctgacctcatccatacctatgactaatggctcagcccgtcatgtggtccctacctagaggtggattcaagcacaaacagatcatttccctccgcccgcatgattccatcaccaatcagcagtactcattttttagtcctgtgcccctgaaactatccttgaaaatctctaagccctgatccactggggaggctgatttgagtaataataaacctccatcctcctgtttggcagacttggagtcattaaaatctttctttactacaaaccaccatttcaatacatttgtgtgtgtgtgtgtgtgtgtgtgtgtgtgtgtgtgtgtgtgtgtgtgcaggaggccagaagaacttgtctggcaattataagagtggatggagaaactgcctatccctgtcccatggtcttgtccacaggtcagcctcacaaagggaaagagccctggatgggaatacagtggaaactcattctcttagtgacctggggacattggctctagaggaagcctggcaggagtggcaactccaggtgatttctgcacctttcctatttcctgggaggtgggccaggccacagtgttagcgggaagggaactgaacagtcagcctagttagagggagtgtctggggaagacctaggggtgggggaagaagctgtgcaggacagggcttgccagtcagaatgaagtgggaggaagatgagggacacagagaagcagagagaggcagagacaccatggcagtgagcagtgagggctacactgacttcagagaccccagggaccaggtgcccccagttccacagtccaggaccaaggagccctgagaaccctccggtggccaaagagcttcagagttacatgaggtggggttgctttagggtcaagaggtagtggggggatgaaacgtgggtgtcagcctctgaaggacaagggacaggtgtggctagaacctcctaggattctgcatgcaaattcagtctctaaagaggttttggatcattcatttcttcattccatttcttcatttgttatgtaagagctcctgagtgtgtctgtctcgctgggcctatggtggtgtagggtgtgagtggggaaagaaaacaaggtcctctccttgatcctcttgtgacagtgacatggacactttgggaaacacaggatttcaggttcagtgatggtggttaagatctgagggggaggcctggacatgttttttccactgactctgacggttgaggtaggtgatttagttctggaatacagactaatcagttgaccgtttgctctcactcctctgaggtttggatgcctaagaagagaggatttgagccaataaatgactatagggtgattggaacccagtaagccctcacttctggtggaggagagggtgggcctttggctccagacacacctcatgtgaccctgatctcccctttgtgtttgtgtgactctggttcagtgactgtggcttcctgtgcctcagttttctctcaaacaaataagctaaatggcaaatggactgtggcttttcatgctatctgtgaataaatgttaaatgattcacagtcacgtgacctaattcttggcacagtggaggtttcacacaaacagcatttattattaatttgcttccatgagaaagcacctttatgtcagatgcctgtggacaagctgctacctggtatatcttctctcctctgtttctgcttctggggacattagactttctatggactggcctaagcctcctaaggcagttgtctgatggcctacaaagcttgtctttctgtcctctccactctgagtgtcaggtgaagaaagctctgtccttgcccagatgaggctctgagggctgagccctggctggtgaacagctccaggagacacagtcctctgacagctggtaaatccttggtcccagtaagccctgcccaagaagcgacaacccagccccagtacaggctcctcagatttatctggagcaaggatttagggacatggttctgggggtgaggcttctagggctgagcttctctgagagtatttcatggggcccctgaggccaagccctactcagtttgccagggtctttctcagggtcaaatttatgaagagagcatgaggtgcttggctgagactgatctcctcctgctgagtccccccatcagactgtccttcctctgcagcgagtgtctgcagggtctggatgcgggaaaggaattctgatctgttgaaatttgtctcttctgtgtgtgtcctgcactaaatgcccaaaccccagcatgggacataatgcagagagggacacaggcacaatccaggcctgacaatcctttgtgtgtgaagtaaagaccccatcccccaacacccagtgatcacgtggagtcactcacggtataaggtgaaggtgaaatgtccagtttctcctctagtcccatcacctcgctttacgatgtgtaaggtgtaggatcctgcgtcctcccgggtgacattctggatcagcagggatgcattggaatatactgtttctcgtccactgtatgcaggcccatatataattatttgaccatctactacgtatgatgtaatgtaatggtagaggtccttcatttgccctttgtaccagatgtagccagcaagattctggggcaaattgtggacaagtagaagaacgtccttccccttggaaactttggttggctcggcttcaatcgtgacttgggcagtggtaggcaagttccagaagtttaaaagtaatgctaggaggtggagagagcatcagtcaatattgagacctatgcattggggtgaaaagatgtggccctgggtcctgagaaggtctcttcaatcctcagctttgaagagacacacacacacacatacaaacacacacacacacacaaaaggggcatgtgtatatgtgtttgtgtcctactctcctactaggtgaaggtcagcaacatgacccccattccttcaacacttctgaccttggcatttttctgtttggaatcctcttccccaggggtccgcacggccccctccacactgccctcaggtcctgctcacatcagggcatccttagacttctttcctgacgcctccttcagagaccctgggtcttccctttctgacctttccctgctctgctccctccagggttcttctcaacacctgacctcacattctagaactctttgcatgtctgtcttcccccccatgacagcgtgagctccgtgaggacagggacttttgtgatcttctttgcaccccagtgcctggaacaggctgcagactcctgtagatgtgagagttctcagggccctccatgccctgggtgttttttcttcccccagttgttgaggtttttttgctgaggacagtgtttcatgccctgcttatatttttatttgaagtgtcatctgatatagttattattatcatttttcaaaatgtggtggcccctgatgattaatcaggaaaacagaacacttaagattttcctacctcttaccaattctggttcctgtgactttcctgttttgacccctgtccctcttgggtgtattttcccctatccaggctccaacagagacttctttcctttttttcttttttctttccattcttttttttttttgagacggagtcttgtactgtcgcccaggctggcgtgcagtggcactatctcggctcactgcaatttcttcctcccgggttcacgtgattctcctgcctcagcctcccgggtagctaggattactggagcacaccacaatatctggttaaatttttgtatttttagtagagacagggcttcactgtgttggccagactgatcttgaactcctgatctcgtgatccaccctcctcagcctccctaagtgctggcttcttttattttttagaaccccaggagtctctccaggagaccccatccagtcactctgcttcctcctcctgtcctctcccaggaagttctctcctcacctgtgagcaggagccccttccaggtgatgcgctgtgtgcagggaggggctgagaggggccccatggtctctgctgcctgcgtgttctcctctgtggagctgagcctaggatccagaaacttcctgagcatggctctcagctgtgctgtccttcctccttctgcgctgagcctcttcccggggcaggagcacttctcaggttcatgggcggggtcaggcccaggacacctctctgtcccctcctctctcagtcctgcctccttgtccctcctgtttttccttttgtctgtgtttcaggtccctgggaattgtggaggcctctgcctttttcagcagtgattctttcaccaagcctcatcacacactttgtgcagacacacacacacacagacacacacagaagagacacacacagacccacacagtcagaaacataccctgcaggttgggcaagcagagtcctgggcctcagcctcctgctgtccccatggctctgggtcggggtgcacattcatgccctttggcctctttcatccccatctggctctccccttcagtgcaggaggctggagctgaaccaggtccctgtcacagtgacaccccattgtgctgtgggtgagctgtgtgttgcctgatgagagggaaccttcctttttctaatcgtgtctagcttggctgcagcttccaaggatggacattcaggacctgggtgtcccagaggaaactgtccttcctggaggtgtgcaggatgaatctctcatgcctcttgtgaggagaggcctgtgctggttgctcagtggggggctgtgagtcccatagtcaaagggacagttctcggtcactctatggctccctggggtctggcggctgagctggagctcatggtttctcatgttcttcctgaccatctttgatgtcctctcttctctgcccagcttattgtcctgtggtcaccacaccttccccgtggtggtgcaggaggaagtggggagttacccaggaaccccgggggacatggctcattgagatgcaggagggggagcctgggacagagcaggggttcagagctggagagattcatcccaacttactctgtggccatgatgggctcagccatccatgtgccgacatacccaggggtctgtcctgaggtttttgacctggccaagctgctgtgtgtagaggaggaacaggtagtggccagagagcctgtctggagggacgttgctcacacctgagtgggcgtgtgggggtgagttgtgttctgggagcaaagagcaataacatcccccttctcccagcaagcacacaggagaggtctgtcttcccaagggacagctgggggtaggtggccacatcccggatggtgcctgtgtgtgagcatcacacgtgctctgagccccccggggtgcagggagcaggcaggacacagggtgcctggctgattcccggggaggctgtgggccctcaggcagccactgttctgtgtcagtgctaggcttggcctgggatgccccagagaacaggacagatggagcaggggcaggcatttagggagcagtgacagaacgagttgatgaggatggagggaggccacgaggggaaagcacccagtgtagtgtcgcgtgcaccagcactgccctgggagatgcctttagctgggcccagggaaggagcaggtgtgtggggaggagctccctgcagggggagtggtgttaggttggcggcccccaggtcagggaggagctgacagagtccgtgtggggagcatggagggcgctgaggacttgggccgaagtgaccctggtgagggtggaccctgctgggctgtgggttccgttgagggcggttggcatcccctgggaaggctccaggctgggagggactctgtccccctctggtggacagggagggaaatgtgaacggcagcaatcccaggccaggctgcatgttttattccacatggatctgcacacttcacacgaggtcacacatatgttatgttatagctccttcaccttccagccccgtgagtcccagtctgtgtggctctatgttcactgttctccctctttcacaatcagatgtcccaaatgcagatttttgtcaccttctgtgagtttgtgtttgtgtgcagtaggcagcactgtgtataccctgggggcagtgatgtctggggctgagcagtgcacatgggcttgggagaagaagagggagcagcagggtgggaagatcaatgtcaggggggcaaggacaagtcattttcattttctcactcccagggaccagaacccaggattctgactccagggcacagtaccacaccctgctggtgtccctggatgtcatgatgctcatagtgtcatgttgccttgtcattcatcttttatggtgtaagtttatttgcctcaaatcagaggcagggcttggtcaccaatgcagtttcaatactgtatctggttcaggtggctccagttggtgtgcagagataaaatcttagaggcatctctcctgcttggtgtgctgggtttccctctctccagctgctttctttaaactgataattctgacatttgccctcacatttaaagtgaccacctctcagtcacagcgtgagcccctggtcccagtgtttgctgcttgctttgaacacatccattaaagctccctgctggaaacctgtcagataacaccctggacttaataaagccattggcttaccggtctcttctctcctctctccatgggctcactgacctctgtgtctgtggtctccaggtgtgccaagtgctccccagtgtctgtaagtagtaaaaatacttacactttcacgttgtggttgtatcactgtggcctcacatgccatccagggtctgatattgaggctgccttatgggacctgtgctggttgagcccctgctggagctcttgttttggggcgtctggttctgctggggacaggagcttccagctaacttgattgaaaatctgatgcctttcattgaaacactgggtcagatgatgtattcatgggcttcagctgccataacagacaccttagcctgggtgaattaaataatagaaatctatttttcacagttctgtgaataatgtgctattttaaccactttaaaatgcataatcaagtgaaattaaccacttacacagtgttaaattaccatcaccagtatttttcctagaaaatttttatcattttaaactgaaactttgtatcttttaaacaataactccctgtatgttccaccttagaccttgatcttctctactctgtctctatgaatttgcctattcttgatgcttcatataaatggaattatacaattatgttattttgtttctgacatatttcacttagcataatgtttccaaagtccatgcatgttccagcgggtgtcagagcttccttcctctttatggcagattatcattctgttgtatgtgtcaccatatttgtttattcatgtgttgatgaacacttggattgttttcatattttatcttttgtgaataatgctgcaatgaacattcccatgcaagtacctgtttgagtccctggatttaattctttgggtatatacctaggaatagatgttgtttcaaatgagaattctatgattagcttttttttattattatactttaagttttagggtacatgtgcacaatgtgcaggtttgttacatatgtatgcatgtgccatgctgttgtgctgcacccattaactcgtcatttagcattaggtatatctcctaaagctatccctcccccctccccccaccacacaacagtccccagagtgtgatgttccccttcctgtgtccatgtgttctcattgttcaattcccacttgtgagtgagaatatgcggtgtttggttttttgttcttgcgatagtttatgagaatgatgatttccaatttcatccatgtccctacaaaggacatgaactcatcattttttatggctgcatagtattccatggtgtatatgtgccacattttcttaatccagtctatcattgtttgacattttggttggttccaagtctttgctattgtgaatagtgctgcaatatacatacgtgtgtatgtgtctttatagcagcgtgatttatagtcctttgggtatatacccagtaataggatggctgggtcaaatggtatttctagttccagaatcgccacattgacttccacaatggttgaactagtttacagtcccaccagcagtgtaaaagtcttcctatttctccacatcctctccagcacctgttgtttcctgcctttttaatgattgccattctaagtggtgtgagatggtatctcattgtggttttgatttgcatttctctgatggccagtgatggtgagcattttttcatgtgttttttggctgcataaatgtcttctgttgagaagtttctgttcatgtccttcacccactttttgatggggttgtttgtttttttcttgtaaatttgtttgagttcattgtagattttggatattaaccctttgtcagatgagtagatttcaaagatttctcccattttgtaggttgcctgttcactctgatggtagtttcttttgctgtgcagaagctctttagtttaattagatcccatttgtcaattttggcttttgttgccattgcttttggtgttttagacatgaagtccttgcgcatgcctatgtcctgaatggtaatgcctaggttttcttctagggtttttatggttttaggtctaacgtttaaggctttaatccatcttgaattaattttttagaaggtgtaaggaagggatccagtttcagctttctacatatggctagccagttttcccagcaccatttattaaatagggagtcctttccccattgcttgttttctcaagtttgtcaaagatcagatagttgtagatatgcagcagtatttctgagggctccgttctgttccattgatctatatttctgttttggtacctgtaccatgctgttttggttactgtagccttgtagtatagtttgaagtcaggtagcgtgatgcctgcagctttgttcttttggcttaagattgacttggcgatgtgggctctttcttggttctatatgaactttaaagtagatttttccaattttgtgaagaaagtcattggtagcttgatgggtatggcattgaatctgtaaattaccttgggtagtatggccattttcacaatattgattcttcctacccatgagcatggaatgttcttccatttctttgtatcctcttttatttcattgagcagtggtttgtagttcttgaagaggtccttcacatccctagtaagttggattcctaggtattttattctgtttgaagcaattgtgaatgggagttcactgatgatttggctctctgtttgtctgttgttggtgtataagaatgcttgtggtttttgtagattgattttgtatgctgagactttgctgaagttgcttatcagcttaaggagattttgggctgagacaatttggttttctagatatacaatcatgtcatctgcaaacagggacaatttgacttcctcttttcctaattgaataccctttattttcttctccggcctaattgccatggccagaacttccaacactatgttgaataggagtggtgagagagggcatccctgtcttgtgctagttttcaaagggaatgcttccagtttttgcccattcagtatgatattggctgtgggtttgtcatagatagctcttattattttgagatatgtcccatcaatacctaatttatggagagtttttagcatgaagcattgttgaattttgtcaaaggccttttctgcatctattgagataatcatgtggttcttgtctttggttctgtttatatgctggattacatttattgatttgcatatattgaaccagccttgtatcccagggatgaagcacacttgatcatggtggataagctttttgatgtgctgctggatttggtttgccagtattttattgaggatttttgcatcaatgttgatcaaggatattggtctaaaattctcttttttggttgtgtctctgcccggctttggtatcaggatgatgctggcctcatgaaatgagttagggaggattccctctttttctattgattggaatagttcagaaggaatggtaccagttcctgcttgtacgtgtggtaaaattcggctgtgaatccatctggtcctggactctttttgtttggtaagcgattgattattgccacaatttcagatcctgttattggtctattcagagattcaacttcttcctggttcagtcttcggagggtgtatgtgtcgaggaatttatccatttcttctagattttctagtttatttgcgtagatgtgcttgtagtattctctgatggtagtctttatttctatggaatcgctggtgataacccctttatcatttttttattacatctatttgattcttctctcttttcttctttattagtcttgctaggagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgaagttagggtgtcaattttggatctttcctgctttctcttgtgggcatttcgtgctataaatttccctctacacactgctttgaatgtgtcccagagattccggtatattgtgtctttgttctcgctggtttcaaggaacatctttatttctgccttcatttcattatgtacccagtagtcattcaggagcaggttgttcagtttccatgtagttgagcagtttaaagtgagtttcttaatcctgagttctagtttgattgcactgtggtctgagagatagtttgttataatttctgttcttttacatttgctgaggagagctttacttccaagtatgtggccaattttggaataggtgtggtgtggtgctgaaaaaaatgtatattctgttgatttgaggtagagagttctgtagatgtctattaggtccgcttggtgcggagctgagttcaattcctgggtatcctttttaactttctgcctcattgatctgtctaatgttgacagtggggtgttaaaacctcccattattattgtgtgggagtccaagtctccttgtaggtcactcaggacttgctttatgaatctgggcgctcctgtattcggtgcatatatgtttaggatagttagcccttcctgttgaattgatccctttaccattatgtaatggctgtctttgtctgttttcatctttgttggtttaaagtctgttttatcagagactaggattgcaacccctgccttttttgttttccatttgcttggtagatcttccgctatccttttattttgagcctatgtgtgtctctgcacgtgagatgggtttcctgaatatatcacagtgatgggtcttgactctttatccaatttgccagtccgtgtcttttaattggagcatttagtctatttacatttaaagttaatattgttatgtgtgaatttgatcctgtcattatgatgttagctggttcttttgctggttagttgatgcagtttcttcctagtctcgatggtctttacaatttggcatgatgttgcagtggctggtacaggttattcctttccatgtttagtgcttccttcaggaggtcttttagggcaggcctggtggtgacaaaatctctcagcatttgcttgtctgtaaagtattttatttctccttcacttatgaagcttagttgggctggatatgaaattctgggttgaaaattcttctctttaagaaagttgaatattggcccccactctcttctggcttgtagagtttctgccgagagatccgctgttagtctgatgggcttccctttgtgggtaacccaagctttctctctggctgcccttaagattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcacttcatttcattcatttcatcttccatcactgataccctttcttccagttgatcgcatcggctcctgaggcttctgcattcttcacatagttcttgagccttggttttcagctccatcagctcctttaagcacttctctgtattggttattctagttatatcttcgtctaaatttttttcaaagttttcaacttctttgcctttggtttgaatttcctcctgtagcttggagtagtttgaacgtctgaagccttcttctctcaactcatcaaagtaattctccatccagctttgttccattgctggtgaggaactgcgttcctttggaggaggagaggcactctgctttttagagttccatttttctgttctgttttttccccatctttgaggttttatctagttttggtaattggtgatggtgatgtacagatgggtttttggtgtggatgtgctttctatttgttagttctccttctaagagacaggaccctcagctgcaggtctgttggagtttgctagaggtccactccagaccgtgtttgtctgggtaccagcagctgtgtctgcagaacagcggattttcgtgaaccacaagtgctgctgtttgatcgttcctctggaagttttgtctcagaggagtacccggccgtgtgaggtgtcagtctgcccctagtggggggtgcctcccagttaggctgctcgggagtcaggggtcagggacacacttgaggaggcagtctgaccgttttcagatctccagctgcatgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggttccacccagttcgagattcccggctgctttgtttacctaagcaagcctgggcaatggtgggcgctcctcccccagctgcgctgctgccttgcagtttgatctcagactgctgtgctggcaatcagtgagactccatgggcataaggccctctgagccatgtgcgggatataatctcctggtgtgctatttttccagcccatcggaaaagcgcagtattagagtgggaatgacccaattttccaggtgctgtctgtcacgctgggagctgtagactggagctgttcctattcggccatcttggctccaggaccctataattagctttttgaggaacagcaaaactgtttctcctagtggctgtacctttttatattctcaccagcaatgtatgaggattccaaattctacataatgctgccacttgttattttacaatttaaaagaatggtagccagttttgtaggtgtgatgtggtgtctcattgcagctttgactttgtattttcctaatgactaatgatgttgagtatcttttcatgtccttcttgactatttgtatatcttctttgaagaaatgtctatttgagtcttttgtccatttataaattggatggtttctcactttgttattgagttgtagctagttcttgatattatctggacatgaaaactgcctatatgtggtttgcaaatattttctctcattccttgtctattaattattttcttgatattttcctttgatgcacaaaatgctcacatctttataaagcccaatttatcttttttttgtttcttatgcttttgtgtcatatctaagaatccattgcacatttgaggtcattaatatttacctctatgtctattttaagatgtttttatggttataggtcttatatttaactcactgatcaattttttagagaattgtttgatatggtgggaggtagagttatctaaattcactgttttgcatgtggttatctagttgtttctgcactatcattagaaaggagaattgttcctccattaaattgtcttgacaccctcttcaaagagtaattgaccataagtgtgagggtttatttctaggctctcaattctatcccatttgtctttatgtccattcttttgccagcagcttatgtctattctttggcagcaacttctgttttaataattgtactgctttgtgagatttcaaataagaaaattcaagtcctacaatttattttggcaagattgttttggctattcaggggtccttttttgaaaggtggggaggccaatgtttcacaattgggaaagccatttctgtcttcttcatggggaaatttgggagaatcttttaagaaacttaatctaagtaggtaaactgtcaccactttatttgctgaagtgctgtgttaaagtgtgcattgactcttgtggaagaattgtgactctggaagcacttgcccacatggtgagagacagtgaattccatgatgaggggcagagatgatgttgttttgggatacaatgttgttgggggagttgtatacatctctacttctttatgtctctgtacagtgggtgtagggaccagccacacagggtcggtgggtttttctctccatatgcagagatgagagattgtagaaataaagacacaagacgaagggataaaagaaaagacagctgggcccgggggactactaccaccaagacgcagagaccagtagtggcaccgaatgccaggctgcactgatttttattggatacaagataaagtgtcaggataaggagtgtgagccatctccaatgataggtaaggccacaggggtcacatgtccactggacagggggcccttccctgcctgtcagctgaggcagagagagagaggagaaagagagagagagcttacagcattatttctgcttattagagacttttagtactttcactaatttgctactgctaactaaacagcagagccaggtgaacagtatggaacatgaaggcagactaggagtgtgaccactgaagcacagcatcatagggagacggtcaggcctccagataactgcgggtggacctgactaatgtcaggccctccacaagaggtggaggagtagagtcctctctaaactcccacggggaaagggagactctaagtagctttcccagtctgctaagtagctggtgtttttccttgacactgaggctactgctagaccagggcccgcttggcaatgggcatcttcccagacgctgtcgttaccgctagaccaagaagccctctagttgccctgtctgggcataacagaaggctcgccctcttgtcttctggtcacttctcactatgtctcctcagctcctatctctgtatggcctggcttttcctaggttatgattatagaaatgaggattattttaatactggaataaagagtaattgctaccaagtagtgattaataatattcatatataatcgtatctaagatctatatctggtataactattcttcttttatatcttattatactggaacagctcatgccctcggtctcttgcctcggcacctgggtgacttgctgcccacaagtgggcatctccattggacacagtaggttttgaaatccttgtttatcctctggggtctgggtcttggcttacctgttagctgcagctgaaagaggtgtctgctaaggcaatgccacctgtggtgagaagaagggttcagcagagtgaaagcagctggggctcagagaaaccaggaaagtctgactcttagaaactgtgggtcagcagatgggtgtcctcaggggtaaatggaccatgccagtagccactgcagtggactggaagaaggtaagggatgccagttatcgcatgttctctctcagctctgcagctgaagatttgggccctgggttggtaaggccctgcagcaggggaagggtatacaggaatagctgcatatcaggaccaagtccatgtcatcttcttaggcattgttactgcagatggaggattcttttcagagacctggcctggacacatgggagggcccaccccattcttttgaaattattttaagagaacagtattagcaaatgtggtacatgttttattctgctagaatcagtattactgtcacattttacaatgtatctcttaggaaatggcgagagccatccacagaatgtgcatttaaaggggactctattataatttcagctttcctacctcttcatagaaaccatcttatctgcaaacacacgggcaatatctctgtgttcatttctattgggagtcctgtatgcaaggtggagagagccacatttccccctgagatgttatgtaaaagtttgggttgagatgacatatctgacactctattgttaccctcagaagctactacatgtgaaattctaatgactgcattatcctgccaagtgaaagaggcaggcatgagcaaggacagttaagaggggtgagagcctcatcatgatggggagtcttgttctgacatcttgggaaaaactgtccacagtgtgaagtcatccacttgttgtcctggtttacagtttgagcatctgttgttatggtgtcgaacattttagtgagttctgagtggctcacccttcaggtacaagggttttcccatgaaatttacattgagttgtccacctccagcttatagggcttctggaacagagtgggtctttttcttagcgattccatggaagaaaatggaattggaggaactagtagaattcagggtaatgtccagtctacaggtggataataaaaacacagaaacaatgaacagagatgcaatctcataacaggtgtactacagtttttattttccacataatttttctctctatgggcatctctagttttaccaatgataatttcagtagaataagtttgtttgcaaaataggttgagtttcttcaaacgtggtctgattgtttacataagtgcagcaagagtagcaatggaccgtgtaggctctcttttaaaattttcttttctctaagtttttataaggaatctgagattaaacttttacaaaactcttgagaataggaagccaaaccaaggctgacttcagactttgcctgcagttcatactggttcattctatctatatccttaaatataacatcccagtcaaagccttggtaatataaccaatgatttgaaatgtgtcctgttacaaagagagcagattgttgctgtacttgtgcaaatatgtgtattaccataaacatatcaattctcatgaatagttgcccaattctggggcagtcaggtagaaagcaaaagtaaatatttcaattacagttcaataaactgcggtatagtttattgaactgctataagctacagataggttaaaagagaaaaattccgtcaatgtagaaaacaaaccatttaaagaatcagcaaattttcaaatgaaaatcataaaaacattatcctcattattatcaattatttcattgaaatcaatgtttttcctgcttggtctaggctgggaattttatgaagatatcagcctgtttgttaaagttttcaaagttcttagacaaatttggagggtttaggaggagaatttgggatttgcttgtgcccatgggacgcaggctgggaataaaaatgttttcctgactcttccctgaaggccagatagactccacctaaatccctattgccaaggatactgggatccgcttaccagagacttttactgtcatggatttggagctttccttgccagtggctgagttacgaacagagcaagcatagagcccgctatgctttgtagtaatttgggggataaagagcttttgtcctgatagctgaaacttcccattaattgtccaagaatactgtgccggtgggttagagtccgcagaacaggacaagtagaggacttctcctgaacggtaataggtgaatgaagggtaaattctggggaggtctggaccatctggagcaaagagaataaagccacaggtgatgtcatctgagggaaggggatgttcctggtctcttaaagggacacagtgaccctctgagccaagacacaccctcaagtcccagcccaaccccctctatgttcactgagccgaatcctcaggtattcacctgtttctcccatcacaagctgtgggccccaagtctcccatgacaagagcgtccactccccttatactcttggttaaggctgtgcctacccaggttttcccagggcagggagtcatggccagctcggatgtccagaagtgaaggtgtctatacttggaccagagagagagtgagaggcctggcctctggtcgttttgatttaagctggtgtcctggcccacagaggaacaaaagatactcacagaggacattcagggtgactgggtaactgcggatgccaccatattggtcccttatttcacattgatagggtcctgtttcatttctcgtgacactgggtagaatgaggatcctgttttcaatgggtcgctttaccctgggactgaccgggaggctctgaccatttagccaccaaatgtaggtgtagttctcactcttaggttcacaggtgaagtttaagacatccttattctccctgggttttaagttgttgatggtgatgtagggcttgggcagcttcgctgtgtggataacagagagaagattgtcctgtgtggcacctttgattcctccacaggcatccttcaatcagagttggcatctcccacttctcagcccacccgagtccttgaaagccaatagctggtgcgtgtgtcacaagacagatgcatgatgatctaagggctcaaagactatgaggccagctgctctgtcttagggaagcacagactttctcaagtgtcaattgagcagcagtgttgggtcatggacagacacgtcagtggaagtcacagcccctggtatccctcccagtccctccctaatcagttgactggctggctcaccctgggttccttacctggaatgtgcaactggtgggccccttccaaattccatcctacattgtccccctagatgtgatttctctgcagcttccatttccaaggacattctagagatgagtaatgatgggactacccatggtcctgaaaccctgaagatactgagcagcctggcctgggactggatgtttcagcagaaataacacaggggagaccagaatcaagcctggaggtcagttcagtcatcaggcagtggaggctcaaggtggggcagttttttgcaggtgtttcatgatgacttacttgaaccagtgacctctaaagatagagcagagtgcaaggaatgatctagaaagagtgaaggcgacaggcaagagctggtggctttggagcagaactatgttgcctgtcctgcgttcaagtttcctctccttctgcagagggcaggtgaggaccatgtggatctttccagaaatatatgtggacatttgcaaatgcagcactgactggtagaaagggtgggaaggatctgctggaaatctggtcctcatggaccatgtgtgtttgatggatatgagacaaatttgaagagaagttttgggaatattttctttcactggacattctactctctgattccctggattcgactactctagggacctcatgtaagtggattccagagtgaatatgagaagagactgctggttgccaggagctgggagtggggagaatcagaagttgttcatgggtgtgcagtttcatttatgcaaggtggggaggttctagagatctgctgtagagcttgatgcctatagttcacacaaattgagtatttcttatgcataagacttaggacaaaaagtgttttggatttctgacattttttgattctgaaatatttgtcatatacttactggtttagcatcccaaatctgaaagattcaaaatctaaaatgctccagtgagcatttcttttcagcatcagattagtaggcaaaagtgggaggtgataagccaaagatattcttgccctttttttttctctcaccacttttctagcttggtgattagttttcggtgaattccatactggccatgcctcactcgtatatttttgaaggctttgggatgtgaagcctttgaaggctgattgctattttctatgtcatcagaactttccaccttttcatggttgcctctttttctcagtgtatctgttgtggcagtcattaataagagcctgtcaggtgagatttaggacagtgttttctaattctgcaaaaaatgttactgggattctgttaggtgttacattgaatccgcaactcactttgggaatattatctttctaacaatattgattcctccaatccatgaaaatgaaatgtgtttccatatattgatatcgtctttaacttgtttcagcaatcttttgtagttttcagggtataatcatttgactttttggttaaacttattccaaaatattttattccttttgatgttaatgtgaactgaaattctttccttaatttcctttcggattgttcattgttagtgtatagtctaaagaatgatctagaaagagtgaaggggacaggcaaaagctggtggttttggagcagaaacatattccctgtcctgggtttttgattttccctctccctttgcagagggcaggtggctcttccctgataactagatagacttcactggaaaacatagtgccaatgctccagggatccacttaccagggactatgatcctcttgattatgagatttgttccagcagtggctgagttatggatgaaacagacatagacccctctatatgttttagtgatttgggggataaagaacacttgtgctgattgctggaacttcccatcaatcagccaagaatgctctgccagtgggtgagagtctgtgaggcaggagagcttggggacttcccctgtatggtaataggtgtatgaggaggaaatggtgggggcatccaggccatgtggagcaaagagaataatgtcacaggcgatattttcagagggaagggaaaatctcgtctgtggaagcaccacaatcacagtgaccctgtgagccaagtcacaacattgaagtcccagccaaatcccagctgtgttcactgatctggagcctgagacattcacctgtttctcccatcacaagctgtggacgctgagtctcccatgacaggagcagcctcttttctcctattgttgatcaagcctaggcctactctggtttgcctggggcagaaagtcatggccaggtttgatgtccaggggtaaaggtctctgtacttggacctgagagggactgagaggcctggtctctggccacgtgtatttgggatggcagcctggctcacagaggaacagaaaatactcacggaggagattcagggtgaatgggtcactgcggctggcactcactgggttccgtatttcacattcatagggtcctgcagtgtactttgtgacacccaatagaaagagggtcctgttggtttcagacaactgcaacctgtgagacatagggaggctctgaccattcatccaccacaggtagcttgcgtccggagtctcaggatcacaggttaagctcacagcctccatggcctccctggggtttaatttgctgctggagatggagggcttgggagtctccactgtgcagaaaacagagagaagattgccctgtgtggcacctttgattcctccaaaggcatttttcaatcagagttggcatttcccacctctcagcccacccaagtccttaaaagcccatggcaggtgtgtgtgttgcaagacagatgcagggcaatctgagggctcagaggttgtgaggctgcctgcttcatgtagaaacacagactttctcaagtgtgaattgagcagcagcattgggtcatggaaagacacaggaccagcagtcacagcccctgttgcctctctgagtccctccgtctccaactgcctgcctggcccaccttgtggtcctcacttggagcatgcagtgctggaatcttcttagtttcagtcttactttgccgcccaaggtatgttttctctgcagcttcccttgccaaggacatcctagagatgggtgatggaacttccaattgtctttaaaccctttgggtactggaaagcctggcctgggactgggtacttcagcagaaataacacaggggagaacagagtcaagtccggaggtcagttcagtcatcaggcagtggagccacaaggtggcgcagttttcccaggtgtctcatagtggctgacttgagccagtgacctctaaagatagagcagagtccaaggaatgacctacagagagtgaaggggacaggcaagaactgatagctttggaccaagaccacgttccctgttctggatccatgatgctcccttccccctgtagagggcaggtgaggaccatgtggatctttttggaaatacatgtggatgtttgcaaatgcagaaccgactggtggaaagggcgaacatgaacagatgatggaagtctggccctcatggaccatatgtgtttggtggatattagaccaatatttgggaagaagccttgcagatactttctctcattagacattctactctctgattctgaatttgactactctatgtacctgatatcagtggattccagagtgaatcagagagtagaataggagtttctacgagctgggatcagggcaatagggcgttgttccatggttgtgcagtttcagttatgcaggatgaggaggttctagagatctcctgtacagcctcatgtctatagttcatacagataaagtgctccttatgcagaaggcttaaaacaaagtgttttggatttctaatttttttttgttttggaatatttgcagtacatgtactggtttagcatcccaaatctgaaaaatttaaaatgcacaatgcgccagtgagcacttctttttagcatcacatcagtggtcagaagtgttgagttttggagcatttcagattgtggatttctggatttgggatgctcaatttgtaatactgtaattttcccataaaaagttgtcaggagtttagacctcatgttatgttctgactctagtaacaaaaaatatttggaggaaacattaaaatgttttcatgagtggaaatttttactgatggtccaaacatctaagatcaattgctggtagtagtatttctcttgagaccaacataaggtttaggtgtgccatgaattccagcaggatcacattatgctcaaagaaagatgccaatggtgatttgaaattagcaactccttaagtagagagagtcccgttaaaaggaccgaactgggtagtgtgtcaattacataaagggaggaatgatgccaaattaaaagaagtgatgtgtgttatgttagtaaatatagaaagaactccctgcttctaaattctgtgcagagttaggaaaaatggggaggaccccaaaacaggtatgtgaaatgctttcttcattttctcttaagctcaggaaacaccactagagtttaagtttgtgtgaattaggaagagtctaagtgagatggcaatggctcatgtgtctccccacacgcagaactccaacttatgaaaatggcatcaacatgaggaaacagttgtatgtggcaaaggcagtaaaaccatcagatagcacccacctggccacctccaactggtccccaaaaccaccagtattcccattacatgtatgttacagcctttgtagttgtcccacagctacaaaatttaaaaattgctattgtcaaaacaaaatattaaatatgaagttgaaatgttgttccacttttttaccccactctttttgaactttcctgtttcagttttggaagtttctattgacgtatcctcaagctagggattctttcctcagctgtgtgcagtctaccagtaagcatcaaaagcattcttcatttctctaacagcattttttttttctgagacagagtctcactctgtcaccctggctggagtgcagtggcatgatctcatctcactgcaagctctgcctcctaggttcacgccattctcctgcctcagcctcccaagtagctgggactacaggggcccgccaccatggctggctaattttttgtatttttagtagagacgaggtttcaccatgttagccaggatggtctctatctcctgaccttgtgcccgcctcggcctccgaaagtgctggtattgtaggtgtgagccactgtgcccagccatctctgagggagtttaacgagttgttgacttttgagtttgttcagctttttacttagtgttagaaccgaatgacaaatttcaagcttgttatatgcctgacaggaagccagaagtctctaggaagtgaccagagaatgtgagctccatagcaggttgaggatggagtcatgggcgaaatgagcccatgggctttggggactgcaggcctgtccagcctctgacaccctggtgagtccgtgcaaagattacaacagtgacaggaaactagcatgcctgactccatctggcatctagtctcaggctggctgtcctcactcattgctgggcataggccaggctaaccttgggaggaatttagtttatggtttaaatttgaagcaagaatgataatagttcctccataaaactaacacccttactttgcccagggactgcctttgtaaaactagtgaaagaccatgagattaaggttataggagggaactgaattctgctaaaatgttggcacagtttctataatccctgactgctccgatgtcatttggcaagagtttacaaaagttgtaactaattgctcctatagataacatcactattgtagaacgtgagattggtcttttgagatgtttctcattcttttgcattctggcaaccggctgacctcatccatacctatgactaatggctcagccagtcatgtggtccctacctagagtcagatttaagggcaaacagatcatttccctccgcccacatgattccatcaccaaacaatcagcagtacttattttttagtcctgtgctcctgaaactacccttgaatatctctaacccctgatccactggggaggctgatttgagtaataataaacctctgtcctcctgtttggcagacttggagtcgttaaaatctttcttgactagaaaccaacatttcaataattttttttttttttttttttttttttttttttgtgcaggaggccagaagaacttgcctggcaattatgagtggatggaggaactgcctatccctgtcccattgtcttgtccacaggtcagcctcacaaagggaaagagccctggatgggaatacagtggaagctcattctcttagtgacctggggacattggctcgagatgaagcctggcaggagtggcaactccaggtgatttctgcacctttcctatttcctgggaggtgggccaggccacagtgttagtgggaagggaacagaacagccagcctagtcagagggagtgtctggggaaggcctaggggtgggggaagaagctgtgcaggacagggcttgccagtcagaatgaagtgggaggaagatgagggacacagagaagcagagagaggcagagacaccatggcagtgagcagtgagggagacactgacttcaaaaaccccagggaccaggtgcccccagctccacagtccaggaccaaagagccctgagaaccctccagtggccaaagagcttcagaattacatgagctggggtggctttaggggcaagaggtagtggggggatgaaacatgggtgtcagcctctgaaggacaagggacaggtgtggctagaaactcctaggattctgcatgcaaattcagtctctaaagaggttttggatcattcatttcattccattccttcatttgttatgtgagagctcctgagtgtgtgtctgtctcgctgggcctgtgctggtgtagggtgtgagtggggaaagaaaaggtcctctccttgatcctctcatgacagtgacatggacactttgggaaacacaggatttcaggttcagtgatgggggctaagatctgagggggaggcctggacatgttttttccactgactctgatggttgaggcaggtgatttagttctggagtacagactaatcagttgaccattttctctcactcctctgaggtttggatgcctaagaagagaggttttgagccaataaatgactatggggtgcttggaagccagtgagccctcacttctggtggaggagaggatgagcctgtggctgcggacacacctcatgtgaccctgatctcccctttgtgattgtgtgactctggctcagggactgtgtcttcctgtacctcagttttctgtcaatcagataagctaaatggcaaatggacagtggcttttcatgctatctgtgaataaatgttaaatgattcacagtcacctgacctaatgcttggcacagtggaggtttcacacaaatagcatttattattaatttgcttccatgagaaagcccctttgcgtcagatccctgtgggcaagctgctaccaggtacatcttctctcttgtgtttctgcttctggggacattagactttctatggactggcctaagcctcctaaggcagttgtctgatggcctacaaagcttgtctttctgtcctctccactctgagtgtcaggtgaagaaaactctgtccttgcccagatgaggctctgagggctgagccctggctggtgaacagctccaggagacacagtcctctgacagctggtaaatcctcggtcccagtaagccctgcccaagaagccacaacccagccccagcacaggctcctcagatttatctggagcaaggatttagggacactgttctgggggtgaggcttctagggctgagcttctctgagagtatctcaggggctcctcaggccaagccctactcagttctccagggtctttctcagggtcaaatttatgaagagggcatgaggtgcttgtctgagactgatctcctcctgctgagtccccccatcagactgtccttcctctgcagcgagtgtctgcagggtctggatgcgggaaaggaattctgatctgttgaaatttgtctcctctgtgtgtgtcctgcactaaatgcccaaaccccagcatgggacataatgcagagagggacacaggcaatgtccaggcctgacaatcctgtgtgtgtgaagtagaagtgacccctgtcccccaacacccagggatcatgtggaatcactcacgatataaggtgaaggtgaaatgtccagttactcctctattctcatcacctcccattatgatgtgtaaggtgtaggatcctgcgtcttcctgggtgacattctggatcagcagggatgcattggaatatattgtttctcgtccactgtatgcaggcccatatataattatttgaccgtctactacatatgatgtaatgtaatggtagaggtccctgatttgccctttgtaccagatgtagccagtaagattctggggcaaattgtggacaagtagaagaacatccttcccctcagaaactttggttggctgggcttcaatcgtgacttgggcagtcgtgggtgggttccagaagtttaaaagtgatgctaggaggtggagagagcatcagtcaatattgagagctatgtattggtgtgaaaacatggggccctgggtcctgagaagttctcttcagtcctcagccttgaagacacagacacacacacatacaaacacacgcacacacacacacaaaagcggcatgtgtgtctgtgtgtgtgtatgtgtgtgtgtcctactatcctactaggtcaaggtcagccccatgacccccattccttcaacacttctgaccttggcatttttctgtttgcaatcctcttccccaggggtccgcatggccccctccacactgccctcaggtcctgctcacatcagggcatccttagatttctttcctgacacctccttcagataccctgggtcttccctttctgacctttccctgctctgctccctccagggttcttctcaacacctgaccttacattctagatctctttgcatgtctgtcttcccctccatgacagcgtgagctccatgaggacagggatttttgtgatcttggttgcaccccagtgcccagaacaggctgcagactcctgtagatgtgagagttctcagggccctccacgcccttggtgtttttttttccccccaattgttgaggtttcttgctgaggacagtgtttcatgccctgtgtatatttttatgtgaagtgtcatctgatacagttattattatcatatttcaaaatgtggtggcccctgatgattaatcaggaaaacagaacacaagattttcctacctcttaccaattctggttcctgtgactttcctgttttgacccctgtccctctctggtgtatttccccctatccaggctccaatagagccttctttcctttttctcttttttctctttttttttttttgagatggagtctcatactgtctcccaggctggcgtgcgatggcactatctcagctagctgcaacttctgcctcctgggttcacgtgattcttctgcctcagcctcccgagtagctaggattagaggagcacaccacaatatctggttaaatttttgtatttttagtagagacagggcttcactgtgttggccagactgatcttgaactcctgatctcatgatccacctgcctcagcctcccaaagtgctggcttctttcattttttagtaccccatactctcaaggagaccccatccagtcactctgcttcctcctcctgtcctctcccaggaggttctctcctcacctgtgagcaggagccccttccaggtgatgcgctgtgtgcagggaggggctgagaggagccccatggtctctgctgtctgtgtgttctcctctgtggagatgagcctaggatccagaagcttcctgagcacagctctcagcagtgctgtcctgcctccttctgcgctgagcttcttcccggggcaggagcacctctcaggttcatgggcggggtcaggcccaggacacctctctgtcccctcctctctcagtcctgcctccttgtccctcctgtttttccttttgtctgtgtttcaggtccctgggaattgtggaggcctctgcctttttcagcagtgattctttcaccaaacctcaacacacactttgtgcagacacacacacacacacacacacacacacacacacacacacacacacacacacacacagaaggacacacacagacctacacagtcagaaacataccctgcaggttgggcaagcagagtcctgggcctcagcctcctgctgtccccatggctctgggtcggggtgcacattcatgccctttggcctctttcatccccatctggctctccccttcagtgcaggaggctggagctgcaccaggtccctgtcacagtgacaccccattgtgctgtgggtgagctgtgtgttgcctggtgagagggacccttcctttctctaatcgtgtctagcttggctgcagcttccaaggatggacactcaggacctgggtgtcccagaggaaactgtccttcctggaggtgtgcagggtgaatctctcatgtctcttgggaggagaggcctgtgctggttgctcagtgggggctgtgagtcccatagtcaaagggacagttctcggtcactctgtgactccgtggggtctggccactgagctggagctcagggtttctcatgttcttcctgaccatctttgatgtcctctcttctctgcccagctgattgtcctgtggtcaccacaccttccccgtggtggtgcaggaggaagtggggagtcacccaggaaccccaagggagatggctcgttgagacgcaagagggtgtgcctgggacagagcaggggttcagagctggagagattcatcttgacttactccgtggccatgatgggctcagccctccatgtgccgacatacccaggggtctgtcctgagggttttgacctggccaagctgctgtgtgtagaggaggaacaggcagtggccagagagcctgtctggagggaccttgctcacacctgagggggcgtgtgggggtgagttgtgttctgggagcaaagagcaataacatcccgcttctccctgcaagcgcacaggagaggtctgccttcccaagggacagctggggcaggtggccacatcccggatggtgcctgtgtgtgaccatcacacgcactctgagcaccccgtggtgcagcgggcaggcaggtcatagggtgcctggctgattcccggggaggctgtgggcccttaggcagctgctgttctgtgtcagtgctaggcttggcctgggatgccccagagaacaggatagatggggcaggggcgggcatttagggagcagtgacagaaagagttgatgaggatggagggaggccacgaggggaaagcgcctagtgtggcgtcgcgtgcaccagcgctgccctgggagatgcctttagctgggcccagggaaggagcaggtgtgtggggaggagctccctgcagagggagtggtgttaggttggcggccaccaggtcagggtggagctggcagagtccgtgtggggagcatggagggcgctgaggacttgggccgaagtgaccctggtgagggtggaccctgctgggctgtgggttccgctgagtgaggttggcatcccctgggaaggctccaggctgggagggactctgtccccctctggtggacagggagggaagtgtgaacggcagcaatcccaggccaggctgcatgttttattccacatggatctgcacacttcacacgaggtcacacatatgttatgttacagctccttcaccttccagccccgtgagtcccagtctgtgtggctctatgttcactgttctccctctttcacaatcagatgtcccaaacgcagatttttgtcaccttctgtgagtttgtgtttgtgtgcagtaggcggcactgtgtataccctgggggcagtgatgtctggggctgagcactgcaattgggcttggaagcagaagagggagcagcagggtgggaagatcaatgtcagggggcagggacaagtcattttcattttcttactcccagggaccagaaccctggattctgactccagggcacagtaccacaccctgctggtgtccctggatgtcatgatgctcatagtgtcatgttgtcttggcattcatttttataaggtgtaagtttatttgcctcaaatcagaggcagggcttggtcaccatggcagttttcaatactgtgtctggttcaagtggctccagttggtgtccagagataaaatcttagaggcatctctgctgcttggtgtgctgggtttccctctctccagctgctttctttaaactgataattctgacatttgccctcacatttaaagtgaccacctctcagtcacagcgtgagctcctggtcccagtgtttgctgcttgctttgaacacatccattaaagctccctgctggaaacctgtcagataacaccctggacttaataaagccattggctcaccggtctcttctctcctccctgtctgggctcactgacctctgtgtctgtggtctccaggtttgccgagtgcttcctagtgtctgtaagtagtaaaaatacttacattttcacgttgtggttgtattattgtagcctcacatgccatccagggcctgacattgaggctgccttatgggacctgtgctggttgagcccctgctggagctcttgttttggggcgtctggttctcctggggacaggagcttccagctaacttgattgaaaatctgatgcctttcattgaaacactgggtcagatgatgtattcatgggcttcggctgccataacaaacaccttagcctgggtgaattaaataatagaaatctatttttcacagttctgtgaataatgtgctattgtaaccactttaaaatgctgaatcaaatgaaattaaccacatacacagtgttaaattaccatcaccactatttttcctagaaaatttttatcattttaaactgaaactttgtatcttttaaacaataactccctgtatgttccaccctagaccttgatcttctctactctgtctctatgaatttgcctgttcttgatgtttcatataaatggaattatacaattatgttattttgtttctgacatatttcacttagcataatgtttccaaagtccatgcatgttccagcgggtgtcagagcttcattcctctgtatggcagattaacattctgttgtatgtgtcaccatatttatttatttatgtgttgatgagcacttgaattattttcatttttttcttttttctttttctgtttaatagtgttttttttatcattattattcttatactttaagttttagagtacatgtgcacaatgtgcaggttagttacatatgtatacatgtgccatgctggtgcgctgcacccactaactcatcatctagcattaggtatatctctcaatgctacccctcccccctgcccccaccccacaactgtccccagagtgtgatgttccccttcctgtgtccatgtgttctcattgttcaattcccacttgtgagtgagaatatgcggtgtttggttttttgttcttgcgatagtttactgagaatgatgatttccaatttcatccatgtccctacaaaggacatgaactcatcattttttatggcttcatagtattccatggtgtatgtgccacattttcttaatccattctatcattgttggacatttgggttggttccaagtctttgctattgtgaatagtgctgcagtatacatacgtgtgtatgtgtctttatagcagcgtgatttatagtcctttgggtatatacccagtaatgggatggctgggtcaaatggtatttctagttgcagaatcgccacgttgacttccacaatggttgaactagtttacagtcccaccaacagtgtaaaagtcttcctatttctccacatcctctccagcacctgttgtttcctgactttttaatgattgccattctaagtggcatgagatgatatctcattatggttttgatttgcatttctctgatggccagtgatggtgagcattttttcatgtgttttttggctgcataaatgtcttctgttgagaagtgtctgttcatgtccttcacccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgaggtgttatttctgaggggtctgttctattccattgatctatatctctgttttggtaccagtaccatgctgttttggttactgtagccttgtagtatagtttgaagtcaggtagtgtgatgcctccagctttgttcttttggcttaggattgacttggcgatgcaggctcttttttggttccatatgaactttaaagtagttctttccaattctgtgaagaaagtcattggtagcttgatgggtatggcattgaatctgtaaattaccttgggcagtatggccattttcacgatattgattcttcctacccgtgagcatggaatattcttccatttgtttgtatcctcttttatttcatcgagcagtggtttgcagttctccttgaagaggtccttcacatcccttgtaagatggattcctaggtattttattctgtttgaagcaattgtgaatgggagttcactgatgatttggctctctgtttgtctgttgttggtgtataagaatgcttgtggtttttgtagattgattttgtatcctgagactgctgaagttgcttatcagcttaaggagattttgggctgagacaatggggttttctagatatacaatcccatcgtctgcaaacagggacaatttgacttcctcttttcctaattggataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaatttatggagagtttttagcatgaagcattgttgaattttgtcaaaggccttttctgcatctattgagataatcatgtggttcttgtctttggttctgtttatatgctggattgcatttattgatttgcgtgtattgaaccagccttgcatcccagggatgaagcccacttgatcatggtggataagctttttgatgtgctgctggatttggtttgccagtattttattgaggatttttgcaccaaagttgatcaaggatattggtctgaaattctcttttttggttgtgtctctgcctggctttggtatcaggatgatgctggcctcatgaaatgagttagggaggattccctctttttctattgattggaatagtttcagaaagaatggtaccagttcctgcttgtacgtgtggtaaaattcggctgtgaatccatctggtcctggactctttttgtttggtaagcaattgattattgccacaatttcagatcctgttattggtctattcagagattcaacttcttcctggttcagtcttcggagggtgtatgtgtcgaggaatttatccatttcttctagattttctagtttatttgcatagatgtgcttgtagtattctctgatggtagtctttatttctatggaatcgctggtgataacccctttatcattttttattgcgtctatttgattcttctctcttttcttctttattagtcttgctagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgaagttagggtgtcaattttggatctttcctgctttctcttgtggggatttcgtgctataaatttccctgtacacactgctttgaatgcatcccagagattctggtatggtgtgtttttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttacaatttctcttcttttacatttgctgaggagagctttacttccaagtatgtggtcaattttggaataggtgtggtgtggtgctgaaaaaaatgtatatcctgttgatttggggtagagagttctgtagatgtctattaggtccacttggtgcagagctgagttcaattcctgggtatccttgttgactttctgtcttgttgatctgtctaatgttgacagtggggtgtaaagtctcccattattaatgtgtgggagtctaagtctctttgtaagtcacacaggacttgctttatgaatctgggtgctcctgtatttggtccatatatatttaggatagttaggtcttcttgtgaattgatccctttaccattatgtaatggccttctttgtctcttttgatctttgttggtttaaagtctgtttcctcagagactaggattgcaacccctgcctttttttgttttccatttgcttggtagatcttcctccatccctttattttgaacctatgtgtgtctctgcatgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttcttttgcttgttagttgatgcagtttcttcctagtctcgatggtccttacattttggcatgattttgcagtgtctggtaccagttgttcctttccatgtttagtgcttccttcaggaggtcttttagggcaggcctggtggtgacaaaatctctcagcatttgcttgtctgtgaagtattttatttctccttcacttatgaagcttagtttggctggatatgaaattctgggttgaaaattcttttctttaagaatgttgaatattggcccccactctcttctggcttgtagagtttctgccaagagatcagctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaactttggcctgccttgctagattggggaagttctcctggataatatcctgcagagtgttttccaacttggttccattctccccgtcactttcatgtacaccaatcagatgtagatttggtcttttcacatagtctcatatttcttggaggctttgttcatttctttttattcttttttctctaaacttccattctcgcttcatttcattcatttcatcttccatcactgatactctttcttccagttgatcgcatcggctcctgaggcttctgcattcttcacgtagttctcgagccttggttttcagttccattagctcctttaagcacttctctgtattggttattctaattatacattcttctaaatttttttcaaagttttcaacttctttgcctttggtttgaatgtcctcccatagcttggagtaatttgattgtctgaagccttcttctctcagctcgtcaaagtcgttctccgtccagctttgttccgtttctggtgaggaactgcgttcctttggaggaggagaggcactctgctttttagagtttgcattttttctgctgtgttttttccccatctttgtggttttatctacttttggtctttgatgatggtgatgtacagatgggtttttggtttggatgtcctttctgtttgttagttttccttctaacagacaggaccctcagctgcaggtctgttggagtacccggccgtgtgaagtgtcagtcttcccctgctggggtgtgcctcccaattaggctgctcgggggtcaggggtcagggacccacttgaggaggcagtctggcagttctcagatctccagctgtgtgctgggagaaccactgctctcttcaaagctgtcagacagagacatttaagtctgcagaggttactgctgtctttttgtttgtctgtgccctacccccagaggtggagcctacagaggcaggcaggcctccttgtgctgtggtgggctccacccagttcgagcttcccagctgctttgtttacctaagtaagcctgggcaatggcgggcgcccctcccccagctgtgctggtgccttgcagtttgatctcagactgctgtgctggcaatcagccagactccgtgggcgtaggaccctctgagagaggtgcgggatataatctggtgtgtcgttttttaagcccattggaaaagcgcagtgttcaggtgggagtgacctgattttccacgtgccatctgtcacccctttctttgactaggaaagggaactccctgaccccttgcacttcccgagtgaggcaatgcctcgccctgcttcggtttgcgcacgttgcgcccacccactgacctgcgcccactgtctggcactccctagtgagatgaacccggttcctcagatggaaatgcagaaatcacccgtcttctgcatcactcacgctgggagctgtagactggagctgttcctgttcggccatcttggctcctactccttattttcgtattttatcttttgtgaataatgctgcaatcaacatttccatgtaagtacctgtttgagtccctggattaaattctttgggcctatacccaggaatggatgttgtttcaaatgagaattctgtgattagctttttgaggaacagcaaaactgtttctcctagtggctgtacctttttatattctcaccagcaatgtatgaggattccaaattctacataatgctgctacttgttatttaacattttaaaagaattgtagccagttttgtaggtgtggtgtggtgtcccattgcagctttgactttgtattttcctaatgactaatgatgttgagtatcttttcatgtccttcttgactatttctataccttctttgaagaaatgtctatttgagtcttttgcccatttataaactggatggtttgtccttttgttattgagttgtagctagttcttgatattatttggacatgaaaactgcgtatatgtggtttgcaaatattttctctcattctatgtctattaattattgtcttaataatttcctttgatgcacaaaatgctcacatcttgataaagccctatttatcttgtttttcttgtttctcatgcttttgtatcatatctaagaatccattgcacatttgaggtcatcaatatttacctctatgtctattttgagatgtttttattgttataggtcttatatttaactcactgatgaattttttagagaatggtttgatatggtgggaggtagagttatctaaattcactgttttgcatgtggttatctagttgtttctgcactatcattggaaaggagaattgttcctccattaaattgtcttgacaccctcttcaaagagtaattcaccataagtgtgagggtttatttctagactctcaattctatcccatttgtctttatgtctattcttttgccagcagcttacgtctattctttggcagcagcttctgttttaataagtgtactcctttgtgagatttcaaataagaaagttcaagtcctacaatttattttggcaagattgttttggctattcaggggtccttttgtgaaaggtggggaggccaatgtttcacaattgggaaagccttttctgtcttcttcatggggaagtttgggagaatcttttaagaaacttaatctaagcaggtaaactgtcaccattttatttgctgaagtgctatgttaaagtgtgcattgcctcttgtggaagaattgtgagaccctggaagctcttgctcacatggtgagagatagtgaattccatgatgaggggcagagaggacagtgttttgggatacaatgttgttgggggagttgtatacatctcaacttctttatgtctctgtacagtgggtgtagggaccagccacacagggtcggtgggtttttctccccgtgtgcagagatgagagattgtagaaataaagacacaagacaaagagacaaaagaaaagacaaatgggcctgggggaccactaccaccaagatgcggagaccggtagtggccccgaatgctaggctgcactgatatttattggatacaagacaaagtgtcaggataaggagtgtgagccatctccaatgataggtaaggccacatgtgtcacatgtccactggacaggggacccttccctgcctggcaggcaaggcagagagagagaggagaaagagagagagcttacagcattatttctgcttattagagacttttagtactttcactaatttgctattgctaagtaaagggcagagcctggtgtactggatggaacatgaagggggagtaggagcgtgtccactgaagcacaacatcacagggaggcagtcaggcctttggataactgtgggtggacctgactaatgtcaggccctccacaagaagtggaggagtagagtcttctctaaactcccccggggaaagggcgactccctttcctggtctgctaagtagtgggtgtttttccttgacaccgaggctaccactagaccacggtccgcttggcaatgggcatcttcccagacgctggcattaccgctagacgaaggagccctctagtggccctgtctgggcataacagaaggcttgcactcttgtcttctggtcacttctgactatgtctccccagctcctatctctgtatcgtctggcttttcctagggtatgattatagaccaaggatttttataatattggaataaagagtaattgctaccaactaatgattaatgatattcacatataatcatatctaagatctatatctggtataactattcttcttttatattttattatactggaatggctcgtgccctcagtcttttgcctcagcacctgggtggcttgccgcccacaagtgggcatctccattggacacagtaggttttgaaatccttgtttatcctctggggtctaggtcttggcttgcctgttagctgcagctgaaagaggtgtctgctaaggcaatgacacctgtggggagaagaaaggttcagcagagtgaaagtagctgaggctcagagaggccaggaaagtctgactcttagaaaccgtgggtcagcagatgggtgtcctcacgggtacatgggcgatgccggtagccactgcagtggactggaagaaggtaagtgatgctgggtatcccatgttctctctcagctctgcagctgaagatttgggccttgggctggtacggccctgcagcaggggaagggtacacaggaatggctgcatatcgggacgaagtccatgtcatcttcttaggcattgttactgcagatggaggattctgttcagagacctggcctggacacatgggagggcccaccccattcttttaaaattattttaagagaacagtattagcaaatgtggtacatgtcttattctgctagaatcagtcttattgtcacgttttacaaagtatcttttaggaaatggtgagagccatccacactatgtggatttaaaggggactctagtataatttcagctttcctactctttatagaaaccatcttctctgcaaacacacaggcaatatctctgtgttcatttctattgggagccctgtatgcaaggtggagagtgccacatttccctctgagatgttatgtaaaagtttgaggtggagatgacatatctgacactctgttgttacactcagaagctactacatgtgaaattctaatgactgcattatcctgccaaataaaaggcaggcatgagcaaggacagtaaagaggggtgagagcctcatcatgatggggagtcttgttctgacatcttgggaaaaactgtccacagtgtgaagtcatcaacttcttgtcctggtttacaatttgagtggctgttgttatggtgtcaaacattttagtgagttctgagtggctcacgcttcaggtacaagggttttcccatgaaatttacattgagttgtccacctccagcttatagggcttctggaacagaatgggtcttgctcttagtgattccatgggagaaaatggaattggaggaactagtagaattcagggtaatgttcagtttacaggtggataataaaaacacagaaacaatgaacagagctgcaatctcataaccggtgtactacagtttttattttccacgtaatttttgtctctacgggcatctctagttttaccaatgataatttcagtagaataagtttgtttgcaaaataggttgagtttcttcaaacgtggtctgattctttacataagtgcagcaagagtagcaatggaccatgtagggtctcttttaaaattttctttcctctaagtttttataaggaatctgagattaaacttttacaaacctcttgagaataggaagccaaaccaaggctgacttcagactttgcctgcagttcatattggttcattctatgtatattcttaaatataacatcccagtcaaagccttggtaatataaccaatgatttgaaatgtgtcctgttacaaagagagcagattgttactgtacttgtgcaaatatgtgtattaccataaacatatcaattctcatgaatagttgcccaattctggggcagtcaggtagagagcaaaagtaaatatttcaataattgttcccagaagtatagtttattgaactgctataagctatagatagattaaaagaaaaaaattccataaatgtagaatacaaaccatttaaagaatcagcaaattttcaaataaaaatcataaaaacattatcctcattattatcaatatttcaatgaagtcaatgtttttcctgcttggtaggctgagagttttatgaagatatcagcctgttagttaaagtttttggaagttcttagacagtcctgtgggataatgtgaaagttatcggaaacttgtattaaagagtacttgtcagcatcttttctacaaatctccttgaaaaggaagcaattttggactgtagctgattggaaatgctttgaagaagaataaaaacaatgtctgttagtgggaaagattttaaatgactatggttaaaactctgatgagaattcattgataacacagctcacataaaaagttagttacttctgtagtatatgacattgtggctgataacatacttaatttctaggaatctcatacaatttctggaacaatcatatcagtaacatatccataaatataacatagagaaggtttagcatcctttaccatttatgatttgaaaatgcttttcatataattttacatatcaaataaagtggcttttccatgtagcttgtgtttctcaacaggattactgagttcttggtggaggctgttaatgaattgggccaagaaagtataggcttatgtatgctgaaaaatttccctagataattccaatactcccagctaataatcatgaatttaggtctaaattttacctattagaacagctgttatttatcctggttacacattagtagcatctgggaagacttaaaaattaccaatgcctgagtctcactttagaccattaaattggatcctatgggtggggcttgggcatccatttaaaaaaatgttttctggtgattccaatgtgtagctgtatttcccctcagatttctctgatttcttttggcattcacttttttctattttggtattataattattttttgggtcttatcatctatcttaggctttatgttccttggggtagaaaccttgccttcttcatttttgtatctttcacgaacatatgagttggtcatcaggaaaatgttctcaatcacaagtaggttgtgttctgagtctcaggtttacacattaatgcttgagtcattgttctctgggaggtgagaggttgcttgtgatgaagggtatgggtaagcccatactgcagatggtagatgggagatcaccctgttttcagccatagcattggaactaagcattctatgtgtatatcaggtggaggggaagggatgtgtagaaagacagatttaattagaatggaggaattatactagggaatagaagtatttaaagcaacaaaaattagtaaagagaagaaatgtgaacttatcaaataggcaagagtagatccctgaagatttttgaataggtgagttaactagaatttaggaagctaataagacagtcatacacaaggaagatttcaaagactggagataagtcaagcagtacctctagcagttgttgaggttgtgggaatggagagaatgacaaaagtgagaaatgttataaaaaaggatcaagagggttttataaggtattgaatctgggaaacaaatgagcagagactgaggataatcacttgtaggagacagtggggtacagggagcatgaagaacaggggagaagagacctgcaggaataaatgctgagaagcaggagtttagtgggaggaggaggagatccagtcccaaataccggcaaagaagtcctttccctctcccaagcaaggcagtcagccctgcaggaaacaggacaaaaggaaaagccatcatacctgccagtcttcctgaaataaactacaacagggctgctagatcagcgccacactggccagtacttcaatcatgatgctgccagtggctctacctgaaaggccaggagaacttcctttcactgaagtatctgtcatggaaagaaaagaagagaaggaataaaggtgatgttattttacagcgtggtaccttaggaaccatcactaagtatttagtagtttctactttttccttcggggattacattaattttgtgggacggttgctggtagatgattagccaactatattcttgcagtttttttctctctcaacgtgtttctaggttagtgatcagtcttctgtcaatttcatcctgaccatgctgcactcagatattttcgaaagctttatgatgtgagaaaggctgactgctattttctgtcactagaactttgtaccctttcatggttgcatctttttctcagtgtgtcagttgtggtaggcatgaataagactctgtcaggtctccatggcagcttgtgtttctcaagaggattactgagtccttggtggagcccattaatgaatagggccgagaaagtataggcttatgtatgttgaaaaatttccctaggtaattctagcactctcagctaataattgattaattaataatcaactgacttgattgacagaaggcccagatcagtgcattccaaactgacaacctactttgcatagagtcctcactttcctgaagctctcagcagggatatgaaagcaagcccagttctatgagactctgttttattctcctgggtgacttgtgggaagaccccctatcagtcttcccatgctctctttgaactgtagctaaatctttgtctttctccttcacaggaatgagatttgcatagtggtcccaaagttccccagacttttttcatgcctgccccactttccctcccaggcatttttcctaatacattatcctgcatgtctaatctcatctcggatgcatctcagtgggcataaactaacataccaggcttgatttttttgcacttagcttttttctgtctctcccacatgtagccagtaaccatgtcctagtgtttcatgtgttacccttttttcatgtgtataggaaaaaaatatatatttccatatacttatttatatgtaatatatataataaaatgtgtaatataaaatgtataataatgtaaaacatatacatattttccatatatgtatatggaaaaagaggtaacacataaaacaccaggacatttacatataataaaattgacatatgttatatatgtatgtagtgtctggtagtcttaccctctttataaatacacactttttgtcactgccccttccttccttcccatgcagagctcctatggccaaatctccctacttctccaagtttgtgtcactcactgtcctctgtgttgtgtcccatgtgctgtgtccacagcctcctagtgttttatgtgttctctttttctatatatatgtggaaaaagcatatacatatttctctgtatatatttatatacaatatataattatctaaaaatatagaatatataacaatttaaaatatatgcatatttccatatctatgaaaaaaggtaacacataaacactaggccatttatatataaaattcacatatgtaatataaatgccaattttatcatatataaataagtatatccatatagacttatcatatataaggtgaatttggaatgccctgacctgggccctctgtcagtcaagtccctgccatggaggccattcatggctgccacaactgagacactgggagaaagatgcaactatgaaaaggtgaaaagttctaaagtcatagaaaatagcaatcagcctttctcacatcccaaaaccttcaaaaatatctgagtgcagcatgtccaagatggaattaaaaacttcaatcttgaaaaggaaaaaggaagctggaggattcacactttcagatttcagcatctactgcaaagctacagtaatcaatacagtgtggtactggcataaaggaggacatagaaatgaatgacatagaatagagaacccagaaagaaagcttgcatatatggccaaatgatttgtgtcaagagtgtcaagcccattccttggggaaaggacagtctttttaacaagtgatactgggaaagctggctatccatggacaagtatgagttgaacctttacctcacaccatatacaaaaaaatgaacccacaatggatcaaagacctaaatggaagagtgaagactaccagactcttagaagaaaacataaggaaaaagcttcatgatattgaatttcagaatgatttatttgttataactacaaaagcataggcaacaaaaaagggataaattggacttcatgaaaattaaaaacttttatatatcaaaggccattatcaagaatgtaaaaaggcaagctatgacatagggaaaatatctgcaaatcatatatctaataagggattaatttccagaatacatgaagaacactacaaatcaaaaacagcaaaaacagaaaagcccaattaaaaaatggacaaaagactgaaagagggattttattaaagaagatatacaaatggccaatgaggacatgcaaggattctcaatataactaatatttagagatttgcaaagcaaaaccacggtgatacatgacctcgcacacattaggatggctttgataaaaacaacatgaacaacaacatcacaaaacaagtgttttcaagtacgtggaaaaattgaagctctttgtgtgttgccgatgggaatgggaagtgttatagccactgtggaaaaaatggcatggcacggccggctcatgcctgtaatcccagcactttaggagccgagatgggtggatctcttgaggtcaggagtttgagaacagcccggcaagtgtggtgaaaccccatctctactaaaaatacaaaaattagctgggtatggtggcatgcgcctgtaatcccagctactcaggacgctgaggcatgagaatcacttgaaccttggaggtggaggttgcagtgagccaagattgcaccattgcactccagtctgggtgacagagcaagaccctgtctcaacatcaacaacagaaaagaaaatggtatgtcagtttcttaaaaaaaattaaagcattaccacttgaaccagcaattctacttctggacatacagccaaaagtattgaaaaatatttgaacagatatttgtacactgatgtttacagcagcatcactcacaatagccaatgggtggaaacaactgaaaagtctattgaaagataagtggatgaacaaaaaggtatatccatactttggaatgttcttcaatcttagcaagggataaaattttgacacatggtgcaaaatggatgaaccttgaagacattatgcgaagtgaaataagccagacacaaaaggataattattatatacttccatttatgtaagatagttagaatagtcagttacttagagacagaaattagaatggtgattaccaggggttaaggggagaaggaatgagagttatcatttattgggttcagaggtttagtatagtaggataaaaaaagctctggaaatagatagtgttgatagtaacacaacactaaattgcacgcttagaaacagttaatagtaagtcttagatgtatagtgtctggtactcttaccctctctgtaaatgcacactttttgtcgctgttcctcccctgccatagagagcttctgtgagttaatctccctatttctccaagtgtccatcactcactgtcctctgtgttgtgttccaggagctctgtccacagactcagacaggcagtgacttcagagccaggacacagccctattcccattttttaaagccttacccatgggaggcttggcttctactggcagctcgatttagccagattcagaaccggccacccaggcaccttatccacatgccctggccccagcccaggtggagtcagggcagggtcagtcactgggcgagcccacagcaatgcagggagcagagtctgagctgcttctccctcaccaaggggcttcctcctctcattggagaaaagtgtgggcttgttttgaagcctctgatgttcatcgcagctcatggagtacacacacacacagacacacacacaaaggagacagaagggatgttttggtgacagaaacagcttgaccatgaggaccctcctctttctccctctgtgaaggcccttacactgcatagtgcttggggctgataaagccatttccctacatttctcaggctggacccaaggtcatccaccagaaatctggcaaacaaagggaagagaatctgtagatatgaattgggagtgttcaggagaaaaatttgggatttacttttgtgcatgggacacaggctgagaataaaaatgttttcctggctctttcttggaaagccagataggcttcacctgaaagcatattgccaatgctccagcgatccacttaccagggactctgattttcttggttgcgaagtttttgccattagtgactgggttatggacataacacagatagtccccactattctcagtagtgacttgggggataaagagctcttgtcctatttgctggttattcccattcagcagccaagaatactctgctgatgggttagagcccatgaggcaggagaggttgaggtttgaccctggatagtaataggtgtctgaagaataagttgtgggttcatctgggccatctggagcaaagagaataatgccacaggtaatgttatcagagggaatgggaagctcctggtctgtgaaaggggcacagtgttcctttttgccaagtcacaaccccgaagtcccagccaaacttcctctgtgttcactgaactggagtagtctaagaaattcacgtgttctcccatcacaagctgtggaaccagagtctcctaagaccagagaagcccctcccctcctgggcctacccaggtttttctggggcaggaagtcatggccagcttgggggtccaggggtaagtgtcttcatacttgaacctgagagggactgagaggcctggcctcatgttatgtggatttgggccggcagccttgtccatgaaggaaaagaggatactcacagagaacatccaggtgactgggtcaatttggctggtactcactacattcttcctttgacattcatagagtcctgtgtcactccttgtgatactgagtagagcaaggatcctgttgtcattggacatctttagcctgggactgagtgtgagtctatgaccatttacccaccacatgtagattgtgccatgaatgtcaggttcacaggttaagaccacagcctcctcatcctctgtggggttgctggtgacatagggcttgggaacattcgctgtgcagataacagagaagattcccctgtgtggcaccactgatttctccatgagcattttccaatcagagttgacatctcccacctctcagcaaatctaagtccttaaaagcccacagcaggtctgtgtgtcaaaagacagatggatgcatgatgatctgagggctcagaggccatggggccacctgctctgtgtgggagatgcacagacttctgaagtgtggattgagcagcaatattggtgaagtgtgaattgagcagggtcaaacaattagagtttgattaactttgtttaaattgagcagagcccaagtgaggcagcagtggctcatgcatctccccaaccgaagcaccccaccttatgacaatgtggttattatgaatacacaggtgtgaatgaaacaggcagtaaatcagacagcacccacctggccagctccacctggtcctaggaaccaccattattcccattatgtgtatgttacagctttttaggctacaaaatataaaatacaatcacagaatataaaatatgctattgtcaatacaaaatattgaatatgaagctgaatatgttgttccactttttctcactcttgttaagctttgctgattcagttttggaagtttctattgacacacacttaagctagagattctttcctcagctgtgtgcagcctaccagtaagcccatggagggcattctttatttctcttaaagtatttttaatctctagcatttcttttgcttctttcttagaatagccatctctgtttaaatcacccatctattcctgaaaggtgtctcctttttccatcataatccttaaccagagttgttttaaatttccagtctgataatttcaacatccctaccacatctgtgtctggttccaatccttgctctgtctttcaaactgcattttttttttttttttgccatagtctgtcttgtatttttttgaaaaccacacatgatgtactgggtaaaagggacttgagtgggtgggcattcagtgacacggtggtgagtgttgggagggaagggttctgtggttctggatgagatctgtgtcctgggctgtgaatgtcacaagtgcctctcaggtttttctttccattaggtgggatatgatgacttgaggaggctggagttggatacttcccctccccctggccagttaagctcccatcaaaccccagctaattaggctgcagtaaaatagtttctcttaaatttaggtcttaccaagaagaatataattcactgacaactttccaagtgtttttttcccttcttcctagaagaaggatgtggattctttttggatattgactgtgagaaactggtagagctccaggagctaagagtcataaatctgtccccctactcccaagactaatccatccactggtgtgtttatctctgcactgtgtccacactgagcctccagaatttcctcaattagagttcaggttttctgaccccagcacttgttcccgctgaggtttctgtgcctgtgtttctgctcaggtacggtgcgctgctctgtatttgcctgtgggtctctccaatatgtgggccagttagcactgagaccttgcttccagagaaatctaaatgagttgttgatttttcagtttgttcagctttttacttgttgttagaactgagtgaaaatttttaagctacttacatgcctgacggaaattcgaagtgtctagggcatgactggaggatatgagccccacagcaggttgaggatggagtcatgagtgaaatgggtgaaatgagcccatgggctttggaaactgcagatctgtccttctgcctctgaccccctggtgagtccatgaagaaagtgaaaccacctttgcgaagcataagatggtgagaggaagctagcttggctgaccgcatctcacctctagtctcaaactggccctcttctctgattcctggacataggccagggtaagcatgggaggaatttatagtttaactttgaagcaaggatgataatagtccctccctaaaattagctcctccttgtcgggggctaccttggtaaatctaagaaaagaccacgaattatgggaggggcccaaattctgctaaaatgcaggcatagtttctataatcccttacttctcaggagtcatgtatccagaggtcacaagatttgtgactttcctagttgctcctatagatagcaagactactgtagaatctgagatttatcttttgagatgtttcagacttttgcattctggcaaccagctgacctcatctagactcatgaccaatggctaaaccagtcatgtggcccccactcagaggcagattcaacaaatacataccattttgcctacgtgcatcatttcatctccagccggtcaacagtacttattccttagacctttgccccttcaaagtttttgaaaaactctaacctcagagccattggggaaggtgatttgagtcataataaatttctgtcctcctttttggcagccttgggctaagcaaaaccattctttactacacatcaccttcacaataaattggctttgcctgtgcagagggcaagaacctgtcaggtgattgtaagaatggatggaggagtcactgatctctttcaggtggcctgtttcatgagtcagcctctcagagggaaagagccctggactgggacacagtggaagctcattctcctggtgacccggggacattgcctcattatggatcctggcaggggtggctactctggctgattttggtgcatttttcatttcccagaaggcaggacaggcctcagtgtgagcaggaaggaaatggaaccgtcaatcttgttagagagggtgtctgggtaagtcctcagggtggaggaagctgtgcaggacagggctcatcaggtagaatgaaagggggatgcacttttttcactgaacacctttcagatgtctcaccaactctggcctcactgggctctgcctttccttctgagcccagagccccgagccctgattcctgggagggaggaagagagagaggaagggtgaagctgggatgtgtgctgtccaggtttcttccatctctggaatcttgaaagcgagggaccctagtgtgttaccacagaggagaccatgggaaaaagctgtttctcaggggtgcctggcttatgaattgaggggaattcagaccaggttggactcgtgaactgcagggactctgttccatgtcagcaaccagctcctctagctcagtgtttctctctgtggctaattcttttgtgtgatttctgagcccatgctagagtcctcctcacgatgcctgatggtcagacctgtgtggggagacctaatgatggggtgggggtggtcttgagtgtcacacagagtgtccagggaacaggctttgtgactttctctaccccagccccacaacaagatctggatagtgggcttggtcagataaagtcagaatccatggagggagggtatgtgtcctggcagtactgaggttcctgcctccaggttagttctcagtctctgcaaatacatttatgttgtgcatgtgctgtttcctggactgtttcatgtccctaacttcttgaacctgtctgcagataatgtcatgagaggtctgcatggaagtatatgagggctctctgattaggatgggtgtgttttacatagtgggtttttttttttcaccaaattgtggttgagtgtgtatatagaaacacatacatacttatattcattagatttgactatttatataaatttaatatacagatacatttctataaatatacacatatatgtatatgtgtatatatgtatatgtatatatgtatatgtatatatatgtatatgggtatatatatgtgtgtgtgtgtgtgtgtgtgtatatataaaatgtgccattttaaccacttaaggggagagagagagagaagagagtttctgctaataccaaatctgggttaaataagggtggtcctatttcctggggttgggcttttgctagatgtgtcagttcctgttggaagtgaggtagagaggttacatgcttaaccaatgtagagattttctatatgaaaataatctgtgagcacactgataagttttatccttttctaggtgaaaagcttggtgaaagattttaaggacttcccattggctgaaggctggcaaatggagtttgctatcctctgactgcagccattctgaggactggaaagaataccctgagaaggggcctattttatttctgcaggaaggtactgaggtttaatttatcttatggagtcttcctagattagaaggctttgaggtgtgttgatgccttgccagtgacttagctgcctgatcagtgaacctatttcctttggctacatcatctgttccccttttgatgttccctataatgtatcactgctatttctcatggaagaaaactgaggataataacctgttaattttttggtgatattttacaggaaatccattagtggtaagaaaatgccttttattttaaatggcagcatgagcatgaagaactcaaaaagcatacttggaatcagtgtaaatgttagctacctttcccttgcttaatttaagtgctcttgtaagaaccatttgtttagctgattgagcacctgcacctgaagggagatgttatttagagtgactactgcttatcctgccatatatatttcttgctttaccagctgtttgttagctaagagctccctctagaggaaagtaattttgccacattaagtggggatgtaaaccgttctttcctagggttaatttggaggcttttctgactagtagagctattgtgacagtggtttggaagcagatgtaaacaataggtcctcctaatggcaaataagaggttgagaaaaatattggattagaatttttcctgagacaccccttatggttgtgctatgggaagaggggaggcctggataagaaaggagaaaagagagagactagatctagtgtttagaaggaggtctactttcctccctataatttccagaatgacctgtgtctcctgtgctgtaatggcagtttgagctgctggagccaggggtttgagccccaggacccatcagtcttgctggaccactgtgagactggtactgaacccagtgacctccaactctgggagcagttgcatctccagtggtctccaccacaggctggtcattgtcaaggtggcttcctcttgctgtttggacactccttcctaaaaatgccctggcttgccacaccgagagcaactagtggatacacctctgggatcctggactttgcaactctgcaaagtagctattagaggctttgtccttctcttgagctttctctctttcttctgggccttctcctggtccctattataaaagactgaagtggctaccctcagaaggttttccaaggtgctatgtgctactatagcttgccttttgtaggttccttctaatattgggagcattctgtataataaacttatctttttgaatgggctgtcacttgagtgaatcaggagataaaaaggtgtgtgctaatagtgcccctcttaacctatccataaaggctgcaggattctcctctggctttgagtctatcatagacagtttagaggaattaagaggtctggccttagtttttcttttccattcatctgctgagctattggggcttcaatcagggttgccaagaggtactgcttcacttcttatttggaatggtgtttctgctatttcttcactttctgtatctccttccttcccttttggtgtattataggagatatgttgctcatcttcaaaattctctggtgcttgtagagctggctgtttttcagttacagttagggtttggtttaggagcagcataacatccttccatgtgaggtgaaacacctgacttaaattctggaaagcttctatatacctatcaggattgtctgaaaatcagcctaagtcttactttatttgcctaaggtcctgtaatgagaagggaacttggagggaccccaaattatggggattcttctcagatggttccctgggaagttgcttttctaattctaggggattattctttataggccttcctgatatggctgttaaaaaaatctgggttgctgttacaatgcttctaaagttttagtaaaaatgccctgtcattgtgcaaaatagaatgagttgcttttctcttcaaagtcctgaggttaaaagagttctagtgcctcagagtgcactccagaggggtgcaaactgaagatgctctgttagccatcgagaaaaagaagtgagaataaaagtgtccttatagtcccccttctttcattgttacccagagtcatgtggaagacagtgggagcatccccccaactgttttctctccttggttcctgagtcctggcactgtgttaaatttgccacccatggttgtaggtgtggccctctaagccatggaactggataaatgaagtgatgacattagccacactttacccatgcagccttagcttatctgcctgtgatctgcctggcctcctgaaaaatggatctctggtgaaattgtaatagttgcctttgagcaagctttctttaagagagggaatgtgccagttgccagttatggcccatgctaaaacacttaccctcagaaaagtggtcctggttgactctgttcttaaaatgtccttactaattaaatactgttctaattggagatagaataagtaccttaaatgaacgtagggacctaatggcagtttttcctgctgatgggacagtatcggaactaaaatttggctatggaagacattttactcctaactgttgaaagcagagctttcccattcacagaaagggcttttctatcagtgcaaaaagagagaattggaaaagtgcagtgttatggcaaaggaccaacaatgtgcctcataaggaggatttatgtttccactaggtgacactgttggcttagaaataccaagtgcttaccaaaggaaggagagagagagagaaagagagagggagggacctattgggttagttattataccatgtaccgatctttcctaacagaactgtttccctgaaccgtaaaaatttccacatattgcaaacacaaaaagaacaggagacatagagaccatggatagaaaggaagaacaaatttgcaacaggatagcaaattaggagacccattaccaacatctggatgagctgccggaagctgtgttcagtccagaagcctttgaataacatcagggtgtttcctggccagaaattctcagctgctccatgacatcccccagcgtcatgtgatggtgaggttctccatgaaaggaaactagtttgaagagaaccttgaaattaaaggacagatttgaggtttgctccatactcaccattctgatgtttctatcttctgttctgatcacaatcccagatgagaactcccaaataaaatggctctgtttgggaatctattcatggttctttgtcacacactgagaaagaattcgggacatggaaacacgtgaggagtgggtttaggagtgaaaaatttaacagacaataaagaagagagagagaaaaagctttctcatactgagaaagcagtcacccgagagagggtctccaatttgtggtggaatgcaattgattttgtacagagacttgaggaggcagtgattgatttacatagggtccagggtattgttttgaccaggtgtgctgtttacgtagcccgagaaaagactggccctcccaccttaatcttttattatgccattgtggcttctacctggtggtcatcatgacacctgcacatatggtgacaaggaaaaaagtgcaggaactgccatattgggagtacctggctcttagttgcctgcatctgtatatgcttatctatgcttgcagcctgatcattcagtctgttttctgttagaaatggtttgggggctgcgttttattaaaggaaaattccaccaagaattcttttaccctttctagctgcctaaaaataatttctcaataactcctgtattaggacccctttaggaaaacagaaaagaagacacagactctcctgtaggaaagtaaccatagtttttttgtcatggagccccaagagttgcaagtgaacggatttctctcaggtctaaaactctgctcttttctccattgtgttacctgacctctttgccttttacattactttgaactgtaaaaatatttgaccttgtgtgtgtaatggttgctgggtcagtggtaagagctatggttttgaaagtgactaacagtgattataataaattattctggcttcagagggctactcatttccttgcatgtttagatgcaaaagacacagtttaaacaattagggaaatgcctttgtagcaaagtactctgtggaagtgttgcacagtatggtccccactgcattgtcctcttcttggggacctgggattcagtgaaatccttgatttttaatgtctaaatgttgtcccttccaactggtgcccttttttacatatttaaatgattagaatctaaaaattgcaaagactttgttggccctcttccttaatgggctctaccttgagcacagtgattcagttgaagaaaagagaccaaattaaaagctacatctctaaataaacaacaggtgctggagaggatatggagaaataggaacacttttacagtgttggtgggagtgtaaactaattcaaccattgtggaagtcagtgtggcgattcctcagggatctagaagtagaaataccatttgacccagccatcccattactgggtatatacccaaaggattataaatcatgctgctataaagacacatgcacacatatgtttattgcggcactattcacaatagcaaagacttggagccaactcaaatgtccaacaatggtagactggattaagaaaatgtggcacatatacaccatggaacactatgcagccataaaaatgatgacttcctgtcctttgtagggacatggatgaagctggaaaccatcattctcagcaaaccatcgcaaggacaaaaaatcaaacaccgcatgttctcactcataggtgggaattgaacagtgagaccacatggacacaggaaggggaacatcacacaccagggcctgttgtggggtgggaagagaggggagggatagcattaggagatatacctaatgttaaatgacgagttaatgggtgcagcacaccaacatggcacatgtatacatatgtaactaacctgcccgttgtgcacatgtaccctaaaacttaaagtatactaaaaaataaataaataaaaccccgtggtaaatttctattatttttgtgttaccttggcatctctttttaatcttccttgaacacaccaaattttttcttgaaaaagcttaagttctctctctctctctctttgctttgagatgtaaatgtgctatttattttctctaaaactcggtaaagccttcctcagataaacgttaacctttaccatttacaagaaagcaatttgaatccaactatcctttaaactggtgggttttactgatctcatgcctaaagtcctaaaatcaaaattctaaaatccttttgtctctctctatctttatgtgaacatgtatatgttatatgttttatcacatatatgtatatgtcacacatttatatactgttgacacatagtttcaaattaatgtaaaaataaatgagtactcacaaattaagtgaataagccaaaatgcttttctatacatgtgattttaataacctttggtgaatatagatagttttaaaattgttggaaaataaagtataaacgtcttcataatttaatttatacgtttttgcctaggtctgttggcaggcaggtttatattgtctttactagatgttttaaggtcatcaaacagttgcttccatatatatacattttcttaatttgtctgtgagcttatgtctttatatttgaagctttaaattctgagttctagatgagtgaccatagtaagaactggggacaaaacccatcccagcctctggctgtgccttttggccatgctgggagaggtgagattatccaggcattttcttcatagctctgttctttgtcttgggctttgcatctggtacatagttagaatgatttactccctagtttttttctactgaaaataaggctgtataagtctgtttttacattgctacagacaaataaatgaacctgaataatttataaagaaaaaagtttgaatggtctcatgattcagcaggttgtagagtaagcatgattctggcatctgctcagcttttgaggaggcctcagaaaacttacaatcacggagaaagccaatggtggaggaagacatcttatataatgggagctggaggaagagagcaagggttgcacactggtaaacaaccagataaaaactcactgttgctacaacagcaccaaggagaatggtgttaacatatgagaaaccacctccatgatccaatcacatccaaccaggctccacctccaactttggagattacaatttgacatgagatttgggtgggggtaaaggtccaaaaaattattattctctccatcttccctcccaaatctcatgcctttctcatatttaataatataagaatggcttcccaaccatctctagagtcttaactcattccagcattaactcaaaagcccaaaatagcaagtttcatctgagacaaggcaagttcctttcacctatgagtctgtgaattcaaaaacaagttagttactttcaagacacaagggagatctaggcattgggtaaatactcccattccaaagggaagaaataggctgaaagaaataggatacatgccccatgaaagtctgaaaccttgcagcacagtctttaaaacttaaagctccaaaataatctccattgaccccatatctcatattcagggcacactgatgtaaggcttaggcttccaaggttctgggcatcacaggaacattctaagagagtcacaaaagaatttgtagtgtggcttttgatgctaaacagcgtattagaccaagtaagtcactgaagagaaaaaagtcagaggagaagatgggtgagggtgacagaaatggaatggtgaaaggaaaggtctgataaaaatgtttaccggctgggcatggtggctcacacctgtaatcccagcactttgggaggccgaggcgggcagatcacgaggtcaggagtttgagaccagcctgagtaacatggtgaaaccccatctctactaaaaatacaaaaattagccgggcgtggtggcatgcacctgtaatcccagctactcaggaggctgaaggcaggagaatcacttgaacttgggatgcggaggttgcagtgacctgagaatgcagcattgcactccagcctgggtgacagagtgagactccatctcaaaaaaaaaaaaaaaaaagttcacccaagggctcatctggtaccttgctctgtgactaatatcttacacttttgatttactcttccactttcattttctgatgctcaaagggtcacccttctgctgaagatgagaaaagaggctgagggagctcaaatgagtggtctagagtcatccagctacttcatagagtttgtgtgtttcaccttgacatttgcgcacagacagaaaagtgagacatggaaggcaaagcaagtttttgctgtgggtgacatttatgaaagttacctgtgtttgcagaataatggactcctaaaatgtttgcaccctagctccagaacctgtgcatttacttttcttggtaaaaacacagtgcaggggtgataaaattaaaatcttaagatgtagatgttattctagattatctgggtgggcccattgtaatcagaagtgtccttgtaagtgacaaagaaaagcaggggcatcagtgtgagaatgatgagcctgtgaaactccactggccaatgctgggtgtgagcatgcatcaaaagacaaaattacaactaatgtagttatagattttatttttcatttattatttgaggcagctctcactctacaaatatagtgacagccctccctgggctatacaataacaaaacagtgggttttgtcaagtgggaaccagtaaacaaagccatataaataaataaattggttaacattagggtacttcaggtctcttttctgtaaaagttaaagcagaggaaacttttattatgctgtctcaggtagagtggaatctcctgttttcaacaaaaaacaaaggtctgttctggtatctctttgcttcattaaaacttcagttgtagactgtagcatttagcatgagtcgttctattttggagtctctaggctctcacttaggtgagagtgtgaccaaaatttaaagcattggcattcatctcagtaaccatcattttgggcttccatcatttatgagtttatgatgtcttcctgatcacacatttctttgagtttttgtcatttcagccaaagagagaccctttggtatttgttgatggctgcacacaaaactttttaaaaactcttgtagaattcaccacaccaaaatgtagaatttaaaaacctgtagaatttatcacaccagagaggctactagtatgactattaggaggataataccaaaagtttggagtatgcactttaggcaagatgcaaaccaagtaaaatagaatagatcaaagaatgagccagaagagtctagcaattttaaccaagtagtatgtttggtaacttctgtgattgagtcattatgatactcgatgtatttgtttatgtgcaacaatcagtgtcagaaactgcacaggctcctccctgttcagctggtagggaacaattttattatgtagcattcgacggctcattaaattaaaacagggagtgagaacaagtgagtctgaaaatgtaactttaaaaggggccactgtacatttgaagaaacaattgtgttaaagatggtgctaatgtcagccattgggtggactaaatgatatcttatgtaaaaatttgagggtgacatgatatatctgtcactctgttatgctactctcagaagctacttcacatgagattctaatgataccatcatcctgccaaatgaaagaggcaggcataagcatggacaaattaagaggggtaagagcctgattttgatgtgaagacttgttctgacaacttgggaaaagcttttgacagtatgaagttgtcaacttcttaccctggttttcagtttgagtgtctgtagttatggtgtcaaacatattggtgagctccgagtgactcattcttcaggcacgagggttttcctgtgaaatttacattgagctttccacctccaacttataggacttcagtaacagagcagattttgttcttactgattcaataagaaaaaactggatgggaggaactagaagaattcagggtctagtccagtctaccggtgaataataaaaactcgaaaacaatgaacagagctgcaatttcatagcaggtatactacactttttattttcaacattatttttctctctataggcatatctatttttaccaaagaaaatcccagtaggacaaatttgtttacaaagtaggtttagtcttatcaaactttgccaggattctttacataagcgcatcaagagtagcagtggaccacagaggctcttcctaaagtttggttcgctagtttttataagtagtctcagattaaacttttacgaacctcttgagatgaggaagccgaatgaaagccatcttcagactttgcctgcagtacatatgtgtccattctatgtatattctcaaatataacatcttagtcaaagccttggtaatataaccaatgttttgaaatgtgtccttttgtaaagagaagattcttactaaacttgtgcaaatagctgtatcatcataatcatatgaatactcatgaatagtttcccagtcctgggacagttaggtaaagagcaaaaatcaatgagcttcaattattgtttccaaaagtatactttaccaaatttctttagatataactagcttaaaagaagaaaaattccataaatctggaaaaaatcatttaaagaatcatcaaattttcaaataaaaattataaaaacattatccacattatcatttatttcaatgaaagtatttttgttctgcttggtctaggttggcacatttcatgaaggcatcatcctgtttgttaaagttttgaaagtctatagatggtccagtgatataatcttgaactgctcagaaacttgtatgcaagagtacttgtcagtatcttttccataaatcttttgaaatagaagcaattttggactgtagctgattgcaaatgtttcaggaagaatcaaaacaactatctgtgaatgaccaacatgtaaaatgactattgctaaaactctgataagagtttggtataagaaagggagtaactccagccagtactctagtcatgatgctgacagtggccccaactgagagaccaaaagaactttcttatcctgaagcagctgtcatggaaaaaaaaagaggagaaggaataaataataaagacagcaagggttttagccaattattttttgagatagggtctcactctgttgcctaggctggtgtgcagtggcacaatctcagctcactgcaacctgtgcctcccaggctcaagcagtcctcccacctcactctcctgagtagctgggactacaggcacacaccaccatgcatgcttaatgtttgtattttttgtagagatgggcttttaccatgttgttgaggcttgttttgaactcctagacttaagttattcactgccttggcttcccaaagtgcagggattacaggtgtgagccacctctcctgccggtttcatgctttttataataagaatgaactccttatgtaataataaataaataaatgaaattatttgctttggatgtaacaaatgtagatttagattgtccagagtcaggagctaagcctcatattttttttgttttagctcagtgtagagtgcattgaaggtgtcctaaaaataattccatatagtaagccaattttaaaccctgctcacagccaggtctgccaagtatgagccaggtaaaattaccaaaatgggtggttctgactgactccttaacaataacgtggcttacaaacaaagactgatatgaaatagttgatccaacccaaacagtttgctcattttccaaaattttctatacaaacatatgcaacttaccacaacatagagatcataatgaaaggtttcccttttattcctttaaatgaccatatgtttagatctgatgtactgacagcaataattctccattaagcagaaacctaataaaatttgaaaaatagtgattttatctttagatgatactcagatcttctgctacatatgtggaaaatggaattattgctagaaacattgtttaaagattagggtatgcaaggagtattaggaagtcaggaggttctttctttaggaaacagcttatctggattcattcaaagagctttaggcgagtttgaggtctttctgcaaaatgtaaattgctatctgagaaaccatatatagtccaatgatgaaagaatgcaaagccttagaagcacaggagacaattccagtatcttccctaaagttctgacaaaaaggaaaataactatcaaattcttcaactcgaatgcttattatgtatgtataagtcaatcggcagatgaagagaggctggaaatatgacttctacccctagggaactcacagtcttgtgggggccactaggggtggtggtgtgacctgcctggagcagcgctaagtatggacttgtgagtcaagggctatcaaaacctaagtaaactgattgctgttcagagaaggtagagttccattccacagtttgcaagaaggactgttttatggaggaggtcatgttggactagaccttaaaaagttggtagaatttaaaagcaaggatatggaagcaggaagagtgaaagtgagcagaggtacagaagtgaggcaagggtgagcagttttaattttttaatggtggtataaaatacacatcaatatttgccatattattattattattttggagacagtgtctggctctgttgcccaggctggagtgcagtagctcaatcatggctttctgtatcctccacctcctgggctcaagcaatccttgtacatcatcctcctgagtagctgggaccacaaacatataccaccatgcccagctaatttttatatttttgggagtgacaaggtcttcctatgttgcccaggctggtctcgaactgctggactcaaatgatcctcctgccttagccccaaagtgctgggactacaggtatgagccactgcacctgaccccatcttaaaaatttttaagtgcacagttgagaagtacatttgcactgtgcaaccatccgcggcaaccatcttcagagagtatttttcatcgtgtaacagggaaaattcatatccatgaaacattaactcctcattcttcctcctccccaccccaggtaaccactattccagtgtctctatgattttgactgctctagggacttatataaatgagatcatacactgtgtatctttttgtgactggcttatttcacttagcataatgtcctcaaggttcatccatgttgtaacatatgtgagaattttttccttttgaaggctgaataatatttcgttgtacggatggaccaaattttgtttatccattcatctatccatggacacttggtttgccttcacattttggctattgtaaataatgctgctataaacatggaggtaccaatatctgtttgggtctctgctttcaattattttgggtttatacccaggagtggaatggccaagtcatacagtacctgtagttttagttttctgaggaaccaccataatgtttttcacagtggctgcaccatcttaattcttatgaatagtgcacaggggttccaatttttccacagtctccttaacacttactattttctggggcttttgctttgtacttgagagtagccatttaaattggcataaggtataatttcattgtggtttacattttcatttccttaatgattagtgatactgatcaatattttctatgcttgctggccatttgtacatcttctttggagaaatgtttattcaggtcatctgcctatttttttaaattgggttgaatttttttttgctgttgtttaggtagagaaggcaatctttgaataccagtgatgtttcactaatactgggccattgatttcacaagaagttgtatgaggtactagaatgtgtgtttggtttcaatcatggctggggttgaatgccttttccaaaattcagtgtgaatttcaccagaagccacaaagggtccaggagcaagaacatggtgtgactgctctctgctaaagaatttcagcctgatgacagtgagcaggctacacatgagactgacacaagaataggtggagagggagactttccactggaagaaggtgattctaacatgcagaatcaccttcaaggagcaagtaagcagaaaaatagacaatggcacagtggccaggcaagaagacactaggtccagaatctgaggttcaaatcctagctctgtgagataaaaacatgccttggttttcccatgctactgaaacaccaggggttgggtctaggtccctttgctcactgcacagaaagccaaccactgagacaatgagcattgccagggaagaaggctttatttgggtgctgcagccaaggaggtgggagatcagtcttaaattcatctctccagccgactcaaattggagggtttatatagctgggaagggaggtagctacctgcagggaaaacagcaattaaggaggggtaaggaagcaatcatgataaatgaggggtctggtgtctcattgtctgatggtgatttggtgaatttcagtctcttgcctgaaggtctgtttcctaactcagatgactgacaaatgttaagtttcaagttttaagaccagatgggtcaatttctatgtttattcaaaaaccctgtaaatatcagttctatgtggaacttgagctggtttcccccaagtcatcacagttagggttaaatgatgcaatataagtaaaacaccagcagtttctgacacacacacagagtgcatgacacaagtggtgtgttgggacaatatagctcagtgaactccctttgtctactcagttatattgagtgatgaggcatctctgaagatgccactttgctacttctcccctgataatttcaccagatccagccatatgagcactgcaagtggggacttagcttaaatcattcctcgtatttcctgtgcaggcaaatcatttggcaccaaaacatgcacagaagtccaaatcctgctgccagctccacgactgatgacacagacagacttcaggattagtcctttaatctctgtcctctattaaatgaaggtcatcatgctgctgcctaatgtaaaaggattgtggggattttcatcattcattaccgattatcttattctttgaaaccccaagaaaactatacaaattccaaagtctaataggtacacaagggctttattatggatgatgaagtttcaaaggatgctaaaccaaaaaaaaattgtttttctttttttttttggatttatttttttatttatttattttattatactttaagttttagggtacatgtgcacattgtgcaggttagttacatatgtatacatgtgccatgctggtgcgctgcacccactaactcgtcatctagcattaggtatatctcctaatgctatccctcccccctccccctaccccacaacagtccccagagtgtgatattccccttcctgtgtccatgtgatctctttgttcaattcccacctatgagtgagagtatgtggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacctgtgcatgtgtctttatagcagcatgatttatagtcctttgggtatatacccagtaatgggatggctgggtcaaatggtatttctacttctagatccctgaggaatcgccacactgactttcacaatggttgaactagtttacagtcccaccaacagtgtaaaagtcttcctatttctccacatcctctcctgcacctgttgtttcctgactttttaatgattgccattctaactggtgtaagatggtatcttattgtggttttgatttgcatttctctgatggccagtgatgatgagcattttttcatgtgttttttggctgcataaatgtctgcttttgagaagtgtctgttcatgtccttcgcccactttttgatggggttgtttgtttttttcttgtaaatttgtttgagttcattgtagattctggatatcagccctttgtcagatgagtaggttgtgaaaattttctcccactttgtaggttgcctgttcactctgatggtagtttcttttgctgtgcagaagctctttagtttaattagatcccatttgtcaattttgtcttttgctgccattgcttttggtgttttatacatgaagtccttgcccatgcctatgtcctgaatggtaatgcctaggttttcttctagggtttttatagttttaggtctaacatgtaagtctttaatccatcttgaattgatttttgtataaagtgtaaggaagggatccagtttcagctttctacatatggctagccagttttcccagcaccatttattaaatagggaatcctttccccattgcttgtttttctcaggtttgtcaaagatcagatagttgtagataagcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaagaaagtcattggtagcttgattggaatggcattgaatctataaattaccttgggcagtatggccattttcacgatattgattcttcctacccatgagcgtggaatattcttccatttgtttgtatcctcttttatttccccaagcagtggtttgtagttctccttgaagaggtccttcacatcccttgtaagttggattcctaggtattttattctctttgaagcaattgtgaatgggatttcactcatgatttggctctctgtttgtctgttgttggtgtataagaatgcttgtgatttttgtacattgattttgaatcctgagactttgctgaagttgcttatcagcttaaggagattttgggctgagacaatggggttttctagagatacaatcatgtcgtctgcaaacagggacaatttgaattcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttctcatagatagctcttattattttgagatatgtcccatcaatacctaatttatggagattttttagcatgaagggctgttgaattttgtcaaaggctttttctgcatctattgagataatcatgtggttcttgtctttggttctgtttatatgctggattacatttattgatttgcatatattgaaccagccttgtatcccagggatgaagcccacttgatcatggtggataagctttttgatgtgctgctggatttggtttgccagtattttattgaggatttttgcatcaatgttgatcaaggatattggtctaaaattctcttttttggttgtgtctctgcccggctttggtatcagaatgatgctggccttataaaatgagttagggaggagtctctctttttctattgattggaatagtttcagaaggaatggtaccagttcctccttgtacctctggtagaattcagctgtgaatccatctggtcctggactctttttggttggtaaactattgattattgccacaatttcagctcctgttattggtctattcagagattcaacttcttcctggtttagtcttgggagagtgtatgtgtcaaggaatttatccatttcttctagattttctagtttatttgcgtagaggtgtttgtagtattgtctgatggtagtttgtatttctgtgggatcggtggtgatatcccctttatcattttttattgtgtctatttgattcttctctcttttttctttattagtcttgctaggagtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcctttctagttcttttaattgtgatgttagggtgtcaattttggatctttcttgctttctcttgtgggcatttagtgctataaatttccctccacacactgctttgaatgcatcccagagattctggtatgttgtgtcttcattctcattggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttgtaataggtgtggtgtggtgctgaaaaaaatgtatattctgttgatttggggtggagagttctgtagatgtctattaggtccacttggtgcagagctgagttcaattcctggcttgattaggtaaataaagcagccaggaagctcgaactgggtggagcccaccacagctcaaggaggcctgcctgcctctgtaggctccacttctgggggcagggcacagacaaacaaaaagacagcagtaacctctgcagacttaaatgtccctgtctgacagctttgaagagagcattggttctcccagcacgcagctggtgatctgagaaccggcagactgcctcctcaagtgggtccctgacccctgacccccgagccgcctaactgggaggtgccccacagcaggggcacactgacacctcacacggcagggtattccaacagacctgcagctgagggtcctgtctgttagaaggaaaactaacaaacagaaaggacatccacactgaaaacccatctgtacatcagtatcatcaaagatcaaaagtagataaaaccacaaagatggggaaaaaacaaaacagaaaaactggaaactctaaaacacagagcgcctctcctcctccaaaggaacgcagttcctcaccagcaacggaacaaagctggatggagaatgactttgacgagctgagagaagaaggcttcagacgatcaaattactctgagctacgggaggacgttcaaaccaaaggcaaagaagttgaaaactttgaaaaaaatttagaagaatgtataactagaataaccaatacagagaagtgcttaaaggagctgatggagctgaaaaccaaggctcgagaactacatgaagaatgcagaagcctcaggagccaatgcgatcaactggaagaaagggtatcagcaatggaagatgaaatgaatgaaatgaagtgagaagggaagtttagagaaaaaagaataaaaagaaatgagcaaagcctccaagaaatatgggactatgtgaaaagaccaaatctacgtctgattggtgtacctgaaagtgacggggagaatggaaccaagttggaaaacactctgcaggatattatccaggagaactcccccaatctagcaaggcaggccaaagttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctcttggcagaaaccctacaagccagaagagagtgggggccaatattcaacattcttaaagaaaagaattttcaacccagaatttcatatccagcccaactaagcttcataagtgaaggagaaataaaatacttaagagacaagcaaatactgagagattttgtcaccaccaggcctgccctaaaagacctcctgaaggaagcgctaaacatggaaaggaacaactggtaccagccactgcaaaatcatgccaaaatgtaaagaccatcgagactaggaagaaactgcatcaactaacgagctaaccagctaacatcataatgacaggatcaaattcacatataacaatattaactttaaatgtaaatagactaaattctccaattaaaagacacagactggcaaattggataaagagtcaagacccatcagtgtgctgtattcaggaaacccatctcacgtgcagagacacacataggctcaaaataaaaggatggaggaagatctaccaaggaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccagtacaggagcacccagattcataaagcaagtcctgagtgacctacaaagagacttagactcccacacattaataatgggagactttaacaccccactgtcaacattagacagatcaacgagacagaaagtcaacaaggactataactttttataagatacatatgggtttactactaaatattcttaaaatgaatataatgctataatattcttattttgaggtaatatatatatatagtctgcaaaaattaggtttcctggtgtcattaaccacttatgcaattatttttctgaaatgaatacacatgctgtacatgcagttttgcctgatataagttttaaaacaacgtatattggaatcttggaactaaaaatgagaaaatcagtgtccccttgatgtcagtttcagtttcaactgcacttgctattttatttttaattggttacttacattatctgtacattgtcacagttgatggtatttgttttcttctctgtgaccatagtttgcacagatttaaccataatgcatccttaaagattacaagaaatcttttagacacagctcctctcagttgctgaggatcgaacctttacttatgtgttttcttcatgaatatatatttcctgtgttgtatgtttgtacatagctatttgtagcctttgaagtttatggaagtttttttggttgcattcttggggtatattttctttccctgatgactgttaaggttaggatatttgacccttccaaagctcatgttgaaatttagtccccaatattggaggctgggcctaatacaaggtgtttgggtcatggggacagatccctcccattgaatagattaatgtcctctcctgatggtgaatgaattcttcctctattagttcctgcaagacctggttgttaaaagagcgggccacctccccggtttctctcttgcttcctctctcatgtaatctctgcacatgctggcttcccctcctctactgccatgaatgggagcagactgtggccatcaccagatgaagatgcccaattttgaactttccagacaccagaatcataagccaaatcatcccttttcctttataaattatccagcctcaggtattctttatagcaacacaaaagggacaggactttttatatcttgccccactgtcttctagcatttcatgtgtcccataaagaaatcttagtctcctaggttttttttttttctgaatatccacagaattctttccataacttcaaataccaggaatttattggggtatttgttaattattcaatataaacacagccttgtaattcttgggctatttctgtctgcagattcaaatttcactgtatttcaggaatttcaccttgaattgtatctttgaaaatttgttttcatgttccattcattttttaacccatgcaaggcatttagtgttatagatatttgatctcttccctaccactccctcccatccccctctttttctctatctctgtcttccgtcttttacttttcgttcttttccatctcacatgctcattttttcttctcaaaaccatccttcgaattccttcagtggtgtctcatctcccttttgctgcttctatcatgacctttgattttggtctctttttgtctctctctctctgagattctgaggctctgcctattccgtttttattctcatttgtttctaatttgtttccaagactctgtctactcccttttcattctcatttattactaatttatttctgaggctttacccactcacttttcattcccgtctaacctaatgtattatcagttcttccttaaagccttatattgcttctttaaattctcatttcagagaaacaatagtgtctttaattgattccttagaaataactttgttcatggtttttggctgcgttgtggtatataatctttccatttctcatctttgtaaatcatgttctgttcttttttatttcagcatcattttaaaggccccccactggctccaccctttttaagtagcattgttcctcatctttttggactagaattttgggcaaagctctggggaaaggggaagaagaaagtgccaaacaaacgggaagattgggtttcagtctgttatctctaggatgtttctcagctggacttggcctgtgggttatctggtccagcatagcaggatatcttccgggctcacaaggaggctgtgcattttacagaacattttaatgtgattatttcaccttgacttatcttcaccagacagctttgggcaaagacggccaggtagcttatatcttattgactcttccttctatcctataccatgattgaaacatgatgtaggcttccaaaaccaggccatgaaccttgatcttaactttctaagcatgggatagacacatttcctttcaatgtgtgccacccatccactttggataactatgagctgggtccactctgcctgagtcacacatagaaagacaccttctcttggagttcccaaatacctccatccacttctcatacacttggttatcttcctgcatctactgttatccagtgttataggggatctgtagcttcattcaagataacatttgtttgtttcttcttctcttgtttgctttggattggtttcataaaggaaatgagacaaaaatatatttatactaccatttgaaaagaaaagataaattccttctttcaaattcattcctttttctttctttccagtgaatctcatggggtgaggggagcactgaagggaatgtccaatctactcaagtccaaaaagtcacaggtataaggcacagaaaattttaccagtctaatgatggcagttttaatgctatataaggacagactatacaaaaatgctattaatgaggatgaggagctacaggaacaaacctgatgaggaactgtaattctattagagggatgtatatagccatcatttttttctttaatccaaaacaattagattgcttatatacacagccacattcaattctaaggtatttgattgaaatgcaccagaagatgcagatatatatatatacttttaccttagcttccattttattctttccctcccattttatcagtgctatagagtacatttttcccacttgagctcaacatgctgttgtgcagaaagccttctcttgggagttcccaaaatgttggcccagatgagtgcagcagacatttggcccaggtgagcctagcagatatttacatgaaatattagggagcatccatctgggccatgtgacttaggctggcgatacacgacagaggattccaatttgttgtataaatcacccttagagcccccaacagtgaacacatagggggttcttttcattttcatgatgtttaatataatctttaaaaataattaaaattaggtgaagtgtgtagatttctgagagattacagaaaggcattagttttgatacctcttgcttgtagcatttgaccgacataaacaaactaaaaggtttaaaaagaacagggattcttcccagtggtatagggcaatgggtagggaaaaaaagttcaaaattgataaatagaccaatattattctcaaaactcataccattgtgattgggaagaaatgaatacatattacttagtcacatcatgttaccatatacttatattaacacaacaaaaaggaaattatacgaaaaaaagtcatacatttaaaggatggaagaaaatcctaggtttactcagagctcaagatcccattgggatgaatattgttctttcctcggattgtgccttcatttcattcattcacttatgtatgtatttatttatttagagatgggatctatttctgtatttatttatttattgattgattgatggagtattgctctgttgcccaggctggagtatagtggcacaatcatagctcactgcagccttgaactcctgggcttaagtgatgctcctgcatcagcctcctgagtagctgggactgcaggtgtttgccaccatgccccgctaatttttaagtttttttttgtattgattgggtttccctatgtttcccatgctggcctttaacttttcagctcagcgatcttctgccctggcctcccaaagtgctgggattacaggtgtgtcccttcatttctaatgaaggaaggttttcctttgaatatctcacaacagatatttttaaaagaaaggcagatttgagcaaccatcaacaaggtttacttgaaaattaatctgatatttacaagtgcattatataacagaaatgttacagactgaattgtgccacacctaccccaaaactcttatgttgaaatcctaacacccagtacctggaatgtgattgtatttggagatgggtcattaaggagtaaattaaagtaaaatgaggtcacatgggtgggccctaatccaataggactggtgtccttataagaagaggagatgaggacacagatacacgcagagagatgaccctgtgaggatacagggagaagacaccatctacaagcccaggagagaggcctcaggaggcaccatccctgctgacaccttgatctcagacctctagcttctagaactgtaagaacaattgttgctgtttaagcattcccatatgtgggactttgttatggctgcctgagcagcctaatgggagtgcaaagactttctttaaataatgtataacaatgttggtttggaaatgactatccagtgttgagttcaaaactttatctttatgggtgctgctatgagtgagtgtctaatttgggggataatattgacattcttcgggagaaatgcagactccaatcagtgcagaaaatggcacagaataatgtttaaatatgccctccaggccataacatggttgggttaggaggaggaatattaaccattcccatcctaaaacacagaattttgggtttctttctgtgagttcaccacctctgaccttcacaggtaagggaccatcacacagacatctgccattttcatataactctctatccaaacaaaggctgaaaattcagcatggagaaactctcccagcacccgtggtcatccccttgacctgcatccccaccctgggcactggtgtgggggtgggattctttatgaacttgggccccaattctgctttccctggaaagctggacccacacaacatcaccctcatatgcagaccctcatgtgtgggcacctgtgaatacccagagctgggggtctgctctaggagctggttcaggacaggatactcccatccaatctgtgcccaccatagaaaagagccagccaagtgcctgctactacagggctcttcacacatggaaaagctgccctgtggaagtgtcccaggaaagggcagggggacaaaaaaaggtcgcagtgatttgcctccagacactggacactcttccctggagagtacagggcatgctgctctccaaacctgatcttgctacatttgtgctgcccacagtagtggtgccactgagttttcaaagaagacagcaggccctgaattgtgcaaggaaaataagtgcttgaattttgtagcatgcatgcagtgttctacttttaagaatggtaccaggctcctctgatattcaagaaaggcccccaacagctcagatggtagttttctaatcctgtcttcccatatgcacatttacctcctccacccaagaactgaataacagacatgagtgctcaggacgtcatgctgtctactgtcatccccttcctgagaccccctctccaaatctcttgacaaccctcttcttagctccctctttctttctggcctgttacactcaacctctccagcatcctaacaagtacccactcaaacctatttcctcccctgctgtgctgcttcttcaaaagtgctttgcttctcatcctcaccttctttccttgccctcttccctgcttccctcttcaaagcacttctcagctacaaatgagaaggaagcgatctgattaaacaggtgatgagcagagtcacattctgaggggatttgcatttttaaaaggagattaatgaccacatctgaaaatgccaccctggaatcttatgcagagtgacaggggattggggatgagctccattcagggcaggaagtgagagtttggatctgaagtgcttttcagatgctgaagtcataggaggttgcagttgcttcctgggtggagccataaacaaacatctcttctgctgagtgaagtctgagaagatagaggcaatggtgacccaggagctctggaattatctggctgtgttacacttgcaggactacacacatttaagtgtaaaaagcatgctttttgtccacttggctgacctcttagcctgctctcctcttattgttcccttgaaggcatcattttttaaagagaaatttaaactccgtccatctcatcccctttggaagaaagttaagattcctttctgagctctttcatcatctggagtttaaaagcttcccctcctctgtcaactctctttgaatccctcatgtcacaccaaacttcaaaagagacaaataattttgcatgactccctgcaggctccattttgccctgtagtgacagccccatgtcttgactttcctgattggaaaaacttctcaagctttctacattcatgatctctgcttcttcagtgcaaccttctccagtttgtccctgatgtccaatggtccctgcattaatcctgtccaagccacaggtgaccctcatatcatctcagcttctacttcccattcctctctctctctttttttttttctgagacaggggtgtcactctgttgcccaggttgatctcaaactgttgagctctaaagatcctccggcctcatcttcctgagtagctggtaggggtgtgagcccttctgcttggtctccagtcctttgcttttcttttttgacctatacaacatttggtagttgatgtccatgttcatgtaattgtcttctctggcttcttggggccacagtgcattgccttctccctcttttcatttattatcttttcatctagtaagacccatcatcccctaaagatgtatattttcttcaaagcaaggattggcgtaccttcacaaactgagtctccaatgacaacataaactgaaatgcaatataaatcatggacagatgtgagctcatcttctgcttcctgtgtcctccgctggttcttcttaccaacatcatgtattgttaaataagcgagtgatattaagttagagaatggactgagtccattaattcatttggcacgctccaaagtcctcacctgagatctatctactctccaaattacacttgttagaaatacaggaggggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaaatacaggaggatccttttcacatgagctaattagggtgaatacatgtaagtgttggtaagaagtactagaaacactggaatttgtgagatttcactgaagaaccagcttccacccagtccttcacattgttctcttttggtagtttcttgtcatttcctccttttattatcaatagagctgctgtgaacatgcatgtacaagtttctgggtggacatatgttttcatttttattggggggggtagacatcaaagaatagaattgctgtgttgtatgatgagtctgtgttctaacatttcagaagctggacttcaactgcttcctgatttcaccttccacaccatttctgtagtgaggcccactccttggccttataagacctgaattaagttaggtgcccagagccgttctgtcatcgactctgttctttcccttgctagcctgtgtaataattggcaatcagacctttacatgagcaatggtttcatatgtctccccaactatattacaagttccacaggggcagggctatgtctatctccttgacctctgtatctgcgatgcctggcagagggctatgaacactggttacgctccataaacactgggagacaaagaagggtgtcagtagagttagtttttttgcttttttacccccagaactcttagaaaataatttgagctattccttcaaggaagtcctggggcaggtgatcattcatagatgacatgagggagtgcacagcacatgagtttgcaggaaaatgcaaaccccacgttgaaatttgatccccaatgttggagatgaggatttacaggggggtgtttgggtcatgggggcggatccctcacgaatggcttggtgctgccctcatggtaatgagtgcgttctcttttcagtcctgcaagagctgattgttagaaagagcctggcaccttcctctcctctttctcttgcttcttctctcaccatgtcatctgtgcacacagcagctccacttcccattccaccatgagtggaagctccctgaggcctcaccagaagcatatgctggtgcaatgcttcttgtatagcctgcagaactgtgagccaaataaacctcttttctttataaattatccagcctcactcaggtattcctttatagcaatgcaaaactgactgagacagggtatcaggagacctagctttgcctgaatctgagaacttcatcaggacttttggaacaatttagcccacaggtccaaggctgatttttgtcacagtgaagttcaggtagtaagaattctcactggtggctgttgaggatggtggtggtggggatgggtcatatggagaattagcagtgggagactagaaattaaagtggagaaagggaagaattaaaagtcaaaaacagtgtgagggaggaaagcaatggatataacacctcaaatctttatccttgagaggccttaaaaaatctacttaataataatcagatgctattctataagtactttgagactagacatgtgatgacttttaggaacctgtactgtggctgaaaatgcatgcaaatctagttgactcagatccagtcttaactggctcataacttgcttcatatgcatgactgtacgttagcaaggaaatgagagagaataacagcacatcacataggcatgaaaagtatttgcaaagcagcagttctcaaaaatgacattttgcagtgttttccagaagcagattcagaaaactgaagaccaaagtaatgatggagccgtctcatgcctagatgagcagaagcataccaaaggcttagtatttccccaagtagtaggcacctcaaacttatttaaggaaaatactcttcttgatgaaacagatactgcagtcgaagcaggaatgtgtttggtgtgctgccttaaatagcatgggtagatgttcaaacatgttaggactcgctggccctaggaaagacccgcaagtagatactttccacaccaggaaagtgacaatgaaacaccaaacaccttttctcctctaattaccaaggaaaatatttctttcccaatggtggaagacaataatgttgggaatgatgaagttttctggagtgtgaagtggatatgtcttataagtttaatccacagattcaccacttcataagtggataatcgaattgtgcctcagtttcctcagacttggggatattaagagaaccctcagtcaccacaaggtgggtaccagcataagaaaagagtgtagcaaaagcccaggggtgcatgttcttaaagtgcctagtgtgggattagaatgacaagtggtagatgacctacttgtgcagaaatttagagttattttgtgattttcaaatgatcatgggtgctttccatatgctgtccagactaggggtgctgcagctagaaagggaagaaggtttccatatttcctgagattggagtcacatcctctcaccaatgcactcacctgctgactaaccagtgtacttctgggaattgcaaatgcatgaaatggcacccattctagactagtcgcggcagtgttggtgatggccacagaccaggaacgaccttgacgtttatccgtagggaactgggtcatgagccatgatccacatcatggatactgtgcagctgtggcaatgaatgaggtatccttctgtctgtgcaccgggaaaggtttccaagatacactgcacagtgagaaaaacaagaagcagaacaatgcacggtgtgctacctcttgcattacaaaggaggaaatgtaaaattaatttacaaatggccaataaacacatgaaaagatgctcaacatcactaatcattaggaaaataaaaatcacaactacagtgggataccaccttacatcctttacgatggttgttcccaataaaaaaaaaaaaaggaaaacagaaaagaaaagtgttggcgaggaggaattggaatgcttgtgtagtgtttgtgggtttgtaatatggcacaacaactgtggtcatttctcaaaaaattaatcatagacttaccacaagatgcagcaattcggcttctggtgtattccaaaaagaacggaaagcaggggccccagcagatatttgcatgtctttgttcatagcagcattattcacaatagctaaaagttggaaacaagcccagtgtccatccatccatgaatgaataaacaaaaagtggtctatgcgtacaaacaaatgggattcagctgtaacaagaagggtgattctgatgtgtgcttcaacatgattaagccttgagttctttctgctaagtgaaataatcagactcaaaaagacaactactacatgattccacttaacagaggtgcgtaacgtcatgaaatgcataggcagaaaatgaaaaggtggttgtcagcggctggagggagggggaaagaggagttggtgtttaatgggtacagaattccagttggggaatatgaaaaagttctgggtggggatggacagtggtggtggttgaacaacaacctaaatgtacttcctgccactggatgtacacttaaaagtggttaaaatgggccgagcgaggtggcttgcgtctaatcccagcactttgggaggtcgaggtgggcagatcatgaggtcaggagattgagaccatcctggctaacatgatgaaatctccgctctactaaaaatacaaaaaattagctgggcatggtggcatgcacctgtagtcccagctactcaggaggctgaagcaggagaagtggttgaacccgggaggtgaagtttgcagtgagctgagatcatgccattgcattccagcctgggtgacagaagaggaacccttctcaaaaaaaaaaaaaaaaaagacagaaaaaaaagaaaggaaaaaaatggttaaaatggtgaattctatgttatatatatttcacaataatttacaataattcctattgttttgcataaaacagctgtagaaagctttgcaggtcatgaacagcacagctggccactggggctggcgtggggctaggacctgggtgcatagggaacagggatgagacacaggctcttcatgcctgcacacatatacagatacacacagatggaaattactgagccatctaaatacaacacctattcaaaaaatcaaacagaaaaaggaaatgtaatggggctgaaggatgagggtaggtggggtggctgctcaggaggactgtggaggccacatcgcctaaccttcgaggcctctcttagcagctggagtgcatcccggggacttgggagctctggaaagaggagcaggaaagggccatggccggaggaggcctgaaaaagatcatctctgccacagagaagaagctggctcggatgctgctggcccctatggagacagggagacccggggagacaactgtattcattcaaggaggaatgggtggtgatgcaaacttgggtggaggccacagggtgcagaagacaggacacagcagagagagatgtaggacatggaagggacagaaaggagtgaccacaggacataaaggggcaaggaaagtggaagcatgataacatctgctgggcatccggctgaggggttgggtgcctagggtgcccttccctaagggagaaccccaggagcagattcagagaaaaccgcccagctcactccagcaagaatcagaaaaggaccggttaaaggagagggtaggaaggtcaccaagctccaagggccctcatgaatccggcttggaggccacagggcccagggcaaggacaaaccacaggcacaggacagctccggtcaagatcttctggctactgcaggaggcagaaaccacaccctgcaccctgcactgctgaggctggcgctggagtccagaagcttctacaccagaagcttcggtcccccatccctgctcaaaaaattaaaacaaaaacaataacaaatcggtgtcatgcaccctctgcttcctggtgctgttcgggaccctgagtctttcacgggagcacctgatggggaaagcctggacccgtgtcggtgtccctcctgcaaggagtgctgggaaaatgaactttccagcttcctccttgcgaaggcagaacattccccatgtgtactggtggcatttaaaaactgcagggcagccagagaacatggactgtgttccaccgggagagttcctggcgggatgtcccggtgcagaagcccgtcccaaggtgggtatttgagctgaggaactgagaagccggtttctgcctagagttagagatccgagaggcatcagcacatggaagggagggaatctacgatgcctcgagggtgggagatcagatgaaccaggagaggcagggcccgggaggaaccccggggagcagcctcctttaaagcctgggggaagtagcttcagagaaggtggggtaggttgggtgggggttgctggaaaaatataattaagaaacaaatttctgctcagcccagaaacccccctcacatccatagaagtaaaagaaacttgtcttatgattgagtaagcattaagccaaaatgtgatgcaatctgctaagagatgacaaagacagaaagaaatcccacctttgtatccagccaagcaggtgcaacccgttacacacatggtctccagatagatggtgactagttcccagttgagaggactcaacggcaccatttgtcacacgtagttcatcctaaattcacccagtaactgtgttgattctctgtgtggttaattggctttatccacaggaaaaagaaacctctcatctatgacaggaggtagttttgcaactgggagtgagatgcccccagaactgaggttccttccttctcacagaaactgggagacaggggtgctttctgcccggatgcctgcctttcaaagagaggtctcctatggccttgaggaggagaattctgggttgtgaggcaggcaagatacttatgtatgctttagaaagctttgcatacatcttcaagggatagagaaagagttttcaattacacctcttctaaaaaaaatgatctcaaagtccagcctaggcaacacagcaagatcctatctccacacacacaacaataataataaatttgctggacatggtggggtgtgcgtgtagtcccagctactcaggaggctaaggagggaggatcacctgagcccaggatgttaaggctgcagtaagcttagatggcagcactgcactccagcctgggtgacagagtgagactctgtcaatgaatgaatgaatgaataaatgaatgaatagaaaatgctctgagtgaaaagaggagagtctctttatctttttgcaacaggctaaacaaagtttttaaaaatgtatatttgcctcacagagattattccaggaaaagaagtggccctcagtgtcaaaggatgcaaaactaacctctgagttcctggcaggtttagcaataaaggaggatgttgctgatctcagtacaagcaatgttagagaaaggggaagatggaagtggacaaggacgagtgagtggaaggtgacaaatggaagcaaagaaacgtatccagaccattgaagatgcttgagcgagaagaaagaggcggtggagggaatggaagcccgaggaagtcatatgttgcaataaggggcctcagagcacgtgtagagtgtggagcagagcccttgcagaggggctgtggaaggctggcagggtgcaggtggccccactctccgtcaccctgaggagtgtgtggtcagagttaaagctcagtctgtttctgggatcaggtaagaggtgagcgtccggagaagacaggcggatcttcagatcctgcagacctccaccgtgccctctgtccctctcgactgctttttctccatctccattgtctggctcacattggtgtcactttttcatttctccctgcccgtcttttctcttttctcctctctttttcttaacccttgtacctttggaagtcccactaacagaatttaaacagcttttcaagttggttttttgttcccagaaattgattttagactctccatgaataatgtggaaatcaaatgagtataagctggttcatctctctgcaaataaacaaataaaatctacattccaatgtttcttcttccagagtagcccgcacttgattttttttttaattactgtcacttgcaatagatttttaattcctgtaacctggctacacaaataccatggggcaaaagccttacttcctgtgagaggaaaccaggcttgactagcctcatgctggctttgaagaagtaaaatcaggggttgatgaatttgcatagggtaaatatcaaaggtcaaaagtaaacaataggtggtagagggaataccccaaattataaaagaacaaactgtttaagccacaacagaattatcgtagaaataaaccacggtccttcctgctaaaatattccacttagaattgtaaaatattcttctcaataactcctggaagagcctactcataaattaatgaggctgggagcagtggctcacacctctaattccagcactttgggaggcctagacgggcagatcgcttgaggttaggagtttgagaccagcctggccaatatggtgaaaccccgtctctactaaaaatacaaaaattacccaggcatcgtggcaggcacctgtaatcccagctacttgggaggctgaggcaggagaatcgcttgaacccaggaggtggaggttgcagtgagccaagatggcaccactgcactccatcctggatgacagagtgaaactccatctcaaccaaaaaaaaaaaaaaaaagaaattaatgaatgtaagagcatctatgttccaaatgcagtgtattattttatgcaggctttcacaagctccaaaagattcaccgtgcagaactggacgttctagagaaagaccacgcctcctcctgcaggtaactcttcattcaggaagcagctcttggcttatccctgggcttagtggaattggaatacctgaccataggacaccaagggctttaggacctgagtggcacatcgtgtcctggtgacatctgagttacctggggcgtgcacagcagcctccagcatcccagggagagctgtgtatggggtcaggctcaagcaggtcccagggcaccagtgacccaatgggtgaatcagactcccgtggcacctgctccttctgtatctccctctgccatatatatgagctcatgggaagcactgtaacctcttacagaggaggaaagttcatggacttctagcttctagaactgtgatacaataaactcctgttgcttatctactcctctgcagtattttgtcatggcagccctagcaaactactacagggactgtgggggttaggatgacaccaagcatcaaatgccactccctgttccattattatgtaatgtccctctttgtcttttttaactgctgttgctttaaagttagtttttttgatataagaatagttactcctgctcacttttgtggccatttgcatggggtgtctttttctacccttttaccttaagttcatgtgacactttatggttaggggagtctcttgagggcagcagatacttgcttggtgaactattatcaattctgcaattctgtgtcttttaagtggagcatttaggccacttacattcaatgttagtattgagatgtgaggtactgttccattcatcctgctatttgttgcctgaataccttggttttattcatttatttattgtatttgtgttttatacgtcctgtgagattcatgctcaaagaggttctgttttgatgtgtatccaggacttgcttcaagatttggagctccttttagcagttattgtagtgctggcttggtagtggcaaattctctgagcatttgtttgtctgaaaaagactgttatctttcctttatttatgaactttagttttgctggatacaaaattcttggctgataattttttttttttttttctgagatggagtcttgttccgtcacccaggctggagtgcagtggtgcgatctgggctcattgcaaccttcgcctcctggattcacgccattctcctgcctcagcctcccgagtagctgggactacaggcgcctgccaccaggcccggctaattttttttgtatttttagtagagacagggtttcaccatgttagccaggatggtcttgatctcctgaccttgtgatccacccgtcttggcctcccaaagtgctgggactacaagtgtgagccaccgtgcctggcctgataatttttttttaaggaggctgcaggtgggtatgcatgctcatttgaggtgttcttcccttattgaagattactaaaatcacatgtgttgaaaagcatttggtattatttacttaattgatgagtacccatttatttttacattaatttgataccatgtataaacaatatataaacataggtatggacatatacatatgtgatatgtgatacagcatagaacatatacttgtgcacataaagatagagggagacagaaatacttcagatttttgattttaaaactttatgcatgaacacataaaactcactgttaaaaaaaatagctggatttaagttgtgcttttgtaaatagaaaaagttaacatttatctgaggaagcccttgctgagttttagagaaagtaggtagtaaatttacatctcaaagcacacacaaacacacacacacacacacacacacacacagagagaaggagtttgggtgtgttcaaggaagattaaaagtagatgccaaggtaacacaaaaatgatagaaatttataacaggattttataaggagaccaattttatttccatacatagcttttattttggtctctgttttccaactttactccaggaaacacactacacaggctcccttcttaagtgctggtgggccactgcacatgcagacagcccactttaagggaagaatcaggggagaagagatgcagaccccagaattatgccaacatacaaaagcctaagtcaaaggtcaaaccacacacttgaaatctcatcacctgtttggccctgttttaagtgtgctttactttctttaatttctgctctaaagcttttaaataaactttcactcctgctctaaaatttgcctaagtctcttcttctgccttatgacacttagttgaattctttcttctgaagaagcaagaattgaggctgctacagacttgtacagatttgctgccattaatatagtttagtgccattctacatgatagaatatatatattcttatatttatatatatatatatatataaaatttatgtattcatagaggccttgaatctacattcttgctgcactttatgtaaacaatccaggtataagactaaaacttattttggaaatatattggtcccatatgatttctatttcataaaaatgggagacaggagggggaaaattatttttcagaaggaaacaacagaaaaatggttattacattttagatctgttcattttttttaaattttgttatttacctacaatttggactgaatcctaaattttttcctggctacaaatttcaaaactaatggtttcagaattttcttccatttttcttccattttggtatattataaattaaaactgtgctttttaaatttttatctttttttaattacacttttaagttctgggatacatgtgcagaacctgcaggtttgttacataggtatacatgtgtcatggtgttttgctgcacccattaacccatcatctaccttaggtatttctcctaatgctatccctcccctagtcccccacccctcaacaggccccagtgtgtgatattcccctccctgtgtccatgtgttctcattgttcaactcccacttttgagtgagaacatgcggtgtttggttttctgttcctgtgttagtttgctgagaatggtggtttccagcttcatccatgtccctgcaaagatatgaactcatccctttttatgcctgtattgaattccatggtgtatatgtaccacattttctttatccagtctatcattgataggcatttgggttggttccaagtctttgctattgtgaatagtgccacaataaacatatgtgtgcatgtgtctttatggtagaatgatctataatcctttgggtatatacccagtaatgggattactgggtcaaatgatatttcttgttctagatccttgaggaatcgccacactgtctttcacaatggttgaactaatttacactcccacgaacggtgtaaaagcattcctatttctccacatcctctctagcatctgttgtttcctgaccttataatgatcaccattctaactggcatgagatggtatctcactgtggttttgatttgcatttctctaatgaccaatgatgatgagctttttttcctatgtttgttgctcacataaatgtcttattttgagaagtatctgttcatctgcttcacccatttttgattggcttatttgttttttttcttgtatatttgtttaagtttcttgtagattctggatattagccttttgtcagatggatagattaaaacttgcaagctgaaactcgacgacttatgtaaacttctggataaatcatagcaacttatatataaacaacctttgtgcctgctgatgtgtggactacacaaaaggtacacatgaacactgtattcagactgcaattcagaaaaatgtgtcacattgccattgcaattggaagatgcttcagaaactctagaaaacctagtctatagggttagagtgatgtttgccaaacgaattgctctaattgaagcagctgttgtgtgactttaataaggttccaggattatactgtcccttttttgctgtgacttccctttgcccttttctgatttgtcttcatccccttttccatggggcatgacttcttaagaatgagccttcctagtgatgtaggatgagatgaaacatacagtcacaaagtcatgtcttctatgatgctttatctgaaagcttttgaagaattggggggccaggtgtgctggcagaggcctgtaatcccagcagtttgagactctaaggcaggaggatcacttgaaaccaggagtttaagaccagcctgagctacaaagggagaccacgtctctacaaaacataaaacaaatcaaattagccaggtgcagtggtgcatgcctatagtctcagatacttgggaggctaaggtgggaggactgcttcagcccaggagttcaaggctgcagtgagtacactccagtcttggtgacagagcaaggttgtgtctctaaaagaagaaaaaaaaaaaaaaaaaggaaaggaaaggaacggggtaaacaggaaagccaaagatctcgggcatctccagatgattccctgaacaaattgttttttcttggcttcaaaacctttcaagatgtatatttctttgtaaaagaaggacatgccaattgtaactttaagtgagcaatccaaatccagctcctaaaaccgaagtattttaactctcattctgataatatttattttctgaggcaaagaagaaagacaagattagatcaattgtttctctgcccactccatctcttccaacctgccttctcccctttaatcaaatgtataaatactaagcctcctgaaacctcttcagagaaaacacaaaccacagaggttttttgcaactcatgtattcccagggtgcactatcaggctctggctcaataaaactcaactggtcaagactcttgcctcagtcagtcattctggataaccaccaggagtcctgcaaagcccttcagtaatctattgcctgcctaggtgatgtgtacctagatgagtcatatcttcatgagccaaacacttgtcttccttttctgtctttcccaaccctaccactcagtgctgtgtgctctgatctgaccccagttcccaggttgtttgtataggtctaagaaagcaagaccaggaggggcaggttgagaaggaagtaagaggccaacagcagtggaaagtggcaggtagagctgtcattgctcaaagccacacacactgggtgcattgtatgaatttttctggattcaaaatcttttccctgtgtgtctatctagaaactcaccctcctcctactttcttctcattacattttctgtttctagtgcacttgtttatgtccagagaatggccatgcaaatagttgacaatagaataaacaatgacgttttgtgagacttggtagctggcctttgttttttccaaaagagattgaggtttctaaaagctagcttttatgcagggctgtgcagttgtgagtgtagttttatggaacaggtgcataagtgaagggtgagatagaaaacaaaatgctggctgtttgtcaaatcctgaaagtgaatgggacaaaaatcatttttgaagaaggatgtcattcaggagaccttgtaaatcttagagtgtcctcttatcagatgaagtggaggatgaggttgaattatggagttaggtgacagtgggtacatacttctctgcctcagttttttttttttttttaatctgtaaaaatggggattgtggtacttgggattttttggtgaggaccgtagttaactggaaagctctcaggatagtgcctggtacatagtgaatgctgcatcagtgtgagctattataattatgggaatagacaaaggtgccaccctggccatccagagtggggagatattttctggtcagagtccaggcaggccagctggagatgaagctgattagtggggacgcttaacttccaggagtggaagaatttaggaggagtaaacagaatgcacaacattctgtaaacattcctttacccaacagtaggaatactcagagtgggtgtgtcttccgtgacaatcattatctcctgggaatctaaaaatgtgtcctagagtcaaatggctttgatgtaagccaaacccagaaatgggcttcagggctgcctggcacatagcattcattcatcttgaaaaaggaaagcattcatcttgctaaaggaatccccttttctggcccaggccattatttttgttttagtactatcctaatttttaaggtataaggagaaagactgaagaataaaataataaagtacgtgtatgaaataacagggtagaattgagactggtacgtgtaagttaagagaaattgtgtataaattttgtgtgaacagaaaaaggatttcttgttgcaaacagacctctccatataaataatacctattgcctcgagtggatagcagaccgcatcacaagaacattccagcagagtcatgagagaatggttagtgtggcttctttaattggcaggttagactgagtaagttactgaagagaaaggagttgaaggagaagatgggtgcgggcaagaaaaatgggaaggtgaaaggaaaggactgaaaggaatgtttaccaagggctcatcaggtaccaggctctgtgactaatgtcttacacatgttaatttactcttccactgtcattttctgatgcagtaagagtcagccttacactgcagatgaggaaagaggctgagggaggtcaaatgagtggcacagggtcatccagccacttcatagcagagctagtgtgtttcactgtggtttgtgccgacagaaaagtgagacatggaaggaaggcaaaacatttttgttgtgggtgatgtttatgaaagtgacccttatgaggcagaataatggcctcttaaacatgtccacatccgggctggatgcaggggctcacgcctgtcatcccagcactttgggaggctgatacgggtggatcacgaggtcaggagttcgagaccagcctggccgacatggtgaaaccccgtttctactaaaaatgcaaaaattagctgggcgtgggggcgcatgcctgtaatgccagctacttgggaggctgaggcaggagaatcatttgaacctgggaggcggagattgcagtgagcctagattgtcccactgcactccagccagggcaacatgagtgaaactctgtctcaaaaaaaaaaaaaaaaaaaaaaatctacatcctaactcttggaacacatgcatttacttttcttggcaaaaacactgttcaaaggtgatgaagttgagtatcttgagaaggaaagcttattctggcttatctgggtggctcccagtttcatcataagggtccttgtaagtgaaagagcaaggcaggaggctcagggtgagaatgatgcagtctgagagactccactggccattgcttcctgtgaacatgtgtgataagacaaaattataactaatttagttatagatgtaattggcttttatttgtgatttatgatttggggcagctctccctctacagatgcctcagcatcccaagtagctgggactatattgcgggatctggcctgcagcctgcaatgcaatggggctctttctttgttctcaggcagatcggcaggttgagaaataaaagacacacacaagatagtgaaagctgggtccagaggggtcaccgccttctggtcctgcgatgctgccaatgcactggatataccagcatttattattaagtttagtgagagtgggggtaggttagtgagagatttagggccatttataggctctccacaagggtcgcattccattcccagagctatggacatctgcttttctgggataggaatcttggtaatgtgaaacctccctgactgcatgtccgttcataggctctctgcagggggaagcacatcacgtgctgttggctcattctggcagtccaacctggcatttgtctttacacaatcctgcatgcaatttcgtatttacaataatcaggagcatttcatcttttattccatagcaatagtttcagggggtctccctacatctcccccttttctccaatttaaatgaaccatagcaatcatagcttggcactgatcacgattggattgaagaatatttttttccaattttacacatgaacaataaaccaatagcacaaattatacacagaacaaaattaacgatagtggatcctcccaaagattttacctattgaatggggttgagattagataacccctcagagatactgtctaaaacttcagcactgggtaaagcagttaagtgtgcttgagaagcttcaaaaatctgttcttttagcttgcttaagtctaaacttaaattatcttcacttccttgtaaatggcattttactgattcccagttgtgaacagactcattatgttggaatggagttatacaaaaatcagaagtattccaatcaggttgcatttgtaatctatgttctaaactcataattctatctcccatccatgtaacagaagcacatcatgtgctgtaggctcattctggcagcccaacctggcattgtatttacacaatcctgcatgctcttttatatttacaataatcaggagcatttcatcatttgttctgtagcaatagtttcagggcttctccctacaggactacaggtgcgcgccaccatgcccggctaatttttgtatttttagtagagacagggtttcaccatattgaccaggctgatctcgaactcctgaccttgtgatctgcctgccttggcctcccaaagttctgggattacagatgtgagccactgtgcctcgccaataattaacacatttctttgagtttttgtaattccagcacaagagaaaccatttgatatttgaagaatggctgcacaccagtgaaaacatctgtagattgcaccacacgagggagactaccagtatgactatcaggaggaaaatatcaagagtttggaatatgcaccttaggcaagatgcaaaccaactacaataggatagatcaaagaagaagccagaagagtctagtcattttaactaggcagcacatttaatgatttttacaactgagtctgtaatacccaatgtatttatccatgtgcaacaagaagcgtcagaaactgcacaggctcccctctgttcagctgatagagagcaattctattatctagcattgcatgtctatgttaaattaaaacagggagcgagaataggcaagtatagaagtggaagcctaaaaaaaactccatacatttgaggaaaacattgtgttacagatgcagctaatgtcagcctttgggtggactaaaggatctcttggtatgtaaaaatgtgtgggccaggtgcggtggctcacgcctgtaatcccagcattttgggaggctgaggcatgtgggtcccctgaggtcgggagttcaagaccagcctgaccaacatggagaaaccccgtctctactgaaaatacaaaattagctgggtgtggtcatgcatgcctgtaatcccagctactcaggaggctgaagcaggagaatcacttgaacccaggaggtggaggttgcagtgacccaagaatgtgccattgcactccagcatgggcaacaagagcgaaactccatcttataaaataaaagtgtggttgacatgatatatctgacactgttaacttactctcagaagctacttcttgtgaaatcctaagtacagcattattctgggaagcaaaggcgacaggcataagcaaggacaaattaagagaggtaagattcccatcatgattgatagtcttgttctgacatcttgagaaaactgtccacagtgtaaagtcatcaacttgttgtcttggtttgcagtttgagtgtctctaagttatggtgttgaacatttggtgagttcttagcggcccacacctcagacatgagagttttctcatgaaatttacattgagttgtccatctccagcttatatggcttcaggaacagagccactcttgttcttaattatttcattggagaaaattgaattggaagaactaaaagaattcagggtccagtccagtctaccagtggattataaatactcaaagataatgaacagtggttcaatctggtaacaggtgtactacagttctgcttttcaacatagtttttctgtctataggagtctctatttttaccaaagataattccagtaggatgaatttgtttgcaaaataggttgagtctcaccgaacttgcccagactttttacctaagtgcggcaagagtagcaatggaccatagaggctctttttaaacttcgctttgctagaagtttttaataagaatctcagattaaacttccaaaaacctcttgagactaggaagccaaaccaagggcaacttcagactttgcctgcattccctatgggtttattctatgtatattctcaaatataacatcccagtcaaagccttggtaatataaccgatgttttcaaatgtgtcctgttataaagagagcagatccttactgaagttgtgcaaataactttattaccataaacatatgaatactcatgaatagtttcccaattctggggcactcagcaaaagcaaatgtttcaatttttgtttacaaaagtatactttaccaattgttcaaggaaaaaagttcataaatctggagaataaaacattcaaagactcagcacattttcaaatagaaaattatgaaaacattatccttttgattatttattccaataaaattgagttttttttcttctttgtcttgaatttcatgaaggtatcagcctgttcattaaaattttgaaagttcttagtccagtggtatgatcttgaagttatcaggagcttgtattccagagtccttgtcagagtcttttccataaatctccttgaagaaaaagcaattttggactgtagctgatggtaaatactttgaggaagaatcaaagcaactgtctgggaatgacaaagatttaaaatgactatggttaaaaatctaatgagaatttattatggtaaagacacagctcacatagaaatctagttacttctgtggcataagacactatgataacatatttgatttccagaaatttcatataatttttataatactcattaaaaaaattttttttgagatggagtgtcactctctcacccaggctggagtgcagtggtgcgatctcagttcactgcaagctccgcctcctgggtccatgccattctcctgcctcagcctcctgagtagctggggctacaggtgcctgccaccacacctggctaattttgtttttgcatttttagtagagatggggtttcaccgtgttagccaggatggtctcgatctcctgacctcgtgatctgcccacctcggcctctgaaattgctgggattacaggcgtgagacatcacgcccagcctagaatactcatattattaacattcccataaatattatttagagaaggtttagcatcaattatcccttatttgaaaatgctttctataaatttaatatataaaataaggtggattttccgttcagcttctgtttctcaagaggattactgagttgttggtgtagcccattcataaataggaccaaaaaagtatagtcttatgtatgttgaaaaaggtccttaggtaattccagtacttccagcagaaaatcattgatttagttttaagttctacctattacaataagagttctccatccttgttacatgttagtagtgtcagggaagacttaaaaattaccaatgcctgggtccgtctccagacctttaaactggaactaatgggtggggcttgagcatccacttttaaaaatgttttccagtgattccaatgtgtagctctatttcccatcagatttctctgatttcttgtggcattcaattttttctattttggtatcatgattattttcaggtctcatttcctgtcttaggctttatgtctcctggcgtagggaccttgccttcttcatttctgtatcttttttaaacacatgaactggtcatcaggaaaaggtctcaaccacacataggttgtgtcctgagtctcaggttcacatgttaatcctaaagtctttgttctccacgaggtcagatgttgcttgtgatgaagggtgtggttaagtctgcagtgcagatggtggaagggatttcactgtttttagacatagcattggaactaagaattttatgtctatatgggtgaaggggcagggatgtgtaggaagacagttctaattaggatgaaggaattatactaggaagtagaggtaaaggaagtgagaaggcttagtaaatagaagaaatgtgaacttatcaaagtggctagagtagaccactggagattcttgattaagtgaattaactagattttagaaaggtaatgaggcagtcatatgcaaggaagatttcaaagtctggagacaagaagtcaagcaatactttgagaagtggttgagctttatgggaattgagagaattacagtattgagagatgttaaaagtaacgaagagggtttcatcatgtgaaattgtgtttctcatttgaatctgagaaacaaatgagcagaggctggagataattatgtctaaaagacagtggggtacagggagcataaaggccagggagaaagggaactgtaggaattagtgctgagaagcaggagtttagtggaggaaggaggagatgcagtcccagatacaagcaaataagtcttttccctctcccaagcatggcagtcagccctgcaggaaccaggataagagaaaaggccatcatacctgccagtcttcctgaaatacagaaatgacatcaccgctgctctattggagtaaagaaaggaagacgtcctattcctggaggagctgtcatggaaagaaaagaaaagaaggaatgaagatgatgttattttacatgggggagcttgaggaacaggcatgtagcatgaggtactctataattgtttcttcaaggactacattatttctgttggaaaattgatgggagatgattatattcttgcagttttttttccctcttaccatacttctaggttggtgatcagtcctctgtcaattctctactgcactcagatattttggaaggctttcagatgtgagaaaggctgattgctattttctatgtcattagaacttgccacctttgcacctttccatggttgcatctttttctcagtgtctctgttatggcagtcacgaatgagaccctgccaggtctccatggcaggcacctgatttacagaaggcccagatcagtacatttcaaattcaccacctcctttgcacagaaagcttctttcctacaggctcccaggaagggtgtgaaagcaagcctagttctctgaggatctctttaactccaatgggtgactggttggaggattccccatcagccttgcaaaaactcttagaattgcattggtacctaaaacttatttctctttccttttcacaggaatcagccctggatagtggtctgtgggttctcccatactaccttcatgcctgccccacattccctcagaggtgtcttccctgataaattatcttgtatgtctaatcccatcttggatgcatctcaattggtaaaaactaacataccaggcttgattctttgcacttagctttttttctttctctcccacaagtagtcagtagccatgttctagtgttctatgtgttacctctttttccatatgtatggaaaaaggaaggtactgttgaggtgcacttcctatgtgccaggccctgtgctcaatactttacctgtatctcatttaagccacacaataaccctgtcaggtagacattatttccattttggcaatgaaaagacagaagcttagcgtggtgtaaaatctttcctggtgtcatatggctagtgacaggtggatctgagatttgattctaggactatttgacctcaaggctaatgataatggtagtaatatggtagctgacattggttcctctgtgtgtggcatcttgtttcattgactgtattaaacctttaaaagaattgtatgaagaaagtagcctcattgcagttttcaggtgaggaatcagaggttcagagaagttgagtcttgtgcaagaaatttataactgtaaactcttacattaaaaaagaagaaagagctcaggtcaacaacctactttaatacttcaggatatgaaagaagaacaaactaaacccaagcacagtgaatgagggaaataataaggattagagtggatataaataaaatggagaatggaaaaataatagaggaaattactgaaaccaaaagttgattcttcaaaataaaatcaacaaaattgacaaccattaactagattgactaagaaaaaaagagaaaagtttaaaattactaaaatcagaaatgaaaatggactctgagcatggtgggtcgtgttttaatcctagcactttgggaggtcacagcggaaggatttcttgagaccaagtgtttgggccagcatagttaaccctgggagatgctgtctctacaaaaaataaaaaaccaattagctgggcatggtgacatgcacctgtagtcctagcatcttgggaggctgaagaaggagaattgcttgagcccaggaggttgaggctgcagtgagccatagacacaccactgtattccatcctagggtggcctacagagtgagagcctgtccctctctcttcaaaaaaaaaaaaaaaaaaaaaaaaagaaaaatgaagcgattactaccaattctaataaaataatgattatgaaagtagtataaataattgtatgctaataaattggataacctatatgaagtagacaaactcttagaaacacacaaatatatgaatagaactataatcagtaataagattgaatcaataaaagtaattgatgaaattcagtattttttcataataaaaacattctaagaatggaaggaaaccacctcaacataaaggcaatatgtgaaaaacccaatgctaacatcatactcaatagagaaagactgaaagctttccctgtatgagcaggaagaagacaaggatgcctgcttttgacacttttattcaatataatattgaaaggtctagtcagaaaaattaggcaagaattttaaaaaagacattcaaattggaaggaaggagtaaaattatttctgtttacagataacttgaacttatatgtagaaaatcctaaagatggaacaaatctattaggactaataaataaattcagtaatgttgcacaatacaaaatcaacattcaaacatcagttgtatttcaatacactaaccatgaacaatctgaagggaaattaagaaaaaaaaattcaatttctattaacatcaaaaagaataaaatatttaggaataagtttaaccaaagaggtgaaatgattatacccgaaatctacaaaatattgctgaaagaaatgaaagaagacatcaataaattgaaagacattttgttttcatgaattggaagactcaatttggttaggaggacagtgctacccaaagtgagctgcagattcaatacaattcttatcagaatctcagtgacatttttgcagaaaaagaaaaatctgtcctaaaatttatattgcatctcatgactctaaatagacacacagctttgaagaggaagaatgaagctggaggactcacacttcctgatttcagcatttactacaaagccccagtaatcaatacagtgtggtactggcataaaggaggacatagaaattaatgaaatataataacctagaaagaaatgcttgcatatatggccaaatgattttcatcgagtgtgccaagatcgttcaatggggaagggacagtgttctcaccaaatgatattggaaaagctggatatccaagggcaagaagagtggaacctttacctaacaccatgtgcaaaaattaacccacaatacatgaaagatctaaatgtaagagcaaaaactatacaactcttagaagaaaaggtccatgatactggatttcacaatgatttcttggttgtaacaacaaaagcataggcaacaaataaaattgataaattggacttcacaaaaatcaaaaccttttgtatatcgaagaacattatcaggaaggtaaaaaggcaacccatgaaatgataaaaatatttgcaaattatatgtgtgataagaaattaatttccagaatacatgaaaagctacaagtcaacaacagcagacatccaaaaacccaattaaaaaatgaacaaaggattaaaatggagttttctccaaggaagatatacaaatatccaataagcccatgcaaagttcctcagcatcatgaatagttagagatatgcaaatcaaaaccacaatgttacaccacctcacacacttgatgggaatgggaaatgttatagccactgtaaaaagtggtgtggctgtttctcaaaaaattaaacaataaattaccatttgatccagcaattccacttctggacatactccacatagaattgaaagaaatttgaagaaatatttgtactctgatgttcagagaagcattactcacactagccaaaaaatggaaacaaccaaaaagtccattgaaagataagtgggtaggcaaatgaggtgtatctacaattaaaatgttattcaaccttaacaaggaataaaattccaatacatcgtgcaaaatggatgaaccttaaagatattatgctaactgaaataagccagacacaaaaggataattatcatataattccatttataaaagatagttagaatagccagttacatagagacagaatgtagaatgttgtgtgctaagggttatggggagaaggagtgagttactgttcattgggtacagaggtttaatatggtaagaggaaaaagttctggaaatggatagtgtgatggttacacaacactaaattgcacacttagaaatagttaatggtaagtcttatattagatatatataaagtgtttggtagtcttaccctctctataattacacactttttggcactgcccctttcctgcgatgcagagccccaggggtgaatctccctatttctccagctctgcatcagtcactatcctccgtgctgtgtcccacatgctgtgcccacagcctcatacagccggtgacttcagagccaggacgcagctcaggagtctgccctgaggctccctctcttcttatttccctgcagcctggcccgggggaggcttggcttcaactggcagctcgatttagccaaattcaggacaggccaccagggctctttctccacacatgctggtcccaccccaggtggagtcaggcagggccagtcaccagaggagcctggagcagagcaggaagcagagtctgagctgctcctccctcacccaaggggcttccccgtctcatttgggggaacagtgtgagcttgtttcaaagcctcagatgttccttgtagctcatggaagaggtacaagaaaacaaagacgtggcagaaggggatgtgttggtgacatcgagaagcaacttgatcttgaggactctccttctcatccgtctctgaagtctcttctaccacatagggctcagggctgataaagccccctccctaactttcttaggccagacacaaggtcagccatgagaaaacaaaaacaagaagagagtctgtagagacaaattgggagggttcaggaggagaatttgggatttgcttgtgcccatgggacacaggctgggaataaaaatgttttcctaactcttctctgaaagccagatagactccacctaaaaccctattgccaaggatgctgggatccacttaccagagacttcgactgtcatggatttggagctttccttgccagtggctgagttacgaacagagcaagcatagagccctctatgctttgtagtaatttgggggataaagagcttttgttctgattgctgaaacttcccattaattgtccaagagtactatgccggtgggttacattccgcgaagcaggacaagtaaaggttttgtcctgaacggtaataggtgaatgaagggtaaattctggggaggtctggaccatctggagcaaagagaataaagccacaggtgatgtcatccgagggaaggggatgctcctggtctcttaaagggacacagtgaccctctgagccaagacacaccttcaagtcccagccgaaccccctctatgttcactgagctgaagcctgaggtattcacctgtttctccccaatcacaagctatgggcaccaagtctcccatgacaagagcgtcccctccccttatattcttggttaaggctgtgcctacccaggatttcccagggcagggagtcatggccagctcggatgtccagaagtaaaggtgtctatacttggaccggagaaagactgagaggactggcttgtggtcatttagagttaagctggtgtcctggcccacagaggaacaaaagatactcacagaggacattcagggtgactgggttactgcggatgccaccatatcggtcccgtatttcacattgatagggtcctgtttcatttctcgtgacactgggtagaatgaggatcctgttttcaatgggtcactttaccctgggactgactgggaggctctgaccatttagccaccacgtgtaggtgtagttctcacttttagggtcacaggtgaagggtaagacatccttattctccctgggttttgagttgttgatggtgatgtagggcttgggcagcttcgctgtgtggataacagagagaagattgtcctgtgtgacacctttgattcctccacaggcatccctcaatcagagttggcatctcccacctgtcatcccacgcgagtccttgaaagccaatagctggtgcatgtgtcacaagacagatgtatgatgatctaagggctcaaagactgtgaggccgcctgctctgtcttagggaagcatagactttctcaagtgtcaattgagcagcagtgttgggtcatggacagacacatcagtaggagtcacagcccctggtacccctcccagtccctccctaatcagttgactggctggctcaccttgggttccttacctggaatatgcaactgctgggccccttccaaattccatcctactttgtccccctagacgtgatttctctgcagcttccatttccaaggacattctagagatgagtaataatgggacttcccattgtcctgaaaccctgaatatactgagcagcctggcctgggactggatgtttcagcaaaaataagacagcagagaccatagtcaagcctggaggtcagttcagtctacaggcagtggaggcaaaaggtggggcagttttttgcaggtgtttcatgatgacttacttgaaccagtgacctctaaagatagagcagagtgcaaggaatgatctagaaagagtgaaggggacaggcaagagctggaggctttggagcagaaccatgttgcctgtcctgcgttcaagtttcctctccttctgcagagggcaggtgaggaccatgtggatctttccagaaatacatgtggacatttgcatatgcagaactgattggtggaaagggtgggaatgaactgctggaaatctggtcctcatggaccatgtgtgtttgatggatatgatacaaatttagagagaagttttgcaaatattttatttcattggacattctactctctgattccatgggttcgactactctagggacctcatgtaagtggattccagagtgaatatgagaagagactgctggtttccaggagctgggagtggggagaatcagaaattgttcatgggtgtgcagtttcagttatgcaaggtggggaggttatagagattggctgtcgagcttgatacctatagttcacacagattgagtatttcttatgcataagacttaggacaaaaagtgttttggatttctgacattttttgattctgaaatatttgtcatatacttactggtttagcatcccaaatctgaaagattcaaaatctaaaatgctccagtgagcatttcttttcagcatcagattagtaggcaaaagtgggaggtgataagccaaagatattcttgccctttttttttctctcaccacatttctagcttggtgattagtttttggtcaattccatactggccatgctgcactcgtatgtttttgaaggttttgggatgtgagaaagcctgattgctattttctgtgtcatcagaactttccaccttttcatggctgcatcatctttttctcagtgtttgtgttgtggcagtgattaataacagcctgtcaggtcagatttaggacagagttttctgattctgcaaaaaattttactgcgattctgctaggggttgcattgaatctgcaactcactttgggtagtattgtctttctaacaatattgactcttccaatccatgaaaatgaaatgtctttccatatattgatattgcatttaatttctttcagcaatgttttgtagtcttcagtgtataatcatttgacctttttggttaaacttattccaaaatagtttattccttttgatgttaatgtgaattgaaattcttttcttaatttcccttcagatagttcattgttagtgtatagtgtaaagaatgatctagaaagagtgaaagggacaggaaaagctggtggttttggagcagaaacatattccctgtcctgggtttttgattttccctctccctttgcagagggcaggtggctcttccctgatagctagatagacttcactggaaaacatattgccagtcctccagggatccactcaccagggactatgatcctcttgattatgagatttgttccaccaatggctgagttatggatgaaacagacatagacccctctatatgttttggtgatttggggtataaataacacttgtgctgattgctggaacttcccatcaatcagccaagaatgctctgctagtgggtgagagtctgtgaggcaggagagcttggggacttcccttgtatggtaataggtgtatgaggaagaaatggtgggggcatccaggccatctggagcaaagagaataaggtcacaggtgatattgtcagagggaagggaaaatcctggtctgtggaagggccacagttgccccgtgagccaagtcgcaacactgaagtcccaagaaaatccctgctgtgttcactgatctggagagtgagacattcacctgtttctcccatcacaagctctggaccatgagtctcccatgacaggagcagcctcttttctcctattgtggatcaagcctaggcctactcttgttttcctggggcagaaagtcatggccagttttgatgtccagggataaaggtctctgtacttggacctgagagggactgagaggcctggcctctggccatgtgtatttgggatggcagcgtggctcacagaggaacagaagatagtcacggaggagattcagggtgaatgggtcactgcggctggcactcactgggttccgtatttcacattcatagggtcctgcagtatactttgtggcaccaaatataaagagggtcctgttggttttggacagctgcaacctttgagtggtagggaggttctgaccattcatccaccacaggtagcttgcgttcggagttgcaggatcacagattaagatcacagcctccatgatctccctggggtttaatttgctgctggagatggagggcttgggagtctccactgtgcagaaaacagggagaagattgccctgtgtggcacctttgattcctccaaaggcatttttcaatcagagttggcatttccaacctctcagcccacccgagtccttaaaagcccatggcaggtgtgtgtgttacaagacagatgcatggcaatctgagggctcagagattgtgaggctgcctgcttcatgtgggagaagcacagactttctcaagtgtgaattgagcagcagcattgggtcatggaaagacacaggaccagcagtcacagcccctggtgcctctctgagtccctccatctccaactgcctgcctggcccaccttttggtcctcacttggagcatgcagtgctggaatcttcttagcttcagtcttactttgcccccgaggcatgttttctctgcagcttccctttccaaggacatcctagagatggatgatggaacttcccattgtccttaaaccctttgggtactggaaagcctggcctgggactgggtacttcagcagaaataacacaggggagaccagagtcaagcctggaggtcagttcagtcatcaggcagtggagccacaaggtggggcagttttcccagatgtctcatagtgactgacttgagccagtgacctctaaagatagagcagagtccaaggaatgacctacaaagagtgaaggggacaggcaagagctgatagctttggacgaagaccacgttccctgttctgggtccatgatgctcccttccccctgtagagggcaggtgaggaccatgtggatctttctggaaatacatgtggatgtttgcaaatgcagaactgactggtggaaagggcaaacatgaactgatgatggaagtctggccctcatggaccatatgtgtttggtggatattagaccaatatttgggaagaagtcttgcagatactttctctcattagacattctactctctgattctgagtttgactactctatgtacctgatatcagtggattccagagtgaatcagagagtagaatagtagtttgcaggagctgggatcaggggaatagggcgttgttccgtgggtgtgcggtttcagttatgcaggatgaggaggttctagagatctcctgtgcagcctcgtgcctatacttcatgcagatacagtgctccttatgcagaaagcttaaaacaaagtgttttggatgtctaattatttttttattttggaatatttgcagtacatgtactggtttagcatcccaaatctgaaaaatttaaaatccacaatgcgccagtgagcacttctttttagcatcacatcagtggtcagaagtgttgagttttgagcatttcagattgtggatttctggatttcagatgctcaatttgtaatactgtaattttcccataaaaagttttcaggactttagacctcatgttatgttctgactctagtaacaaaaaaaaatttggaggaaacattgaaatgttttcataagtgggaatttttactgatggtccaaacatctgagatcaattgctggtagtagtatttctcttgaggccaacataaggtttaggtgtgccatgaattccagcaggatcacattatgctcaaagaaagatgccaaaggtgatttgaaattagcaactccttaagtagagagagtcccgttaaaaggacaaaactgggtagtgtgtcaattacataaagggaggaatgatgccaaattaaaagaagtgatgtgtgttatgttagtaaatatagaaagaactccctgcttctgctttctgtgccgagttaggaaaaatcgggaggagcacaaagcaggtatgtgaaatactttcttcgttctctcttaagttcaggaaataacactagagtttaagtttgtgtgaattaggaagagtctaagtgagatgccaatggctcgtgtgtctccccacaggaagaactcgaacttatgaaagcagcatcatcatgaggaaacagttgtatgtggcacaggcagtaataccatcagatagcacccacctggccacctccagctggtccccaaaaccaccagtattcccattacatgtaggttacagcctttgtagttgtcccacaacaaagaaatttaaaaattgctattgtcaaaacaaaatattaaatatgaaggcgaatatgttgttccactttttttccccactctttttgacctttcttgtttcagttttggaagtttctattgacacatcctcaagctagggattctttcctcagctctgtgcagtctaccagtaagcatcaaaagcattcttcatttctctaacagcattttttattttctgagacagagtctcactctgtcaccccggctggagtgcagtggcatgatctcagctcactgcaagttccgcctcgcgggttcatgccattctcctgcctcaacctcccaagtagctggcactacaggtgcccaccaccaagcccagctaattttttgtatttttagtagagacggggtttcaccatgttagccaggatggtctctatctcgtgaacttgtgcccgccttggcctcccaaagtgctgggattataggcatgagccactgtgcccagccatctctgaaggattttaacgagttgttgacttttgagtttgttcagtttttacttagcgttagaaccgagtgacaaatttcaagcttgttatatgcctgacaggaagccagaagtctctaggaagtgactggagaatgtgagctccacagcaggttgaggatggagtcacgagtgaaatgagcccatgggctttggggactgcaggcctgtccagcctctgacaccctggtgagtcagagcaaagattacaacagtgacaggaaactagcgtggctgactccatctggcatctagtctcaggctggctgtcctcactcattcctgggcataggccaggctaacattgggaggaatttagtttatggtttaactttgaaacaagaaagataatagtacctccataaaactaacacccttactttgcccaggggctgcctttctaaaactagtgaaagaccatgagattgagattataggagggaaccgaattctgctacaatgtaggcacagtttctataatccctgactgatcaaatgtcatttggccagagtttacaaaatttgtaactaattgctcccatagataacatcactattgcagaacgtgagattagtcttttgagatgtttttcattcttttgcattctggcaactggctgacctcatccatacccatgactaatggctcagccagccatgtggtccctacctagaagtggattcaagcacaaacagttcatttccctccgcccgcatgattccatcaccaaacaatcagcagtactcattttttagtcctgtgtccctgaaatcatccttggaaatgtctaacacctgatccactggggaggctgatttgagtaataataaacctctgtcctcctgtttggcagacttggagtcattaaaatctttctttactacaaaccaccatttcaataattttttttttgtgtgtgtgtttgtgtctgtgtgtgcagaaggccagaagaacttgtctggcaatgataacagtggatggagaactgcctatccctgtcccatggtcttgtccacaggtcagcctcacaaagggaaagagccctagatgggaatacattggaagctcattctcttagtgacctggggacattggctggagataaagcccggcaggagtggcaactccaggtgatttctacacctttcctatttcctgggaggtgggccaggccacagtgttagcaggaagggaacagaactgccagactaattagagggagtgtctggggaaggcctaggtgtggaggaagaagctgtgcaggacagggcttgccagtcagaatgaagtgggaggaagatgagggacacagagaagcagagagaggcagagacaccatggcagtgagcagtgagggagacactgacttcagagaccccaggtaccaggtgcccccatttcctcagtccaggaccaaggagccctgagaaccctccggtggccaaagagcttcagagttgcatgaggtggggtggctttaggggcaagaggtagtagggggatgaaacatgggtgtcagcctctgaaggacaagggacaggtgtggctaggacctcctaggattctgcatccaagatccagtctctaaagaggttttggatcattcatttcttcatttgattccttcatttgttatgtgagagctcctgagtatgtgtctctggctgggcctgtgctggtgcagggtgtgagtggggaaagaaaacaaggtcctctccttgatcctctcatgacagtaacatggacactttgggaaacacaggatttcaggttcagtgatgggggttaagatctgagggggaggcctggacattttttttgcactgactctgatggttgaggcaggtgatttagttctggagtacagactaatcagctgaccatttgctctcactcctctgaggtttggatgcctaagaagagaggatttgagccaataaatgactatggggtgcttgaaacccagtaagccctcacttctggtggaggagaggatgggcctgtggctgcagacagacctcatgtgaccctgatctcccctttgggtttgtgtgactctggttcaaagactgtgccttcctgtgcctctgttttctctcaatcaaataagttaactggcaaatggactgtggcttttcatgctatctgtgaataaatgttaaagtattcacagtcacctgacttaatgcttggcacagtggaggtgttcacacaaacagcatttattattaatttgcttccatgagaaagcacatttatgtcagatccctgtggacaagctgctaccagttacaccttctctcttctgtttctgcttccgggaacattagactttctatggactgtcctgagcctcccaaggcagttggctgatggcctacaaagcttgtctttctgtcctctccactctgaatgtcaggtgaagaaagctctgtccttgcccagatgaggctctgagggctgagccctagctggtgaacagctgcaggagacacagtcctcagacagctggaaaacccttggtcccagtaagccctgcccaagaagccacaacccagccccagtacaggctccttagatttatctgcagcaaggatttagggacaagggtctggggttgaggcttctagggctgagcttctctgagagtatctcaggtggcctctcaggccaagccctactcagttatccagggtctttctcagggtcaaatttatgaagagggcatgaggtgcctggctgagactgatctcctcctgctgagtccccccatcagactgtccttcctctgcagcgagtgtctgcagggtctggatgtgggaaaggaattctgatctgttgaaatttgtctcctctgtgtgtgtcctgcactaaatgcccaaactccagcatgggacataatgcagagggggacacaggcacagtccaggcctgacaatcctgtgtgtgtgaagtagaagtgacccctgtcccccaacacccagggatcatgtggaatcacttacggtataaggtgaaggtgaaatttccagttactcctctagtcccatcacctcgctgtatgatgtgtaaggtgtaggatactccgtcctcccgggtgacattctggatcagcagggatgcattggaatatactgtttctcgtccactgtatgcaggcccatatgtaattctttgaccgtctactacatatgatgtaatgtaatggtagaggtcccttatttgccctttctaccacatgtaaccagtaagattctggggcaaattgtggacaagtagaagaacatccttcccctcggaaactttgggtggctgggcttcagtcgtgacttgggcaatggtaggtgggttccagaagtttaaaagtgatgctaggaggtggagagagcatcagtcaatattgagacctgtgtattggtgtgaaaacatggggccctgggtcctgagaaggtctcttcagtcctcagccttgacaacacagacacacacacacatacaaacacacacacacacacacaaaagcggcatgtgtgattgtgtgtgtgtatgtgtgtgtgtcctactgtcctactaggtcaaggtcagcagcatgacgcccattccttcaacacttctgaccttggcatttttctgtttggaatcctcttccccaggggtccgcatggccccctccacactgccctcaggtcctgcttacatcagggcatcgttagacttctttcctgatgcctgcttcagagaccctgggtcttccctttctgacctttccctgctctgctccctccagggttcttgtcaacacctgacctcacattctagatctctttgcatgtctgtcttcccccccatgacagcgtgagctccgtgaggacagggacttttgtgatcttggttgcaccccagtgcctggaacaggctgcagactcctgtagatgtgagagttctcagggccctccatgccctgggtgttttttttctcccaattgttgaggttttttgctgaggacagcatttcatgtcctgcttatatttttatttgaagtgtcatctgatatagttattattatcatttttcaaaatgtgctggcctctgatgattaatcaggaaaacagaacacttaagattttcctacctcttaccaattccggttcaatgtgactttcctattttgacccctgtccctctctggtgtattttcccctatccaggcatcaacagagcgttctttccttttttttttctttttttctttttttttttttttgtgacggattctcgtactgtcgcccgggctggcattcagtggcactatctcggctagctgcaacttctgcctcccgggttcaggtgattctcctgcctcagcctcccgagtggctaggattacaggagcacaccaccatacctggttaaatttttgtatttttagcagagacagggcttcactgtgttggccagactgatcgtgaactcctgatctcctgatccactcgcctcagcctcccaaagtgctggcttctttcattttttagaaccccatcctctccaggagaccccatccagtcactctgcttcctcctcctgtcctctcccaggaagttctctcctcacctgtgagcaggacccccttccatttgatgtgctgtgtgcagggaggggctgagaggggccccatggtctctgctgcttgtgtgttctcctctgtggagatgagcctaggttccagaaacttcctgagcacggctgtaggctgtgctgtccttcctccttctgcgctgagcctcttcctggggcaggagcacttctcaggctcatgggtggggttaggcccaggacacctctctgtcccctcctctctacatcctgcctccttgtccctccttctgtttttccttttgtctgtgtttcaggtccctgggaattgtggaggcctctgcctttttcagcagtgattctttcaccaaacctcaacacacactttgtgcagacacaaacacacacagacacacacccccccccccacacacacacagaagagacacacacagacccacagtcacacacataccctgcaggttgggcaagcagagtcctgggcctcagcctccaggtgtccccatgggtcttggttgcggtgcacattcatgccctttgccctctttcatccccatctggctctcccttgcagtgcaggaggctggagctgcaccaggtccctgtcacagtgatgccccattgtgctgtgtgtgagctgtgtgttgcctggtgagaaggacccttcctttctctaatcgtgtctagcttggctgcagcttccaaggatggacattgaggacctgggtgtcacagaggaaagtgtcctacctggaggtgtgcagggtgaatctctcatgcctcttgggaggagaggcctgtgctggttgctctttgggggctgtgattcccatagtcaaagggacagttcttggtcagtctatggctccctcgggtctggcggctgagctgaagctcaggatttctcatgttcttcctgaccatctttgatgtcctctcttctctgcccagctgattgtcctgtggtcaccacaccttccccctggtggtgcaggaggaagtggggagtcacccaggaaccccgtgggacatggctcattgagacgcaggagggggagcctgggacagggcaggggttagaggtggagagattcatcccaacttactccgtggccatgatgggctcagccctccatgtgctgacatacccaggggtctatcctgagggttttgacctggtcaagctgctctctgtagaggaggaagaggcagtggccagagagcctgtctggagggaccttgctcacacctgagagggtgtgtgggggtgagttgtgttctgggatcaaagagcaataacaccccccttctcccagcaagcacacaggagaggtctgtcttcccaagggacagctgggggtaggtggccacatcccggatggtgcctgtgtgtgaccatcacacgcactctgagcaccccggggtgcagcgggcaggcaggtcacagggtgcctgactgattcccggggaggctgtgggtcctcaggcagccgctgttctgtgtcggcgctaggcttggcctgggatgccccagagaagaggacagatggagcaggggcgggtatttagagagcagtgacagaaagagttgatgaggatggagggaggccacgaggggaaagcaccccgtgtagcgtcgcgtgcaccagtgctgccctgggagatgcctttagctgggcccagggaaggagcaggtgtgtggggaggagctacctgtagggggagtggtgttaggttggtggccaccaggtcagggaggagctgacagagtccgtgtggggagcatggagagagctgaggacttaggccgaagtgaccctgatgagggtggatcctgctgggctgtgggttccgctgagggaggttggcatcccctaggaaggctccagggtgggagggactctgtcgccctctggtggacagggagggaagtgtgaacggcagcaatcccaggccaggctgcatgttttattccacatggatctgcacacttcacactaggtcacacatatgttatgttacagctccatcacccttccagccccgtgagtcccagtctctgtggctctatgttcactgttctccctttcacaatcagatgtcccaaacgcagatttttgtcactttctgtgagttcgtgtttgtatgcagtaggcggcactgtatataccctgggggcagtgatgtctagggctgagcagtgcacgtgggcttgggaggagaagagggagcagcagagtgggaatatcaatgtcagagggacagggacaagtcactttcattttctcactcccagggaccagaacccaggattctgactccagggcacagtaccacaccttgctggtgtccctggatgtcatgatgctcatagtgtcatgttgccttggcattcattttttaaggtgtaagtttatttgcctcaaatcagaggcagggcttggtcaccatggcagttttcaatactgtatctggttcaagtggctccagttggtgtccagagatcaaatcttagaggcatctctcctgcttggtgtgctgggctctcctctctccagctgctttctttaaactgataattctgacattcaccctcacatttaaagtgaccacctctcagtcacagcatgagctcctggtcccagtgtttgctgcttgctttgaacacatccattaaagctccctgctggaaatctgtcagataacaccctggacttaataaaggcattggcttaccggtctcttctctcctccctgcctgggctcactgacctctgtgtctgtggtctccaggtgtgccaagtgctccccagtgtctgtaagtagtaaaaatacttacactttcacgttgtggttgtattgctgtggcctcacatgccatccagggcctgacattgacgctgccttgtgggacctgtgctggctgagcccctgctggagctgttgttttatggtctctggttctgctggggacaggagcttccagctaacttgattgaaaaactgatgcctttcattgaaaacactgggtcagatgatgtattcatgggcttcagctgccataacaaacaccttagcctgggtgaattaaataatagaaatctatttttcacagttctgtgaataatgtgctattctaaccactttaaaatccacaatcaagtgaaattaaccacacacacagtgttaaattaccatcaccactattttccctagaaaatttttatcattttaaactgaaagtttgtatcttttaaacaataactccctgtatgttccaccctagaccttgatcatctctactctgtctctatgaatttgcctattcttgatgtttcatataaatggaattatacaattatgttatttcatttctgacatatttcacttagcataatgtttccaaagtccatgcatgttccagcgggtgtcagagcttccttcctctttatggcagattatcattctgttgtatgtgtcaccatatttgtttattcatgtgttgatgaacacttggattgttttcatattttatcttttctgaataatgctgcaatgaacattcccatgcaagtacctgtttgagtccgtactttgggtatatacctaggaatggatgttgtttcaaatgagaatactatgattagcttttgtttttgttattattatactttaagttttagggtacatgtgcacaatgtgcaggtttgttatatatgtatacatgtgccatgctggtgtgctgcacccactgactcatcatttagcattaggtatatctcctaaagttatccgtcccccctcccctcaccccacaacagtccccagagtgtgatgttccccttcctgtgttcgtgtgttctcattgttcagttcccacctgtgagtgagaatatgcggtgtttggtttttttgttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaagtatgatattggctgtgggtttgtcatagatagctcttattattttgagatatgtcccatcaatacctaatttattgagagtttttagcatgaagcattgttgaattttgtcaaaggcctcttctgcatctattgagataatcatgtggtttttgtctttggttcttatgctggattacatttattgatttgcgtatgttgaaccagccttgcatcccagggttgaagcccacttgatcatggtggataagctttttgatgtgctgctggattctgtttgccagtattttattgaggatttttgcgtcaatgttgataaaggatattggtctaaaattctcttttttggttgtgtctctgcccggctttggtatcaggatgatgctggcctcataaaatgagttagggaggattccctctttttctattgattggaatagtttcagaaggaatggtaccagctcctccttgtacctctggtagaattcggctgtgaatccatctggtcctggactctttttggttggtaagctattgattattgccacaatttcagatcctgttattggtctattcagagattcaacttcttcctggtttagtcttgggagggtgtatgtgtcaaggaatttatccatttcttctacattttctagtttatttgcatagaagtgcttttagtattctctgatggcagtttgtatttctgtgggatcggtggtgatatcccctttatcattttttattgtgtctatttgattcttctctcttttcttctttattagtcttgctagtggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgaagttagggtgtcaattttggatctttcctgctttctcttgtgggcatttcgtgctataaatttccctctgcacactgctttgaatgcatcccagagattctggtatgttgtgtctttgttctcattggtttcaaagaacatctttatttctgccttcattttgttatctacccagtagtcattcaggagcaggttgttcagtttccatgtagttgacctgttttaagtgagattcttaatcctgagttctagtttgattgcactgtggtctgagagacagtttgttataatttctgttcttttacatttgctgaggagagctttacttccaagtatgtggtcaattttgtaataggtgtggtgtggtgctgaaaaaaatgtagattctgttgatttgggttggagagttctgtagatgtctattaggtccacttggtgcagagctgagttcaattcctgggtatccttcttaactttctgtctcgttgatctgtctaatgttgacaatggggtgttaaagtctcccattattattgtgtgggagtctaagtctctttgtaggtcactcaggacttgctttatgaatctgggtgctcctgtattgggtgcatatatgtttaggatagttagctcttcttgttgaattgatccctttaccattatgtaatggccttctttgtctcttttgatctttgttggtttaaagtctgttttattagagactaggattgcaacccctgccttttcttttttccatttgcttggtagatcttcctccatccttttattttgagcctatgtgtgtctctgcacatgggatgggtttcctgaatacagcacactgatgggtcttgactctttatccaatttgccagtctgtgtcttttaattggagcatttagtccatttaaatttaaagttaatattgttatgtgtgaactttatcctgtcattatgatgttagctggttattttgctcattggttgatgcagtttcttcctagccttgatggtctttacaatttggcatgattttgcagtggctggtaccagttgttcctttccatgtttatcgcttccttcaggagctctttttgggcaggcctggtggtgacaaaatctctcagcatttgcttgtctgtaaagtattttatttctccttcacttatgaagcttaatttggctggatatgaaattctgggttgaaaattcttttctttaagaatgttgaatattggcccccactctcctctggcttgtagggtttctgctgagagatccgctgttagtctgatggggttccctttgtgggtaagtcgacctttctctctgcttcccttaacattttttccttcatttcaactttggtgaatctgacaattatgtgtcttggatttgctcttcttgaggagtatctttgtggcgttctctgtatttcctgaatctgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgttcatttctttttattcttttttctctaaacttcccttctcgcttcatttcattcatttcatcttccatcactgatacccttcttccagttgatcgcatcggctcctgaggcttctgcattcttcacgtagttctcgagtcttggctttcagctccatcagctccttcaagcacttctctgtattggttattctagttataccttcatctaaatttttttcaaagtttttaacttctttgcctttggtttgaatttcctcctggagctcagagtagtttgaacatctgaagccttcttctctcaacttatgaaagtcattctccatccagctttgttccattgctggtgaggaactgcgttccttttgaggaggagaggcgctctgctttttatagtttcgttttactgctctgttttttccccatctttgtggttttatctacttttcgtctttgatgatggtgatgtacagatgggtttttggtgtggatgtcctctctgtttgttagttttccttctaagagacaggaccttcagctgaaggtctgttggagtttactagaggtccactccagaccctgtttgtgtgggtaccagcagcggtggctgcagaacagcggatttttgtgaactgcgaatgctgctgtctgatcgttcctctggaagttttgtctcagaggagtacccggccatgtgaggtgtcagtcttcccctagtggggggtgcctcccagttaggctgctcgggggtcaggcatcatgaacccacttgaggaggcagtctgcccattttcagatctccagctgcatgctgggagaaccactgctctgttcaaagctgtcagacagggacatttaagtctgcagaggttactgctgtctttttgtttgtctgtgcctggcccacagaggtggagcctacagaggcaggcaggcctctttgagctgtggtgggctccacccagtttgagcttcctggctgctttgtttacctaagcaagcgttggcaatggcgggagcccctccccgagcctcactgccaccttgcagtttgatctcagactgctgtgctaggaatcagcgagactctgtgggcataggaccctctgagccatgttcgggatataatctcctggtgcgcctttttttatgcctatttcaaaagcacagtattaggatgggagtgacccgattttccaggtgccatctgtcacccctttctttgactagaaaagggaactccctgacctcttgtgcttcccgagtgaggcaatgccttgccctgctttggctcatgcacagtgcactgcacccactgtcctgtgcccactgtccagcagtcgctagtgagatgaacctggtacctcagatggaaatgcagaaatcacccgtcttctgcatcgctcacgctgggagctgtagaccagagctgttcctattcggccatcttggctccaggaccctatgattagctttttgaggaagagcaaaactgtttctcctagtggctgtacttttttatattctcaccagcaatgtatgaggattccaaattctacataatgctgccacttgttatttaacattttaaaagaattgtagccagttttgtaggtgtggtgtggtatctcattgcagctttgactttgtattttcctaatgactaatgatgttgagtatcttttcatgtccttcttgactatttgtatatcttctttgaagaaacatctatttgagtcttttgtccatttataaattggatggtttctccctttgttattgagttgtagctagttcttgatattatctggacatgaaaactgcctatatgtggtttgcaaatattttctctcattctgtgtctattaattattttcttgatgatttcctttgatgcacaaaaggctcacatcttgataaagcccaatttatcttttttttctcatgcttttgtatcatagctaagaatccattgcacatttgaggtcatcaatatttacctctatgtctattttaagatgtttttatggttataggtcttatatttaactcactgatcaattttttagagaattgtttgatatggtgggaggtagagttatctaaattcactgttttgcatgtggttatctagttgtttctgcattatcattagaaaggagaattgttcctccattaaattgtcttgacacactcttcaaagagtaattgaccataagtgtgagggtttatttctaggctctcagttctatcccatttgtctttatgtccattcttttgccagcagcttatgtctattctttgccagtagcttctgttttaataattgtactcctttgtgagatttcaaataagaaagttcaagtcctacaatttattttggcaagattgttttggctattcaggggtccttttttgaaaggtggggaggccaatatttcacaactgggaaagccgtttctgtcttcttcagggggaaatttgggagaacattttaagaaactttatctaagtaggtaaactgttaccactttatttgctgaagtgctacgttaaagtgtgcattgcctcttgtggaagaattatgagaccctggaagcactagcccacatggtaagagacagtgaattccacaatgaggggcagagaggatgttgttttgggatacaatgttgttgggggagtggtatacatctctacttctttatgtctctgtatagttggtgtagggaccagccacacaaggtcagtgggtttttctccctgtgtgtggagatgagagattgtagaaataaagacagaagacagagataaaagaaaagacagctgggcctgtgggaccactaccaccaagacacagagaccggtagtggcaccgaatgccaggctgcactgacatttattggatacaagacaaaggggcaggataaggagtgtgagccatctccaatgataggtaaggccacaggggtcacatgtccactggacagggggcccttccctgcctggcaaccaaggcagagtgagagaagagaaagagagagagagcttacagcattatttctgcttattagagacttttagtactttcactaatttgcttctgctaactaaatggcagagccaggtgaacaggttggaacatgaaggtggactaggattgtgaccactgaagcacagcatcatagggagacagtcaggcctccaaataactgcaggtggacctgactaatgtcaggccctctacaagaggtggaggagtagagtcttctctaaatttccccagggaaagggagactctaagtagctttcctggtctgctaagtagcaggtgtttttccttgacactgaggctactgctagaccagggtccgcttggcaatgggcatcttcccagacgctgtcattaccgctagaccaaggagccctctagttgccctgtctgggcataacagaaggctcacactcttgtcttctggtcacttctcactatgtctcctgagctcatgtctctgtatggcctggcttttcctaggttatgattatagaaatgaggattattataatattggaataaagagtaattgctaccaagtaatgattaatgatattcatatataatcatatctaagatctatatctggtataactattcttcttttatattttattataccggaagagcttgtgccctcggtctcttgccttggcacctgggtggcttgccacccacaagtgggcatctccgttggacacagtaggttttgaaatccttgtttatcctctggggtctgggtcttggcttacctgttagctgcagctgaaagaggtgtctgctaaggcattgccacctgtggtgagaagaagggttcagcagagtgaaagtagctggggctcagagaaaccaggaaagtctgactcttagaaactatgggtcagcagatgggtgtcctcaggggtaaatgggccatgccagtagacattgcagtggactggaagaaggtaagggatgccaggtatcccatgttctgtctcagctctgcagctgaagatttgggccatgggcttgtacggccctgcagcaggggaagggtatagaggaatggctgcatatcaggaccaagtccatgtcatcttcttaggcattgttaccacagatggaggattctgttcagagactggcctggacacatgggagggcccaccccattcttttaaaattattttaagagaacagtattagcaaaggtggtacatgttttattctgctagaatgtcttactgtcacgttttacaatgtatctcttaggaaacggcaagagccatccacacaatgtggatttaaaggggactctattataatttcagctttcctacgtcttcatacaaaccatcttctctgcaaacacacaggcaatatctctgtgttcatttctattgggagccctgtatgcaaggtggagagagccacatttccccctgagatgttatgtaaaagtttgaggttgagatgacatatctgacactctgttgttactctcagaagctactacatgtgaaattctaatgactgcattatcctgccaagtgaaagaggcaggcatgagcaaggacagttaagaggggggagagcctcatcatgatggggagtcttgttctgacatcttgggaaaaactgtccacagtgtgaagtcatccacttgttgtcctggtttacagtttgagcatctgttgttatggtgtcgaatattttggtgagttctgagtggctcatgcttcacgtacaagggttttcccatgaaatttacattgagttgtccacctccagcttatagggcttctggaacagagtgggtcttgctcttagtgattccatgggagaaaatggaattggaggtactagtagaattcagggaactgtccagtctacaggtggataataaaaacacagaaacaatgaacagagctgcagtctcataacaggtatactacagtttttattttccacataatttttccctctatgggcatctctacttttaccaatgataatttcagtagaataagtttgtttgcaaaataggtggagtttcttcaaatgtggtctgattgtttacataagtgcagcaagagtagcaatggaccatgtaggctgtcttctaaaattttcttttctctaagtttttataaggaatctgagattaaatcttcacaaacctcttgagaataggaagccaaaccaaggctgacttcagactttgcctgcagttcatattggttcattctatctatgtttttaatataacatccgaatcaaagcattggtaatataaccaatgatttcaaatgtgtcatgttacaaagaaagcagattgttactgtacttgtgcaaatatgtgtattaccataaacatatcaattctcatgaatagttgcccaattctggggcagtcaggtagaaagcaaaagtaaatgtttcaattacggttcccagaagtatagtttattgaactgctataagctgtagatagattaaaagagaaaaattccatcaatgtagaaaacaaaccatttaaagaatcagcaaattttcaaataaaaatcataaaaacattatcttcattattatcaattatttcaatgaaatcaatgttcttcctgcttggtctaggctgggaatattatgaagatatcagcctgtttgttaaagttttcgaagttcttagacaaatttggagggttcaggaggagaatttgggatttgcttgtgcccatgggacacaggctgggaatacaattgttttcctgactcttctctgaatgccagatagactccacctaaaaccctattgccaacgatgctgggatccacttaccagagacttcgactgtcatggatttggagctttccttgccagtggctgagttacgaacagagcaaacatagagcccgctatgctttgtagtaatatggcggataaagagcttttgtcctggtagctgaaacttttcattaattgtccaagaatactgtgccggtgggttagagtccgcagaacaggacaagtagaggacttctcctgaacggtaataggtgaatgaagggtaaattctggggaggtctggaccatctggagcaaagagaataaagccacaggtgatgtcatctgagggaaggggatgttcctggtctcttaaagggacacagtgaccctctgagccaagacacaccctcaagtcccagcccaaccccctctatgttcactgagccgaatcctgaggtattcccctgtttctcccatcacaagctgtgggccccaagtctcccatgataagagcatcccctccccttatattcttggttaaggctgtgcctacccaggatttcccagggcagggagtcatggccagctccgatgtccagaagtaaaggtgtctatacttggaccggagagagactgagaggcctggcatctggtggtttggatttaagctggtgtcctggcccacagaggaacaaaagatactcacagaggacattcagggtgactgggtcactgcggatgccaccatatcggtcccgtatttcacattgatagggtcctgtttcatttctcgtgacactgggtagaatgaggatcctgttttcaatgggtcgctttaccctgggactgaccgggaggctctgaccatttagccaccaaatgtaggtgtagttctcactcttaggttcacaggtgaagtttaagacatccttattctccctggggtttaagttgttgatggtgatgtagggcttgggcagcttcgctgtgtggataacagagagaagattgtcctgtgtggcacctttgattcctccacaggtatccttcaatcagagttggcatctcccacctctcattccacccgagtccttgaaagccaatagctggtgcttttgtcacaagatagatgcatgatgatctaagggctcaaagactgtgaggccgccttctctgtcttagggaagcacagactttctgaagtgtcaattgagcagcagtgttgggtcatggacagacacgtcagtgggagtcacagcccctggtacccttcccaggccctccctaatcagttgactggctggctcaccttgggttccttacctggaatatgcaactgctgggccccttccaaattccatcctactttgtccccctagatgtgatttctctgcagcttccatttcaaaggacattctagagatgagtaataatgggacttccctttgtcctgcaaccctgaagatactgagcagcctggcctgggactggatgtttcagcagaaataacacaggggagaccagaatcaaggctggaggtcagttcagtcatcaggcagtggaggctcaaggtggggcagttttttgcaggtgtttcatgatgacttacttgaaccagtgacctctaaagatagagcagagtgcaaggaatgatctagaaagagtgaaggggacaggcaagagctggtggctttggagcagaagcatgttccctgtcttgggttctttaagtttcctctccttctgcagagggcaggtgaggaccatgtggatctttccagaaatacatgtggacatttgcaaattcagaactgactggtagaaagggtgggaatgaactgctggaaatctggtcctcatgaaccatgtgtgtttgatggatatgagacaaatttggagagaggttttgcaaatattttatttcattggacattctactctctgattccatgggttcaactactctagggacctcatgtaagtggattccagagtgaatatgagaagagactgctggttgtcaggagctgggagtgggtagaatcagaagttgttcatgggtgtgcagtttcagttatgcaaggtggggaggttctagagaactgctgtagagcttgatgcctatagttcacacagattgagtatttcttatgcataagacttaggacaaaaagtgttttggatttctgacattttttgattctgaaatatttgtcatatacttactggtttagcatcccaaatctgaaagattcaaaatctaaaatgctccagtgagcatttcttttcagcatcagattagtaggcaaaagtgggaggtgataagccaaagatattcttgcccttttttttctctcaccacgtttctagcttggtgatcagttttcggtgaattccacagtggccatgctgcactcgtatatttttgaaggccttgggatgtgagaaaggctgattgctattttctatgtcatcagaactttccaccttttcatggttacctctttttctcagtgtttgtgttgtgtcagtcattaataagagcctgtcatgtgagatttaggacagtgttttctaattctgcaaaaaatgttactgtgattctggtaggggatgcattgaatctgcaactcattttgggtaatgttgtctttctaacaatattgattcttccaatccatgaaaatgaaatgtctttccatatattgatatcgtctttaatttctttcagcaatggtttgtagttttcagggtataatcatttgacttttttggttaaacttactccaaaatattttattccttttgatgttaatgtgaattgaaattatttccttaatttcctttcagattgttcattgttagtgtatagtctaaagaatgatctagaaagagtgaaggggacaggcaaaagctggtggttttggagtagaaacatattccctgtcctgggtttttgattttccctctccctttgcagagggcaggtggctcttccctgatagctagatagacttcactggaaaacatattgccaatgctccagggatccacttaccagggactatgatcctcttgattatgagatttgttccaccagtggctgagttatggatgaaacagacctagatccctgtatatgttttagtgatttggggtataaagaacacttgtgttgattgctggaacttcccagcaatcagccaagaatgctctgccagtggatggagtctgtgaggcaggagagcttggggacttcccctgtatggtaataggtgtatgaggaagaaatggtgggggcatccaggccatgtggagtaaagagaataatgtcacaggcactattgtcagagggaagggaaaatcctggtctgtggaagggccacaatcacagtgaccctgtgagccaagtcacaacattgaagtcccagccaaatccccactgtgttcacagatctggagcctgagaccttcacctgtttctcccatcacaagctgtggaccctgagtctcccatgacaggagcagcctcttttctcctattgttgatgaagcctaggtctactctggtttgcctggggcacaaagtcatggccaggtttgatgtccaggggtaaaggtctctgtattggacctgagagggacagagaggcctggcctctggccacgtgtatttgggatggcagcctggctcacagaggaacagaagatactcacggaggagattcagggtgactgggtcactgcggctggcactcactgggttccgtatttcacattcatagggtcctgcagtatactttgtgacacccaatagaaagagggtcctgttggtttcggacagcttcaagctgtgagtcatagggaggctctgaccattcatccaccacaggtagcttgcgtctggagtctcagggtcacaggttaagctcacagcctccatggtctccctgggatttaagttgctgctggagatggagggcttaggagtctccactgtgcagaaaacagggtgaagattgccgtgtgtggcgcctttgattcctccaaaggcatttttcaatcagaattggcatttcccacctctcagcccacccaagtccttaaaagcccatggcaggtgtgtgtgatacaagacagatgcatggcaatctgagggctcagagattgtgaggctgcctgcttcatgtgggagaagcacagactttctcaagtgtgaattgagcagcagcattgggtcatggaaagacacaggaccagcagtcacagcccctggtgcctctgtgtgtccctccgtctccaactgcctgcctggcccaccttgtggtcctcacttggagcatgcagtgctggaatcttgttagtttcagtctcactttgcccactgaggtatgttttctctgcagcttcccttgccaaggacatcctagagatggatgatggaacttcccattgtccttaaaacctttgggtactggaaagcctggcctgggactgggtattctagcataaaacaggggagaccagagtcaagcctggaggtcagttcagtcatcaggcagtggagccacgaggtggggcagttttcccaggtgtctcatagtgactgagttgagctagtgactctaaagatagagcagagtccaaggaatgacctacaaagagtgaaggggataggcaagagctgatagctttggaccaagaccatgttctctcttctgggtccatgatgctcccttccccctgtagagggcagttgaggaccatgtggatctttctagaaatacatgtggatctttgcaaatgcagaactgactggtggaaagggcgatcatgaactgatgacggaagtctggccctcatggaccatatgtgtttggtgaatattagaccaatatttgggaagaagtcttgcagatactttctctcattagacattctactctctgattctgagtttgactactctatgtacctgatatcagtggattccagagtgaatcagagagtagaatagtagtttgcaggagctgggatcaggggaatagggtgttgttccgtgggtgtgcagtttcagttatgcaggaagaggaggttctagagatctcctgtacagcctcatgcctatacttcatacagataaagtgctccttatgcagaaagcttgaaactaagtgttttggatgtctaattatttttttattttggaatatttgcagtacatgtactggtttagcatcccaaatctgaaaaatttaaaatccacaatgcgccagtgagcacttctttttagcatcacatcagtggtcagaagtgttgagttttgagcatttcagattgtggatttctggatttccgatgctcaatttgtaacagtgtaatttttccgtaaaaatttgtcaggagtttagacctcatgttatattctgactctagtaacaaaaaaaatttggaggaaacattaaaatgttttcataagtggaaatttttactgatggtccaaacatctaagatcaattgctggtagtagtatttctcttgagaccaaaataaggtttaggtgtgccgtgaattccagcaggatcacgttatgctcaaagaaagatgccaaaggtgatttgaaattagcagctccttaagtagagagagtcccattgaaaggaccgaactggtcagtgcatcaattacataaagggagaaaggatgtcaaattaaaagaagtgatgtgtgttatgttagtaaatatagaaagaactccctgcttctaaattctgtgcagagttaggaaaaatggggaggacctcaaaacaggtatgtgaaatgctttcttcattttctcttaagctcaggaaacaccactagagtttaagtttgtgtgaattaggaagagtctaagtgagatggcaatggctcttgtgtctccccacacgaagatctccaacttatgaaaatgacatcatcatgaggaaacagttataggtggcacaggcagtaaaaccatcagataacacccacctggtcaactccaactagtccccaaaaccaccggtattcccattacgtgtacattacagtctttgtagttgtcccacagctacaaaatttaaaaattgctattgtcaaaacaaaatattaaatatgaagttgaatatgttgttccactttttttccccactctttttgaactttcctgtttcagttttggaagtttctgttgacacatcctcaagctaggtattctttccacagctgtgtgcagtctaccagtaagcatcaaaagcattcttcatttctctaacagggttttttttttctgagacagagtctcgctctgtcaccccggctgcagtgcagtggcatgatctcagctcactgcaagctctgcctcctgggttcacaccattctcctgccttggcctcccaagtagctgggactacaggggcccgccaccatgcctggctaattttttgcatttttagtagagacggggtttcaccatgttagccaggatggtctctatctcttgaccttgtgcccgcctcggcctcccaaagtgctgggattataggcgtgagccactgtgcgcagccgtctctgagggagtttaatgagttgttgccttttgagtttgttcagctttttacttagtgttagaaccgagtgacaaatttcaagcttgttatacgcctgtcaggaagctagaactctctagaaagtgaccggagaatgtgagctccatagcaggttgaggatggcgtcatgagtgaggatggggtcaagagtccactcagagatggagtgcccagccatctctgagggattttaacaagttgttgacttttgagtttgttcagctttttacttagcgttagaaaccagtgacaaatttcaagcttgttatatgcctgacaggaagccagaagtctataggaagtgactggagaatgtgagctccttagcaggttgaggctggagtcacaggtgaaatgagcccatggggtttggggacagcaggcctgtccagcctctgacaccctggtgagtcagtgcagagattacaacagtgacagcaaactagcatggctgactccatctggcatctagtctcaggctggctgtcctcactcattcctgggcataggccaggttaaccttgggaggaatttagtttatggtttaaacttgaagcaagaatgataatagttcctccataaaactaacacccttactttgtccagggactgcctttgtaaaactagtgaaagaccatgagattaagattataggagggaactgaattttgctaaaatgtaggcacagtttctataatccctgactgctccagtgtcattgggacagggtttacaaaatttgtaactaattgctcctatagataacatcactattgtagaacgtgagattggtcttttgagatgtttctcattcttttgcattctggcaaccggctgacctcatccatacctatgactaatggctcagccagtcatgtggtccctacctagaggcagattcaagcacaaacagatcatgtccccctgcccccatgattccatcaccaaacaatcagcagtactaattttttagtcctgtggccctgaaactatccttgaaaatctctaagccctgatccactggggaggctgatttgagtaataataaacctctgtcctcctgtttggcagacttggagtcattaaaatctttctttactgcaaaccgccatttcaattattttattttatttatttatttgtttttttttttttttgtgcaggaggccagaggaacttgtctggcaattatgagagtggatggaggaactgcctatccctgtcccatggtcttgtccacaggtcagcctcacaaagggaaagagccctggatgggaatacagtggaaggtcattctcttagtgacctggggacattggctcgagaggaagcctggcaggagtggcaactccagatgatttctgtgcctttcctctttcctgggaggtgggccaggccacagtgttagtgggaagggaactgaacagccagagtggttagagggagtgtctagggaaggcctagaggtggaggaagaagctgtgcaggacagggcttgccagtcagaatgaagtgggaggaagatgagggacacagagaagcagagagaggcagatacaccatggcagtgagcagtgagggagacactgtcttcagaaactccagggaccaggtgcccccagttccatagtccaggaccaaggagccctcgagaaccctccggtggcttaagagcttcagaattacatgaggtggggtggctttaggggcaagaggtagtggggggatgaaacatggatgtcagcctctgaaggacaagggacaggtgtggctagaacctcctaggattctgcatccaagatccaatctctaaagaggttttggatcattcatttcttcattccattccttcatttgtcatgtgagagctcctgagtgtgtgtctctctcgctgggcctgtggtggtgtagagtgtgagtggggaaagaaaacaaggtcctctccttgatcctctcatgacagtgacaaggacactttgggaaacacaggatttcaggttcagtgatggtggttaagatctgaggaggaggcctggacatttttttgcactgactctgatggttgaagcaggtgatttagttctggagtgcagactaatcagctgaccatttgctctcactcctctgaggtttggatgcctaagaagagaggatttgagccaacaaatgactatggggtgcttggaacccagtaagccctcacttctggtggagtagaggatgggcctgtggctacagacagacctcatgtgaccctgatctcccctttgtgtttgtgtgactcttgctcagtcactgtgccttcctgtgcctcagttttctctcaatcaaataagctaaatggcaaatggactgtggcttttcatgctatctgtgaataaatgttaaattattcacagtcacctgacctaatgcttggcacagtggaggtttcacacaaacagcatttattattaatttgcttccatgagaaagcacctttacgtcagatccctgtggacaagctgctacctggtacatcttctctcttctgtttctgcttctggggacattagtctttctatggactatcctaagcctcctaaggcagttgggtgatggcctacaaagcttgtctttctgtcctctccactctgagtatcaggtgaagaaagctctgtcctggcccagatgaggctctgagggctgagccctggctggtgaacagctccaggagacacagtcctctgacagctggtaaatccttggtcccagtaagccctgcccaagaagccacaacccagtcccagcacaggctcctcagctttatctggaacaaggatttagggacaagggtctggggttgaggcttctagggctgagcttctctgagagtatctcagggggcccctcaggccaagccctactcagttatccagggtctttctcagggtcaaatttatgaagagggcatgaggtgcttggctgagactgatctcctcctgctgagtccccccatcagactgtccttcctctgcagcgagtgtctgcagggtctggatgcaggaaaggaattctgatctgttgaaatttgtctcctctgtgtgtgtcctgcactaaatgcccaaatcccagcatgggacataacgcagtgagtgacacaggcagagtccaggcctgacaatcctgtgtgtgtgaagtagaagtgacccctgtcccccaacacccagggatcatgtggaatcacttacggtgtaaggtgaaggtgaaacgtccagttactcctctagtcccatcatctccctttatgatgtgtaaggtgtaggatcctgcgtcctcccgggtgacattctggatcagcagggatgcattggaatatgctgtttctcgtccactatatgcaggcccatatataattatttcaccgtctactacatatgatgtaatgtaatggtagaggtccctcatttgccctttgtaccagatgtagccggtaagattctggggcaaattgtggacaagtagaagaacatccttcccctcggaaactttggttggctcggcttcaatcgtgacttgggcagtggtgggcaggttccagaagtttaaaagtgatgctaggaggtggagagaacatcagtcaatattgagacctatgtattggtgtgaaaacatggggccctgggtcctgagaaggtctcttcagtcctcagccttgacaacacagacacacacacacatacaaacacacacacacacacacacacaaaagcggcatgtgtgattgtgtgtgtgtatgtgtgtgtgtcctactgtcctactaggtcaaggtcagcagcatgacgcccattccttcaacacttctgacgttggcatttttctgtttggaatcctcttccccaggggtccgcatggccccctccacaatgccctcaggtcctgcttacatcagggcatcgttagacttctttcctgatgcctgcttcagagaccctgggtcttccctttctgacctttccctgctctgctccctccagggttcttgtcaacacctgacctcacattctagatctctttgcatgtctgtcttcccccccatgacagcgtgagctccgtgaagacagggacttttgtgatcttggttgcaccccagtgcctggaacaggctgcagactcctgtagatgtgagagttctcagggccctccatgccctgggtgttttttttcccccaattgttgaggtttcttgctgaggacagtgtttcctgccctgtttatatttttatttgaggtgtcatctgctatagttattattatcatttttcaaaatatggtggcccctgatgattaatcaggaaaacagaacacttaagattttcctacctcttaccaattccggtccaatacgactttcctgttttgacccctgtccctctctggtgtattttcccctatccaggctccaacagagccttctttcctttttttcttttttctttttttttttttgagatggagtcttgtactgtcgcccaggctggcatgcggtggtgctatctcagctatctgcaacttctgcctcccgggttcacgtgattctcctgcctcagcctcccgagtagctaggattataggagcacaccaccatacctggttaaatttttgtattttcagtacagacagggcttcactgtgttggccagactgatcttgaacttctgatctcatgatccacccacctcagactcccaaagtgctggcttctttcattttttagaaccccatcctctccaggagaccccatccagtcactctgcttcctcctcctgtcctctcccaggaagttctctcctcacctgtgagcaggagccccttccatttgatgcgctgtgtgcagggaggggctgagagggttcccatggtctctgctgcttgtgtgttctcctctgtggagataagcctaggatccagaaactctctgagcacggctgtcagctgtgctgtccttcctctttctgtgctgagcctcttcccagggcaggagcaattctcaagctcatgggcagggtcaggcccaggacacctctctgtcccctcctctctaagtcctgcctccttgtccctccttctgtttctccttttgtctgtgtttcaggtccctgggaattgtggcggcctctgcctttttcagcagtgattctttcaccaaacctcaagacacactttgtgcagacacacagacacacacacacacacacacacacacacacacagaagagatacacacagacccacacagtcagacacataccctgcaggttgggcaagaacagtcctgggcctcagcctcctggtgtccccatggctctgggtcggggtgcaaattaacgccctttggcctctttcatccccatcaggctctccccttcagtgcaggaggctggagctgtaccaggtccctgtcagaatgatgccccattgtgctgtgggtgagctgtgtgttgcctggtgagagggacccttcctttctctaatcatgtctagcttggctgcagcttccaaggatggacattcaggacctgggtgtcccagaggaaactgtcctttctggcggtgtgcagggtgaatctctcatgcctcttgggaggagaggcctgtgctggttgctcagtgggggctgtgagtcccatagtcaaagggacagttctctgtcagtctatggctccctggggtctggcggctgagctggagctcatagtttctcatgttcttcctgaccatctttgatgtcctctcttctctgcccagctgactgtcctgtggtcaccacaccttccctgtggtggtgcaggaggaagtggggagttacccaggaaccctgcgggacatggctcattgagatgcgggagggggagcctgggacagagcaggggttcagagctggagagattcatcccaacttactccgtggccatgatgggctcagccctccatatgctgacatacccaggggtctgtcctgatggttttgacctggccaagctgctgtgtgtagaggaggaacaggcagtggccagagagcctgtctggagggacattgctctcacctgagagggcgggtgggggtgagttgtgttctgagatcaaagagcaataacattccccttcttcccgcaagcacacaggagaggtctgtcttcccaagggacagctggtgttaggtggccacatcccggatggtgcctgtgtgtgaccatcacacgcgctctgagcccccagggtgcagcgggcaggcaggtcacagggtgcctggctgattcccggggaggctgtgggccctcaggcagccgctgttctgtgtcagcgctaggcttggcctgggatgccccagagaacaggacagatggagcaggggtgggcatttagggagcagtgccagaaagagttgatgaggatggagggaggtcacgaggggaaagcacccggtgtggcatcgcgtgcaccagcgctgccctgggagatgcctttagctgggcccagggaaggagcaggtgtgtggggaggagctacctgcagggggagtggtgttaggttggcggccgccaggtcagggaggagctgacagtgtccgtgtggggagcatggagggcgctgaggacttgggcagaagtgaccctgtagagggtggacactgctgggctgtgggttccgctgagtgaggttggcatcccctgggaagactccaggctgggagggactctgtccccctctggtggacagggagggaagtgtgaacggcagcaattccaggccaggatgcatgttttattccacgtggatctgcacagttcacacgaggtcacacctgtgttatgttacagccccatcaccttccagccccgtgagtcccagtctctgtggctctatgttcactgttctccctctttcacaatcagatgtcccaaatgcagatttttgtcaccttctgtgagtttgtgtttgtgtgcagtaggcggcactgtgtataccctgggggcagtgatgtctggggctgagcactgcagttgggcttgggagcagcagggtgggaagatcaatgtcaggggggcagggacaagtcattttcattttctcactcccagggaccagaacccaggattctgactccagggcagagtaccacaccctgctggtgtccctggatgtcatgatgctcatagtgtcatgttgccttggcattcattttttaaggtgtaagtttatttgcctcaaatcagaggcagggcttggtcaccatggcagttttcaatactgtgtctggttcaagtggctccagttggtgtccagagatcaaatcttagagacatctctcctgcttggtgtgctgggctcccgtctctccagctgctttctttaaactgataattctgacattcgccctcacattaaaagtgaccacctctcagtcacagcgtgagctcctgttcccagtgtttgctgcttgctttgaacacatccattaaagctccctgctggaaacctgtcagataacaccctggacttaataaagccattggcttaccggtctcttctctcctccctccctgggctcactgacctctgtgtctgtggtctccaggtgtgccaagtgcttcccagtgtctgtaagtagtaaaaatacttacactttcacgttgtggttgtattgctgtggcctcacatgccatccagggcctgacattgaggctgccttatgggacctgtgctggctgagcccctgctggagctcttgttttggggcctctggttctcttggggacaggagcttccagctaacttgattgaaaaactgatgcatttcattgaaaacactgggtcagatgatgtattcataggcttcagctcctataacaaacaccttagcctgggtgaattaaataatagaaatctatttttcacagttctgtgaataatgtgctattttaaccactttaaaatgcacaatcaatgaaattaaccgcatacaccgtgttaaattaccatcaccagtatttttcctagaaaattgttatcattttaaactgaaactttgtatcttttaaacaataactccctgtatgttccaccctaggccttgatcacctctactctgtctctatgaatttgcctattcttgatgtttcatataaatggaattatacaattatgttattttgtttctgacacatttcacttagcataatgttttccaagtccatgcatgttccagcgggtgtcagagcttccttcctctttatggcagattatcattctgttttatgtgtcaccatatttgtttattcatgtgttgatgaacacttggattgttttcatattttatcttttctgaataatgctgcaatgaacattcccatgcaagtacctttttgagtccgtggatttaattctttgggtatatacctaggaatggatgttatttcaaatgagaattctataattagctttttgaggaacagcaatactctttctcctagctgctgtacttttttatattctcaccagccatgtatgaggattccaaattctacataatgctgctacttgttatttaacattttaaaagaacggtagccagttttgtaggtttgatgtggtgtctcattgcagctttgactttgtattttcctaatgactaatgatgtttagtatcttttcatgtccttcttgactatttgtatatcttctttgaagaaatgtatatttgagtcttttgcccatttataaatttaatggtttctccttttgttactgagttgtagctagttctttatattatctggacatgaaaactgcctatatgtggttgtcaaatattttctctcattctgtgtctattaattattgtcttgataattttctttgatgtacaaaaggctcacatcttgataaagcccaatttatcttgtttttcttgtttctcatgcttttgtatcatatctaagaatccattgcacatttgagttcatcaatatttacctctatgtctattttaagatgttttataggtctgatatttaactcactgatgaatttttcagagaattgtttgatatggtgggaggtagagttatctaaattcactgttttgcatgtggttatctagttgtttctgcattatcattagaaaggagaattgttcctccattaaattttcttgacaccctcttcaaagagtaattgaccataaatgtgagggtttatttctagactctcaattctatcccatttttcattatgtccagtcttttgccagcagcttgttttaataattgtactcctttgtgagattgcaaataagaaagttcaagtcttacaatttcttttggcaggattgttttcactattcaggggtacttttttgaaagatggggaggacaaagtttcacaattgggaaagccgtttctgtcttcttcagggggaaatttgggagaagcttttaagaaactttatctaagtaggtaaactgtcaccactttatttgctgaagtgctatgttaaagtgtgcattgcctcttgtggaagaattttggaccctggaagcacttgcccacgtggtgagagacagtgaattccacgatgaggggcagagatgatgttgttttgtgatacagtgttgttgggggagttgtatacatctcaacttctttatgtctctgtaaagtgggcatagggagcagcccgcagggtcggtgggtttttctccccgtgtgcagagacgtgagattgtagaaataaagacgcaagacagagagataaaagaaaagacagctgggcccgggggaccactaccaccaagtcatggagacagatagtggcccttaatgccaggctgtgctgatatttattggatacaagacaaaagggcaggataattagtgtgagccatctccagtgataggtaaggtcacgtgggtcacgtgtccactgcacagggggcccttccctgcctggcagctgaggcagagagagggaggagaaagagagagagagcttacagcattatttctgcttattagagacttttagtactttcactaatttgctattgctaactaaacagcagagccaggtgtacagcatggaacatgaaggcggactaggagcgtgaccactgaagcacagcctcacagggagatggtcaggcctctggataactgcgggtggacctgactaatgtcaggccctccacaagaggtggaggagtagagtcttctctaaactcccctggggaaagggagactccctttcccggtctgctaagtagcgagtgtttttccttgacactgaggctaccactagaccatggtccgcttggcaatgggcatctttccagatgctggcattatcgctagaccaaggagccctctagtggccttctgtgggcataacagaaggctcgcactcttgtcttctggtcacttctcactcttccctgcttccctcttccaaccacttctgagctacaaatgagaaggaagcgatctgattaaacaggtgatgagcagagtcacgttctgaggggatttgcacttttaaaaggagattaatgaccacatctgacaatgtcaccctggaatcttatgcagagtgacaggggagtggggatgagctccgttcaggttcaggaagcgagagtttggatctgaagtacttttcagatgctgaagtcataggagcttgcagttgcttcctgggtggagccataaacaaacatctcttctgctgagtggggtctgagaagatagagggaacggtgacccaggagctctggaattatctggctgtgttacacttgcaggactacacatatttaagtgaaaacaacatggttttcatccacctggctgacctcttagcctgctttcctcttattgttccctcgaaggcatcattttttgaaagagaaatttaaactctgtccatctcatcccctttggacaaaagttgagtcctttctgagctctttcatcatctggagtttaaaagcttcccctcctctgttaactctctttgaatccctcatgtcacaccaaacttcaaaagagacaaatacttttgcatgactccctgcaggctccgttttgccctgtagtgacagccccatgtcttggctttcctgattggaaaaacttctcaagctttctgcattcatgatctctgcttcttcagtgcaaccttctccagcttgtctctgatctccaatggtccctgcattaatcctgtccaagccacaggtgaccctcatatcatctcagcttctacttcccagtctctctctctctctcttttttttttgagacaggggtctcactctgttgcccaggttggtctcaaactgttgagctctaaagatcctctggcctcatcttcctgagtagctggtaggggtgtgagcccttctgcttggtctccagtcctttgcttttcttttttgacctatacaacatttggtggttgatgtccatgttcatgtaattgtcttctctggcttcttggggccaccatgcattcccttctccctcttttcatttattatcttttcatctagtaagacccatcttcccctgaatatgtatattttcctcaaagcaaggattggcttaccttcacaaactgagtctccaatgaccacataaactgaaatgcaatagaaatcatggacagatgtgagctcctcttctacttcctgtgtcctctgcaggttcttctcaccaacgtcacgtattgttaagtaagccagtgatgttaagttagaaagtggactgattccattaattcatttggcatgttccgaagtcctcacctgagatctatctactctccaaattacacttgttagtaatacaggaagatctttttcacatgagctaattagggtgaatacatgtaagtgttggtaagaagtactagaaacactggaatttgtgagatttcattgaagaaccaacttccacccagcccttcacattgttctcttttggtagtttcttgtcatttcctccttttattatcaatagagctgctgtgaacatgcatgtacaagtttctgggtggacatatgttttcattttttggggggtagacatcaaagagtagaattgctgggttgtatgatgaatctgtgttccaacttttcagaaactggacttctactccttcctgatttcaccttccacgccatttctgtagtgaggcccactccttggccttataagacctgaattaagttaggtgcccagagccgttctgtcattgactctgttctttcccttgctagcctgtgtaataattggcaatcagacctttacgtgcgcaatggtttcatatgtctccccaactatattacaagttccacgggggcagggctatgtctatctccttgacctctgtatctgcgatgcctagcagagggctgtgaacaccggtcaccctccataaacactgggagacaaacaagggagtcagtagagttagtttttttgcctttttacccccagaactcttagaatatgatttgagctattgcttcaaggaagtcctggggcagatgatcattcatagatgacatgagggagtgcacagcacatgagtttgcaggaaaatgcaaaccccacattgaaatttgatccccaatgttggagatggggatctacatgggggtgtttgggtcatgggggcggatccctcatgaatggcttggtgctgccctcatggtaatgagtgggttttctactcaatcctgcaagagctgattgttagaaagagcctggcaccttcctctcctctttctcttgcttcttctctcaccatgtcatctgtgcacacagcagctccccttcccattccaccatgagtggaagctccctgaggcctcaccagaagcagatgctggtgcaatgcttcttgtatagcctgtagaactgtgagccaaataaacctcttttctttataaattatccagcttcactcaggtattcctttttagcaacacaaaactgactaagacagggtatcaggagacctagctttgcctgaatctgagaactccatcaggaatcttggaacaatttagcccacaggtccaaggctgattttttgtcacagtgaagttcaggtagtaagaattctcactggtggctgttgacggtggcggtggtggggatgggtcatatggagaattagcagtgggagactagaaattaaagtggataaagggaagaattaaaagtcaaaaacagtgtgagggaggaaaggaatggatataacacctcacagctttatccttgagaggccttaaagaatctacttaataataatcagatggtattctataagaactttgagactagacatgtgatgacttttaggaaactgccctggagctgaaaatgcatgcaaatctagctgactcagctccagccttaactggctcataacttgtttcataaacatgactgtatgttagcaaggaaatgagagagaataacagcacatcacataggcatgaaaagtatttgcaaagcagcagttctcaacaatgacattttgcagagttttccagaagcagattcagaaaactgaagaccaaagtaatgagggagctgtctcatgcctagatgagcagaagcataccaaaggcttagtatttccccaagtaataggcacctgaaacttatttaaggaaaatactcttcttgatgaaacaggcactgcagttgaagcaggaatgtgtttggtgtgctgccttaaatagcatgggtagatgttcaaacatgttaggactcgctggccctaggaaagacccgcaagtatctggtctacaccaggaaagtgacaatgaaacaccaaacaccttttctcctctaattaccaagaaaagtatttctttcccaatggtggaagacaataatgttgggaatgatgaagttttctggagtgtgaagtggatatgtcttataagtttaatccacagcttcaccacttcataagtggataatcgaattgtgcctcagtttcctcagacttggggatattaagagtatcctcagtcaccacaaggtgggtaccaacataagaaaagagtgtagcaaaagcccatgggtgcatgttcttaaagtgcctagtgtgggattagaatgacaagtggtagatgacctacttgtgcagaaatttagagttattttgtgattttcaaatgatcatgtgtgctttccatatgctgtccagactgggggtgctgcagctagaaagggaagaaggtttccatatttcctgagactggagtcacatcctctcaccaatgcactcacctgctgactaaccagtgtacttctgggaattgcaaatgcatgaaatggcacccattctagactagtcacggcagtgttggtgatggccacagatcgggaacgaccctgacgtttatccatagggaactgggtcatgagccatgatccacatcatggatactgggcagctgtggcaaagaatgaggtatctttcttctgtgtactgggaaaggtttccaagatataccgcacagtgagaaaaacaagaagcagaacaatgcacggtgtgctacctcttacattacataggaggaaatgtaaaattaatttaccaatggccaataagcacatgaaaagatgctcaacatcactaatcatttggaaaataaaaatcacggctacagtgagataccatcttacatccattatgatgattgttcttaaaaaaaagaaaaacagaaaagaacaagtgttggcaggtaggaattggaatgcttgtgtagtgtttgtgggtatgaaatatggcgcacccactgtcatcgtttctcaaaaaattaatcatagacttaccacaagatgcagcaattcggcttctggtgtattccaaaaagaacggaaagcaggggccccagcagatatttgcatgtctttgttcatagcagcattattcacaatagctagatgttggaaataagcccagtgtccatccatccatgaatgaataaacagaatgtggtctatacgtacaaatgaatgggattaaaccataacaagaagggtggttctgatgcgtgcttcaacatgaataagccttgagttctttctgctaagtgaaataatcagactcaaaaagacaaacattgcatgattccacttaacagaagtgcctgacgtcatgaaatgcatagacagaaaatgaaaaggtggttgtcagcggctggagggagggggaaagaggagttgttgtttaattggtaaagaattccagttggggaatatgaaaaagttctgggtggggatggacagtggtggtggttgaacaacaacgtaaatgtacttcctgccactggatgtacagttaaaagtggttaaaatgggccgggcaaggtggctcacgtctaatcccagcactttgggagattgagacaggcggatcactttagattaggagtttgagaccagcctgggcaatatggtgaaaccccatctctactaaaaatacaaaaattacccaggcatggtgacaggcgcctgtaatcccagctacttgggagggtgaggcaggagaatcgcttgaacccaggaggcggaggttgcagtgagccaagacggcgccactgcactccatcctggacgacagagggaatctccatctcaaccaaaaaaaaaaaaaaaagaaattaacgaacgaagagcatctatgttccaaatgcagtgtattattttatgcaggctttcacaagctccaaaagattcaccgtgcagaactggagattctagagaaagaccacgcctcctcctgcgggtaactcttcattcagcaagcagctcttggcttatccctgggcttagtggaattcgaatacctgaccataggacaccaagggctttgggacctgaatgacacatcatgtggtggtgacatctgagttacctggggcgtgcacagcagcctccagcatcccagggagagctgtgtatggggtcaggctcaagcaggtctcagggcaccagtgacccaatgggtgactcagactcccatggcacctgctccttctgtttctcccttcgccatatatatgagctcatgggaaacgctgtgacctcttacagaggaggaaagttcatggacttctagcttctagaactgtgatacaataaactcctgttgcttatctactcctctgcagtattttgtcatggcagccctagcaaactactatagtgactgtgggggttaggatgacaccaagcatcaaatgccactccctgttccaacagtgagaccattccacagcccctgaatgacaagacaggccttcaaactcaagactacctggctaggtaagaagtactttagtcacaccacttctgaactttcttgcctacctgcagggcaggaatttttaccatttttaaatgaggacactgaagctcagagaagtgatgctatttcctgatgggtaagaggtgatatatttcagtcctcagaccaactctggagtagcaaggttctagtcttaagagtcaaacttggctaggcatggtggctcaagcctgtaatcccagcattttgggaggccaaggccggtggatcacctgaggtcaggagttcgagaccagcctggccaacatggtgaaacctcgtctctactaaaaatacaaaaattagctgggcgtggtggcatgtgcctgtaatcccagctacttgggaggctgaggcaggagaatcgcttgaacccgggaggcagaagttgcagtgagctgagattgtgccattgcactctagcttggggaacaagagtgagacatcagctcaaaaaaaaaaaaaaaaaaaaaagtcaaccttgagccaggcatggtggctcatgcctgtaatctcagcactttgggaagccgatgaagtcaggatttcgagagcagcttgggcaacatgctaatacgctgtctctaccaaaaattaaaaaattagtgggtatggtggctcatgcctgtaatcccagctatttgggaggctgaggcacaaggatagcatgaaccctggaggtggagctgcagtgagccaagattgtgccattgtactccagtctggagtgcaaaaaaaaaaagtccatctcaaaaaaaacacaaaaagaataaatatggggcctcatgactgtatattactgggcttccgacctagactgaaagatcagggaagactttcctgaagagaaagtgagctctgatgggcccactgtactctagcctgggcaatgtaatgaggctctgtctcaagaaaaacatgcagaataaaaccacaataagataccactacagaactattagaatggctaagattaaaaagagtgaccatgacaagtgttggcaaggatgtggaggcactggaatgctcacgctactggtgggaatgtaagatggtacaaccactatgaaagcagtctggcagcttctaaaaatttcagcatacacccactatactactcggcaattccattccattcccacattatttttatttaaaggaaaatcaagtggtatgatctttaaggcatttttgcctgacaaatagatgaaatgtgggtagcagcccaacactccctggtaagtcttcacagggcatatgtggactcgtggcccccaggaaatatggctctttccacaagtgctaagtccactctctccatcaatcctaagatgttagttccacagcactgccagcattgggctttgtctatttctttctttctttgtcttttttgagaggggtcttgctctgtcatccaggctgaagtgcagtgatgcaatgttggttgtaatggctcccatttcatttccaattgatcttatttggctcttccctctttttttcttggttaatcttgccaatggtctatcaattttatttatttttcccaaaaatcagctttacattttatttatattttgtattattttgtttcaatttcatttagttctactctgatgttggttattttctttcttctgctggatttgggtttggtgtgttcttgtttcttgagtttctagaagtgtaaccttagattgtctatttgtgctctttcagtctttttgatgtaggcatttaaggctataaacttttagcacactctttgctgtattccagatgttttgatagggtgcgtcactattgttcagtttgaagaatttttaaatttccatcttgatttcatatttgacccaatgatcattcaggagcaagttatttaatttccatgtgtttgcatggttttgaaagttccttttggagttgatttccagtttattctaccattgtctgagagagtacttcatataatttcaattttcttaaatttattgagacttgttttgtggcctatcatatggcctatcttgaagaaagttccatgtgctgatgaatagaatgtatattttgtggttgttgggtagaatattctgtaaatatctcttaagtctatttgctctagggcatagtttaaatccattgtttcttccttgactttctgtcttgatgacccgtctagtgctgtcagtggagtaatgaagtccctcacaattattgtgttactgtctatctcatttcttaggtctagtagtaatggctatataaatttgggagctccagtgttaggtgcatgtttatttaggactgtgatattttcctgttggacaagtccttttattattatataatgttcctctttgtcttttttaagtgctgttgctttaaagttagtttttttgttataagaatagttactcctgctcacttttgtggccatttgcatggggcgtctttttctacccttttaccttaagtttatgtgacactttatggttaggggagtctcttgagggcagcagatacttgcttggtgaattattatcaattctgcaattctgtatcttttaagtggagcatttagaccacttatattcaatgttagtattgagatttgaggtactgttccattcatcctgctatttgttgcctgaataccttggttttattcatttatttattgtatttttgttttataggtcctgtgagattcacgctcaaagaggttctgttctgatgtgtttccaggatttgtttcaagatttggagctccttttagcagttattgtagtgctggcttggtagtggcaaattctctgagcatttgtttgtctgaaaaagactgttatctttcctttatttatgaactttagttttgctggatacaaaattcttggctgataattttttttttctttttctgagatggagtctttccctgttgcccaggctggagtgcagtggtgtgatctcggctcactgcaacctccgcctcctggattcacgccattctcctgcctcagcctcctgagtagctgggattacaggcgcctgccaccaggcctggctaattttttttgtatttttagtagagacggggtttcaccatgttagccaggatggtctcgatctcctgaccttgtgatctgcccgcgtcggcctcccaaagtgctgggactacgggcgtgagccaccgcggccggcctgataaatttttttaaggaggctgcagatgggtatgcatgctcattggaggtgttcttcccttattgaagattattaaaatcacatgtgttgaaaagcatttgggactgtttacttaattgatgagtactcatttatttttacattaattttgataccatgtataaacaatatataaacataggtatggacatatacatatgtgataggcgatacagcatagaacatatacatgtgcacataaagatagagtgcgacagaaatacttcagatttttgattttaaaactttatgcatgaacctataaaactccctgttaaaaaaaaaaaactggatttaaattgtgctattgtaaatataaaaattaacatttatctgaggaagcccttgctgagttttagagagagtaggtagtaaatttacatctcaaagcacacacacacacacacacacacacacacacacacacacacagaagaatttgggtgtgttcaaggaagattaaaagtagatgccaaggtaacacaaaaatgatagaaatttataacaggattttataaggagaccaattttatttccatacatagcttttattttggtctctgttttccaactgtactccaggaaacacactacacaggctcccttcttaagtgctggtgagccactgcatatacagacagcccactttaagggaagaatcaggggagaagagatgcagaccccagaattatgccaacatacaaatgcctaagtcaaaggtcaaactgcacacttgaaatctcatcacctgtttggccctgttttcagtgtactttactttctttaatttctgctctaaagcttttaaatgaactttcactcttgctctaaaatttgcctaagtctcttcttctgccttatgacacttagtttaattctttcttctgaagaagcaagaattgaggctgctgcagacttgtacagatttgctgccattaatatactttagtgccattctacatgatagaatatacatattcttatatttatacatatatataaaatatatgtattcatagaggccttgaatctacattcttgctgcacttcatgtaaacaatccaggtagaagactaaaagttattttggaaatacatttgtcccatatgatttctatttcataaaaatgggagacaggagggggaaaattatttttagaaaaaaacaacagaacaacagttattaaattttagatctgttcatttttttttttgaattttgttatttacctacaatttgggctgaatcctaaattttttcctggctacaaatttcaaaactaatggtttcagaattttcttccattttggtatattataaattaaaactgtgctttttaaatttttatcatttttttattacgcttttaagttctgggatacatgcacagaacctgcaggtttgttacataggtatacatgtgtcatggtgttttgctgcacccattaacccatcatctaccttaggtatttctcctaatgctatccctcccctagtcccccacccctcaacaggccccagtgtgtgatgttcccctccctgtgtccatgtgttctcattgttcaactcccacttataagtaagaacatgcagtgtttggttttctgttcctgtgttagtttgctgagaatggtcatttccagtttcatccatgtccctgcaaaggacatgaactcatccttttttatggctgcattgaattccatggtgtatatgtaccatattttctttatccagtctatcattgataggcatttgggttggttccaagtctttgctattgtgaatagtgctgcaataaacatatgtgtgcatgtgtctttacagtagaatgatctataatctttgggtatatacccagtaatgggatcactgggtcaaatgatatttcttgttctacatccttgaggaatcgccacactgtctttcacaatggttgaactaatttacattcctaccaacagtgtaaaagcgttcctatttctccacatcctctccagcatctgttgtttcctgaccttttaatggtcaccattctaactagcatgagacagtatctcattgtggttttgatttgcatttctctaatgaccagtgatgatgagcttttttttgtatgtttgttggtcacaaaaatgtcctattttgagaagtgtctgttcatgtgcttctcccactttttgatgggcttttttttttcttgtaaatttgtttaagtttcttgtagattttggatattagccttttgtcagatggataggttaaaccttgcaagctgaaactcgatgacttatgtaaacttctggagaaatcatagcaacttatatataaacaacctttgtgcctgctgatgtgtactatacaaaaggtacacatgaacgctggattcagactgcaattcagaaaaatgtgtcagattgccattgcaattagaagatgcttcagaaactctagaaaacctagtctatagggttagagtgatgtttgccaaacgaattgctctaattgaagcagcagttgtgtgactttaataaagttccaggattatactgtccctttgttgctgtgacttccctttgcctttttctgatttgtcttcatccccttttccacggggcatgacttcttaagaatgagccttcctagtgatgtaggatcagatgaaacatacagtcacaaagtcatgtcttctacaatgctttctctgaaagcttttgaagaatcgagggaccaggtgtgctgacacagacctgtaatcccagcagtttgagagtccaaggcaggaggatcacttgaaaccaggagtttaagaccagcctgagcaacaaagggagaccatgtctctaccaaacataaaataaatcaaattagccaggtgcagtgatgcatgcctacagtctcagatacttgggaggctaaggcgggaggaccacttcagcccaggagttcaaggctgtagtgagtacactccagtcttggtgacagagcaaggttgtgtctctaaaagaaaaaaaaaaaggaaaggaaaagaatggggtaagcaggaaagccaaagatctcgggcatctccagatgattccctgaacaaattgttttttcttggcttcaaaacctttcaagatgtatatttctttgtaaaagaaagacatgccaattgtaactttaagtgagcagtcaaaatctagctcctaaaactgaagtattttaactctcattctgataatatttattttctgaggcaaagaagaaagacaagattagatgaattgtttttctgcccacaccatctcttccgacatgccttatccctttaatcaaatgtataaatactaagcctcctgaaacctcttcagagaaaacacaagccacagaggtttttttgcaactcatgtattcccagggtgtactttcaagttctggctcaataaatctcaatttatcaagacccttgcctcagtcagtcattctggataaccaccatgagtcctgcaaagcccttcagtaatctgttgcctgcctaggtgatgtgtaaggtgagtcaggtcttcatgagtcaaacactcgtcttcctttctgtctttcccaaccctaccactcagtgctgtgtgctctgatctgaccccagctcccaggttgtttgtattggtctaagaaagcaagaccaggaggggcaggttgagaaggaagtaagaagtgaacatggaaagtggcaggtggggctgtcattgctcaaagccacacaccctgggtgcattttatgaatttttctggattcataatcttttccctgtgtgtctatctagaaactcacccccctcctactttcttctcattactctttctgtttctagtgcactcgtttatggccagagaatggccgtgtaaatagttgacaatagaataaaaaatgatgttttctgagacttggaagctggcctttcttttttccaaaagagattggggtttctaaaagctagcttttatgcagggctgtgcagttgtgagtgtagttttagggaacagatgcataagtgaagggtgagacagaaaacaaaatgctggctgtttgtcaaatcctgaaagtaaatgggacaaaaatcatttttgaaggaggatgtcattcaggagaccttgtacatcttagcgtgtcctcttaccagaagaattggaggttgaggttgaattatggatttaagtgacagtgggtatataattctctgcctcagtttttttttttaatctgtaaaaatggggattgtggctcttgggattttttggtgagcactatagttacctgaaaagctcttaggatagtgcctggtgcatagtgagtgctgcatcagtgtgagctattataattatgggaatatacaaaggtatcaccctggccatccagagtggggagatattttctggtcagggtccaggcaggccagctggagatgaagctgattagtagggaagcttaacttccaggagtggaagaatttaggaggagtaaacagaatgcacaacattctgcaaacattcctttacccaacagtaggaatactcagagtgggtgtgtcttccgtgacaatcattatctcctgggaatctaagaatgtgttctagagtcaaatggctttgatgtaagccaaacccagaaatgggcttcagggctgccttgcacatagcattcattcatcttgaaaaaggaaagcattcatcttgctaaaggaatcccctcttctggcccaggccattatttttgtttttgtgctatcctaatttttaaggtgtaagcagaaagactgaagaataaaataatgaagtacatgaatgaaataacagggtagaattgagactgctacatgtaagttaagagaaattgtgtataaatttttgtgaacagaaaaaggatttcttgttgcaaacagacctctctatataaataatacctcctgccttgagtggatagcagaccgcatcacaagaacattccagcagagtcatgagagaatggttagtgtggcttctttaattgtcaggttagactgagtaagttactgaagagaaaggagttgaaggagaagatgggtgagggcaagaaaaatgggaaggtgaaaggaaaggactgaaaggaatgtttaccaagggctcatcaggtaccaggctctgtgactaatgtcttacacatgttaatttactcttccactgtcattttctgatgcagtaagagtcagccttacactgcagatgaggaaagaggctgagggaagtcaaatgagtggcccagggtcatccagccacttcatagcagagctagtgtgtttcactgtggtttgtgcagacagaaaagtgagacatggaaggaaggcaaaacatttttgttgtgggtgatgtttatgaaagtgacccgtatgaggcagaataatggcctcttaaaaatgtccacatccgggccgggtgcaggggctcacgcctgtcatcccaccactttgggaggctgatacgggtggatcacgaggtcaggagttcaagaccagcctggccaacgaggtgaaaccccgtttctactaaaaatgcaaaaattagctgggcgtggtggcgggcaactttaatgccagctacttgggaggctgaggcaggagaatcatatgaacctgggaggcggagattgcagtgagcctagattgtcccactgcactccagccggggcaacatgagtgaaactgtctcaaaaaaaaaaaaaatccacatcctaactcttggaacacatgcatttacttttcttggcaaaaacactgttcaaaggtgatgaggttgagtatcttgagatggaaagcttattctggcttatctggatggctcccagtgtcatcataggggtccttgtaagtgaaagagcaaggcaggagggtcagggtgagaatgatgcagtctgagagactccactggccattgcttgctgtgaacatgtgtgataagacaaaattacaactgatttagttatagatgtaattggtttttatttgtgatttatgatttggggcagctctccctctacagatgcctcagcatcccaagtagctgggactatattgtgggatctggccagcaacctgcaatgcaacagggctctttctttgttcccaggcagatcggcaagttgagaaataaaggacacacacaagatagggaaagctgtgtccaggggtgtcaccgccttctggtcctgcgatgctgccaatgcactggatacaccagcatttattattaagtttagtgagagtgggggtagtttagtgagggatttagggtcatttataggctctccataagggtcacattcctttcccagagctacagacatctgcttttctgggataggaatcttggtaatgtgaaacctccctgactgcccatccattcataggctctctgcagggggaagcacatcacgtgctgttggctcattctggcagtccaacctggcatttttctttacacaatccttcatgcaattttgtacttacaataatcaggagctttaaaggatgtcttgttatgtaaaaatgtgttggctgggtgcggtggctcatgcctgtaatcccagtactttgggaggctgaggcgtgtggatcacctgatgtcgggagttcgagaccagcctgaccaacatggaggaaccctgtctctactgaaaatacaaaattagctgggcatgatggtgcatgcctgttatcccagctacttgggaggctgaggcaggagaatcacttgaacccagggggcggaggttgtattgagccaagattgtcccattgcactccagcatgggcaacaagagtgaaactccatcttaaaaaataaatgaagtgtggttgacatgatatatctgacactgttaacttactctcagaagctacttcttgtgaaatcctaagtacagcattattctgggaagcaaaggagacaggcataagcaaggagaaattaagagaggtaagagtctcatcatgattgatagtcttgttctgacatcttgagaaaagctgtccacagtgtaaagtcatcaacttgttgtcgtggtttgcagtttgagtgtctctaagttatggtgttgaacatttggtgagcttttagtggcccacacctcagacacgagggttttcccatgaaatttacattgagttgtccacctccagcttatatggcttcaggaacagagctgctcttgttcttaatgatttcattggagaaaattgaattggaagaactaaaagaattcagggtccagtccagtctaccagtggattataaatactcaaagataatgaacagtagtggttcaatctggtaacaggtgtactacagtttttcttttcaactagtttttctctctataggagtctctaattttaccaaagataattccagtaggatgaatttgtttgcaaaataggttgagtctcaccgaacttgcccagattttttacctaagtgcggcaagagtagccgtggaccatagaggctctttttaaacgtccctttgctagaagtttttaataagaatctcagatgaaacttccaaaaacctcttgagactaggaaactaaaccaagaccaacttcagactttgcctgctttccctatgggtttattctaggtatattatcaaatataacatcccagtaaaagctttggtaatataaccaatgttttcaaatgtgtcctgttataaagagagcagattcttactgaacttgtgcaaataactttattaccataaacctatgaatactcatgaatagtttcccaattctggggcactcagatagagagcaaaagcaaatgtttcaatttttgtttacaaaagtatactttaccaattgctgaagaaaaaaagttcataaatctggagaataaaacattccaagaatcagcacattttccaataaaaaattatgaaaacattatccttttgattatttagtccaataacattgagtttttttcttctttgtcttgaatttcatgaaggtatcaacctgttctttttctcagtgtctctattgtggcagccattaatgagactctgtctggtttccatggcagggacctgattgacagaaggcccaggtcagcgcatttcaaattcactacctcctttacagagaaagcttctttcccacaggctcccagcaagggtgtgaaagcaagtctagttctccgaggctctctttaactccaatgggtgactggttggaggattcctcatcagccttgcaaaaactcttagaactgcattggtacctaaaacttctttctctttctttttcacaggaatcagctctgcatagcggtctgtgggttctcccatactaccttcatgcctgccccacattccctcacaggtgtcttccctgataaattatcttgtatgtctaatcccatcttggatgcatctcagttggtaaaaactaacataccagacttgattctttgcacttagctttttttctttctctcccacaattagtcagtaaccatgtcctagtgttttatgtgttaccgcttttttcatatctatggaaaaaggtaggtactgttgaggtgcactttctatgtgccaggccctgtgctcaatactttacctgtatctcatttaatccacacaataaccctgtcaggtaggcattatttccattttgctgatgaaaagacagaagcttagcatggtgtaaaaactttcctggtgtcatatggctagtgacaggtggatctgagatttgattctaggactatttgacctcaaggctaatgatgatggtagtaatatagcagctgacattggttcctctttgtgtggcatcttgtttcattgactgcattaaacctttaaaagaatggtatgaagaaagtactcttattgcaattttcaggtgaggaatcaggggttcagagaagttgagtcttgtgcaagaaatttataactgtaaactcttacattaaaaaagaagaaagagctcaggtcaacaacctactttaatacttcaggatacgaaagaagaacaaactaaacccaagcacagtgaatgagggaaataataagtattagggtggatataaataaaatggagaatggaaacagaatagaggaaattactgaaaccaaaagttgattcttcaaaataaaatcaacaaaattgacaaccattaactagattggctaagaaaaaaagagaaaagataaaattactcaaatcataaatgaaaatggactctgagcatggtgggtcatgttttaatcctagcactttgggaggtcacagcagaaggatttcttgaaaccaggtgtttggaccagcataggtaacctggggagatgctgtctctacaaaaaaaaaaaaaaccaattagctgggcatgttgacatgcacctgtagtcctagcatcttgggaggctgaagaaggagaattgcttgagcccaggaggttgaggctgcagtgagccataatcacaccactgtattccatcctagggtggcctacagagtgagagcctgtctctctgtcttaaaagaaaaagaaaaaagaaaaatgaagcgattactaccaattctaataaaataatgattatgaaagtactataaataattgtatgccaataaattggataacctagatgaaatagacaaactcctagaaacacacaaaaatatgaatataactataatcagtaagaagattgaatcaataaaagcatttgatgaaattcagtattttttcataataaaaacattctaagaatggaaggcaaccacctcaacataaaggcaatatgtgaaaaacccaatgctaacatcttacataacagagaaagactgaaaactttccctgtatgagcaggaaaagacaaggatgcctgctattgacacttttattcaacatagtagtgaaaggtctaatcagaaaaattagggaagaatttttaaaaagacattcaaattggaaggaaggagtaaaattatttctgtttatagataacttgaacttatttgtagaaaatcctaaagatggaacaaacctattagaattaataaattcagtaatgttgcacaatacaaaatcaacattcaaacatcagttgtatttcaatacactaaccatgaacaatctgaagggaaattaagaaaaataatttcaatttatattcacatcaaaaagaataaaatatttaggaataagtttaaccaaagaggtgaaatgattatacctgaaatctacaaagtattgctgaaagaaatgaaagatgacatcaataaattgaaagacattttgtgttcatgaattggaagactcaatattgttaggaggacagtgctgcccaaagtgagctgcagattcaatacaattcctatcagaatctcagtgacatttttgcagaaaaagaaaaatctgtcctaaaatttatattgcatctcatgactctaaatagacacacagctttgaagaggaagaatgaagctggaggactcacacttcctgatttcagcatttactacaaagccccagtaatcaatacagtgtggtactggcataaaggaggacatagaaattaatgaaatatcatagcccagaaagaaatgcttgcatatatggccaaatgattttcatcgagtgtgccaagatcgttcaatggggaagggacagtgttctcaccaaatgatattgggaaaggtggatatccaagggcaagaagagtggaacctttacctaacaccatgtacaaaaattaacccacaatagatcaaagatctaaatgtaagagtaaaaactatacaactcttagaagaaaaacttcatgatagtggatttcacaatgatttcttggttgtaacaacaaaagcataggcaacaaataaaatggataaatcagacttcataaaaatcaaaaccttttatatagcccatgcaaagttcctcagcatcacgaatacttagagatatgcaaatcaaaaccacaatgttacaacacctcacacactttaggatggctttgataaacaacaacaatgacagcaacactaaacaacaggtgtttccaagtagatggaaaaattggagctctagtgcattgctgatgggaatgggaaatgttatagccaatgtaaaaagtagtgtggctgtttttcaaaaaattaaacaataaattaccatttgatccagcaattccccttctggacatactccctatagaattgaaagaaatttgaagaaatatttgtacactgatgtacagagaagcattactcacactagccaaaaatggaaacaactgaaaagtccattgaaagataagtgggtaggcaaatgagatgtatctatacattgaaatgttattcaaccttaacaaggaagaaaattacaatacatcgtgcaaaatggatgaaccttgaagatattatgccaactgaaataagccagacacaaaaggataattattatataattccatttataaaagatagttagaatagccagttacatagagacagaaagtagaatggtgggtgttaagggttagggggagaaggagtgagagttactgtttattgggtacagaggtttaatatggtaagaggaaaaagttctggaaatggatagtgtgatagttacacaacactaaattgcacacttagttaatggtaagtctaatattagatatatataaagtgtctcgtggtcttgccctctctataattacacactttttggcactgcccctttcctgccatgcagagccccaggggtgaatctccctatttctctagctctgcatcagtcactgtcctccgtgctgtgtcccacgtgctgtgcccaaagcctcatacagctggtgacttcagagccaggatgcagctcaggagtcagccctgaagctccctctcttcttatttccctgcagcctggcccgggggaggcttggcttcaactggcagctcgatttagccaacttcaggacaggccaccagggccctttctccacacatgttggttccaccccaggtggagtcaggcagggccaggccagtcaccagaggagcccggagcagagcaggaagcagagtctgagctgctcctccctcacccaaagggcttcctcctctcatttgggggaaaagtgtgagcttgtttcaaagcctcagatgttccttgtagctcatggaataggtacaagaaaacaaagacatggcagaaggggatgtgttcgtgacagcgagaagcaacttgatcttgaggactctccttcttgtccctctgtgaagcctcttctaccacatagggctcagggctgataaagccccctccctacctttctcaggccagacacaaggtcagccatgagaaaacagaaaaacaagcagaagagagtctgtagagataagttgggagggttcaggaggagaatttgggatttgcttgtgcccatgggacacagtctgggaatacaaatgttttcctgactcttctctgaaagccagatagactccacctaaaaccctattgccaaggatgctgggatccacttaccagagactttgactatcatggatttggagatttccttgccagtggctgagttacgaacagagcaagcatagagcccgctatgatttgtagtaatttgggggataaagagcttttgtcctgatagctgaaacttcccattaattgtccaagaatactctgccggtgggttagagtccgcaaagcaggacaagtcgaggttttctcctgaacggtaataggtgaatgaagggtaaattctggggaggtctggaccatctggaggaaagagaataaagccacaggtgatgtcatccaagggaaggggatgctcctggtctcttaaagggacacagtgaccctctgaaccaagacacaacctcaagtgacagccaaatcccatctatgtttactaagcccaagcctgaggtattcccctgtttctctcattacaagctgtgggcccctagtgtcccatgacaagagcgcccctccccttatattcttggttaaggctgtgcctacccaggatttcccagggcagggagtcatggccaggtctgatgtccagaagtaaagttgtctatacttggaccggagagagactgagaggcctggcctctggtcgtttggagttaagctggtgtcctggcccacagaggaacaaaggatactcacagaggacattcagggtgactgggttactgcggatgccaccatatcggtcccgtatttcacattgatagggtcctgtttcatttctcgtgacactgggtagaatgagtatcctgttttcaatgggtcgctttaccctcggactgaccgggaggctctgaccatttagccaccaaatgtaggtgtagttccgactcttaggttcacaggtgaaggctaacacatccttcttctccctggggtttaagttgttgatggtgatgtaaggcatgggcagcttcgctgtgtggataacagaagattgtcctgtgtggcacctttgattcctccacaggcatccttcattcagagttggcatctcccacctgtcaacccacatgagtccttgaaagccagtagctggtgcatgtgtcacaagacagatgtatgatgatctaagggctcaaagactgtgaggcctcctgctctgtcttagggaagcacagactttctcaagtgtcaattgagcagcagtgttgggtcatggacagacacgtcagtgggagtcacagcccctggtacccctcccagtccctccataatcagttgactggctggctcaccctgggttccttacctggaatgtgcaactgctgggccccttccaaattacatcctactttgcccccctagatgtgatttctctgcagcttccatttccaaggacattctagagatgagtaataatgggacttcccattgtcctgaaaccctgcagatactgagcagcctggcctgggactggatgtttcagcagaaataacacagggaagaccagagtcaagcctgtaggtcagttcagtcatcaggcactagaggcaccaggtggggcagtttttttgcaggtgtttcatgatgacttacttgaaccagtgacctctaaagatagagcagagtgcaaggaatgatctagaaagagtgaaggggacaggcaagagctggtggctttggagcagaagcatgttccctgtcctgggttctttaagtttcctctccttctgcagagggcaggtgaggaccatgtggatctttctagaaatacatgtggacatttgcaaatgcagaactgagtggtggaaagggtgggaatgaactgctggaaatctagtcctcatggaccatgtgtgtttgatggatatgagacaaatttggagagaagttttgcaaatattttctttcattggacattctactctctgattccatgggttccactaatctagggacctcatgtaagttgattccagattgaatatgagacgaggctgctggaagccaggagctgggagtggggagaatcagaagttgttcatgggtgtgcagtttcagttatacaagttggagaggttctagagatctgctgtagagcttgatgcctatagttcacacagattatctcttatgcataagttttaggacaaaaagtgttttggatttctgatattttttgattctcaaatatttgtcatatacttactggtttagcatcccaaatctgaaagattcaaaatgtaaaatgcttcagtgagcatttcttttcagcatcagattagtaggcaaaagtgggaggtgataagccagatatattcttgcccttttttttctctcaccatgtttctagcttggtgattagttttcggtgaattccatagtggccatgctgcactcgtatatttttgaaggctttgggatgtgagaaaggctgattgctattttctatgtcatcagaactttccaccttttctggttgcttctttttctcagtgtttgtgttgtggcagtcattaagaagagcctgtcagctcagatttaggacagagttttctaaattctgcaaaaaatgttactgggattctggtaggggttgcattgaatctgcaactcaattgggtagtattgcctttctaacaatattgcttcttccaatccatgaaaatgaaatgtgtttccatatattgatatcgtctttaatttctttcagcaatgttttgtagttttcagggtataatcatttgacctttttggttaaacttattccaaaatattttattccttttgatgttaatgtgaattgaaattctttccttaacttcctttcagattgttcattgttagtgtattgtctaaagaatgatctagaaagagtgaaggggacaggcagaagctggtggttttggagcagaaacatattccctttcctgggttttgattttccctctccctttgcagagagcaggtggctcttccctgacagctagatagactttactggaaaacatggtgccaatgctccagggatccacttaccagggactatgatcctcttgattatgagatttgttccaccagtggctgagttatggatgaaacagacatagacccctctatatgttttagtgatttggggtataaagaacacttgtgctgattgctggaacttcccatcaatcagccaagaatgctctgccagtgggtgagagtctgtgaggcaggagagcttggggacttcccctgtatggtaataggtgtatgaggaagaaacggtgggagcatccaggccatgcggagcaaagagaataatgtcacaggcgatattgtcagagggaagggaaaatcctggtctgtggaagggacacagtcacagtgaccctgtgagccaagttgcaacactgaagtcccagccaaatccccgctgtgttcactgatctggagcctgagacattcacctgtttcttccatcacaagctgtggaacctgagtctcccatgacaggagaagcctcttctctcttattgttgatcaagcctaggcctactctggtttgcctggagcagaaagtcatggccagctttgatgttcagggataaaggtctctgtacttggacctgagagggactgagaggcctggcctctggccacttgtatttgggatggcagcctggctcacagaggaacagaagatactcacggaggagattcagggtgactgggtcactgcggctggcactcactgggttccgtatttcacattcatagggtcctgcaatatactttgtgacaccaaatagatagagggtcctgttggttttggacagctgcaacctgtgagtcatagggaggttctgaccattcagcaaccacaggtagcttgcatccggagtctcaggatcacagattaagcgcacagcctccatgacctccctggggtttaagttgctgctggagatggagggcttgggagtctccgctgtgcagaaaacagagagaagattgccctgtgtggcacctttgattcctccaaaggcatttttcaatcagagttggcatttccaacctctcagcccacccaagtccttaaaagcccatggcaggtgtgtgtgttacaagacagatgcatggcaacctgagggctcagtgattgtgaggctgcctgctttatgtaggagaagcatggactttctcaaatgtgaattgagcagcagcattgggtcatggaaagacacaggaccagcagtcacagcccctggtgcctctctgagtccctccgtctccaactgcctgcctggcccaccttttggtccttacttggggcatgcagtgctggaatcttgttagtttcagtctcactttgccccctgaggtatgttttctcatcagcttcccttgccaaggacatcctagagatggatgatggaacttcccattgtccttaagccctttgggtattagaaagcctggcctggaactgggtacttcagcagaaataacacaggggagaccagagtcaggcctggaggtcagttcagtcatcaggcagtggagccacaaggtggggcagttttccaggtgtctcatagtgactgagttgagccaatgactctaaagatagagcagagtccaaggaatgacctacaaagagtgaaagggacaggcaagagctgataggtttggcccaagaccatgatccctgttctgggtccatgatgctcccttccccctgtagagggcagttgaggaccatatggatctttctagaaatacatgttgatgtttgcaaatgcagaactgactggtggaaagggcaaacatgaacagatgacagaagtctggccctcagggaccttatgtgtttggtggatattagaccaatatttgggaagaagtcttgcagatactttctcttattagacattctactctctgattctgagtttgactactctatgtacctcatatcagtggattccagagggaatcagagattagaatagtagtttgcagcaactgaaatcacgggtatagggcgttgttccgtgggtgtgcggtttctgttatgcaggatgaggaggttctagagatctcctgtgcagcctcgtgcctatacttcatgcagatacagtgctccttatgcagaaagcttaaaacaaagtgttttggatttctaattttttttattttggaatatttgcagtatatgtactggtttagcatcccaaatctgaaaaatttaaaatccacaatgcgcgagtgagcacttctttttagcatcacatcagtggtcagaagtgttgagttttgagcatttcagattgtggatttctggatttccgatgctcaatttgtaatactgtaattttcccataaaaagttgtcaggagtttagacctcatgttatattctgactctagtaacaaaaaaaatttggaggaaaccttaaaatgttttcataagtggaaatttttactgatggtccaaacatctaagatcaattgctggtagtcatatttctcttgagaccaaaataaggtttaggtgtgccatgaattccagcaggatcacattatgctcaaagaaagatgccaaaggtgatttgaaattagcaactccttaagtagagagagtcctgttaaaaggaccgaactggttagtgtgtcaattacataaaaggaggaaggatgccaaattaaaagaagtgatgtgtgttatgttagtaaatatagaaagaacctgcttctaatttctgtgcagagttacaaaacatggggaggaccccaaaacaggtatgtgaaatgtcttcttcattttctcttaaggtcaggaaacaccactaaaatttaagtttgtgtgaattaggaagagtctaagtgagatgccaatggctcttgtgtctccccacacgaagaactccaacttatgaaaacggcatcatcatgaggaaatagttgtatgtggcacaggcagtaaaaccatgagataggacctacctggccacctccatctggtccccaaaccacaagtattcccgttaagtgtatgtgacagcctttgtagttgtcccacaactacaaaatttaaaaattgctattgtcaaaacaaaatattaaatatgaagttgaatatgttgttccgctttttttccccactctttttgagctttcctgtttcagttttggaagtttctattgacacattctcaagctagggattctttcctcagctctgtgcggtctatcagtaagcatcaaaagcattcttcatttctctaacagcatttttttttctgagacagagtctcgctctgtcaccccagctgcagtggcatgatctcagctcactgcaagctccacctcctgggttcatgccattctcctgcctcggcctcccaagtagctgggactacaggtgaccaccaccatgcccagctaattttttgtatttttagtagagacggggtttcaccatgttagccaggatggtctctatctcctgaccttgtgcccgcctcagcctcccaaagtgctgggattataggcgtgagccactgtgcccagccatctctgaaggattttaatgagttgttgacttttgagtttgttcagctttttacttagtgttagaaccgagtgacaaatttcaagcttgttttatgcctgacaggaagccagaagtctctagaaagtgaccggagaatgtgagctccatagcaggttgaggatggagtcactagtgaaatgggtgaaatgagcctatgggcttaattgctcctataattgctcctatagataacatcactattgtagaacgtgagattggtcttttgaaatgtttctcattcttttgccttctgacaaccggctgacctcatccatacctatgcctaatggctcagccagtcatgtggcccctacctagaggcagattcaagcactaacagatcatttccctccgcccgcatgattccatcaccaatcagcagtactcattttttagtcctgtgcccctgaaactatccttgaaaatctctaacacctgatccactggggaggctgatttgagtaataataaacctccaccctcctgtttggcagacttggagttcttaaaatctttctttactgcaaaccaccatttcaataaattttattttattttatatttttttgtgtgcaggaggccagaggaacttgtctggcaattacaagggtggatgggggaactgcctatccctgtcccatggtcttgtccacaggtcagcctcacaaagggaaagagccctggatgggaatacagtggaaggtttctcttagtgacctggggacattggctcgagaggaagcctggcaggagtggcaactccaggtgatttctgcacctttcctatttcctgggaggtgggccaggccacagtgttagcgggaagggaacagaacagccagcctagttagagggagtgtctggggaaggcctagggttggaggaagaagctgtgcaggacagggcttgccagtcagaatgaagtgggaggaagatgagggacacagagaagcagagagaggcagagacaccatggcagtgagcagtgagggagacactgacttcaaaaaccccagggaccaggtgcccccagctccacagtccaggaccaaagagccctgagaaccctccggtggccaaagaacttcagagttgcatgaggtggggtggctttagggtcaagaggtagtggggggatgaaacatgggtgtcagcctctgaaggacaagggacaggtgtggctagaacctcctaggattctgattccaagatccagtctctaaagaggttttggatcatccatttcttcattccattccttcatttgttatgtgagagctcctgagtgtgtctctctcactgggcctgtgctgaggcagggtgtgagtggggaaagaaaacaaggtcctctccttgatcctctcatgacggtgacatggacacttgggaaacacaggatttcacattcagtgatggaggttaagatctgagggggagacctggacattttttttgcactgactctggcggttgaagccagtgatttagttctggagtacagactaatcagctgaccatttgctctcactcctctgaggtttggatgcctaagaagagaggatttgagtcaataaatgactatggggtccttggaacccagtaagccctcacttctggtagaggagaggatgggcctgtggctgcagacagacctcatgtgaccccgatctcccctttgtgtttgtgtgactgtggctcagtgactgtgccttcctgtgcctcagttttctctcaatcaaatgagctaaatggcaaatggactgtggcttttcatgctatctgtgaataaatgttaaagtattcacagtcaactgacttaatgcttggcacagtggaggtgttcacacaaacagcatttattattaatttgcttccatgagaaagcacctttgcgtcagatccctgtggacaaacggctacctggtgcatcttctctcttctgtttctgcttctggggatattagactttctatggagtgtcctaggcctcctaaggcagttggctgatggcctacaaagcttgtctttctgtcctctccactctgagtgtcaggtgaagaaagctctgtccttgcccagatgaggctctgaggactgagccctggctggtgaacagctccaggagacacagtcctcagacagctggtaaatccttggtcccagtaagccctgccaaagaagccacaacccagtcctggcacaggctcctcagctttacctggagcaaggatttagggacaggggtctgggattgaggcttccagagctgaggttctctgagggtatctcagtgggcccctcaggccaagccctactcagttttccagggtctttctcagggtcaaatttatgaagagggcatgaggtgcttggctgagactgatctcctcctgctgagtccccccatcagactgtccttcctctgcagcgagtgtctgcagggtctggatgcgggaaaggaattctgatctgttgaaatgtgtctcctctgtgtgtgtcctgcactaaatgcccaaaccccagcatgggacataatgcagagagtgacacaggcagagtccaggcctgacaattctgtgtgtgtgaagtagaaatgacccctgccccccaacacccagggatcatgcggaatcactcacagtataaggtgacagtgaaatatccagttactcctccagtcccatcgcctcgctttatgatgtgtaaggtgtaggatcctgcatcctcctgtgtgacattctggatcagcagggatgcattggaatatactgtttctcgtccactgtaggcaggcccatatataatttgaccgtgtactacatatgatgtaatgtaatggtagaggtccgtcatttgccctttgtaccagatgtagccagtaagattctggggcaaattgtggacaagtagaagaacatccttcccctcggaaactttgggtggcttggcttcaattattacttgggcagtggtgggcaggttccagaagtttaaaagtgatgctaggaggtagagacagcatcagttaatatttggacctatgtattggggtgaaaagatggggccctgtgtcctgagaaggtctcttcaatcatcagccttgaagatatgcacacacacacatacaaacacacacacacaaaagggcatgtgtgtttgtgtgtgtgtatgtgtgtgtgtcctactgtcctactaggtcaaggtcagcagcatgacccccattccttcaacactcctgaccttggcatttttctgtttgcaatcctcttccccaggggtccgcacggccccctccacactgccctcaggtcctgctcacatcagggcatccttagacttctttcctgatgcctgcttcagagaccctgggtcttccctttctgacctttccctgctctgctccctctagggttcttgtcaacacctgacctcacattctatatctctttgcatgtctgtcttcctccccatgagagtgtgagctctgtgaggacagagacttttgtcatgttggttgcaccccagtgcctggaacaggatgcagactcctgtagatgtgagagttctcagggccctccatgccctgggtgttttttttcccccaattgttgaggttttttgctgaggaaagtgtttcatgccctggttacatttttatttgaggtgtcatctgatatagtcattattatcatttttcaaaatgtggtggcccctgatgattaatcaggaaaacagaacacttaagattttactacctcttaccaattccggttcaatgtgactttcctattttgacccctgtccctctctggtgtattttcccctatccaggctccaacagagccttctttccctttttttctttcttctttttattcttttttttttttttttttgaaatggagtctcgtactgtcacccaggctggcgtgcagtggtgctgtctcggctagctgcaacttctgcctcctgggttcatgtgattatcctgcctcagcctcccgaaagctgggattacaggagcacaccaccatacttggttaattttttgtattttttggtagagacacgtctacactgtgttggccagactgatcttgaactcctgatctcgtgatccacccacctcagcctccctaagtgctggcttcttttattttttagaaccccatcctctccaggataccccatccagtcactctgcttcctcctcctgtcctctcccaggaagtcctctcctcacctgtgagcaggagccccttccaggtgatgtgctgagtgcagggaggggctgagaggggtcccatggtctctgctgtctgtgtgttctcccctgtggagatgagcctaggatccagagacttcctgagcagggctgtcaggtgtgctgtccttcctccttctgtgctgagcctcttcccagggcagaagcacttctcaggctcatgggcggggtcaggcccaggacacctctctgtcccctcctctctcagtcctgcctccttgtccctccttctgtttttccttttgtctgtgtttcaggtccctgggaattgtggaggcctctgcctttttcagcagtgattctttcaccaaacctcaacacacactttgtgcagacacacacacacacacacacacacacacacacagacccacacagtgacacacataccctgcaggttgggcgaggacagtcctgggcctcagcctcctgctgtccccatggctctgggtcggggtgcacattcatgccatttgccctctttcatccccatctggctctccccttcagtgcaggaggctggagctgcaccaggtccctttcacagtgatgtcccattgtgctgtgggtgagctgtgtgttgcctggtgagagggacccttcctttttctaatcgtgtctagcttggctgcagcttccaaggatggtcattcaggacctgggtgtcccagaggaaactgtccttcctggaggtgtgcagggtgaatctctcatgcctcttgggaggagaggcctgtgcctgttgctcagtggtggctgtgagtcccatagtcaaagggaaagttctcggtcactgtatgactccgtggggtccggtggctgagctggagctcatggtttctcatgttcttcctgaccatctttgatgtcctctcttctctgcccagctgattgtcctgtggtcaccacagcttctccgtggtggtgcagaaggaagtgaggagttaaacaggaacccggtgggacatggctcgttgagacgcaggagggggagcctgggtcggagcagagtttcagagctggagagattcatcccgaccaactccgtggcaatgttgggcagagcctttcatgtgttgacatacccaggggtctgtcctgagggtttttgacctggccaagctgctgtgtgtagaggaggaacaggcagtggccagagatcctgtctggagggacgttgctcacacctgagcgggcgggtggggggtgagttgtgttctgggagcaaagagcaataacatcccccttctccccgcaagcacacaggagaggtctgtcttcccaagggacagctggggataggtggccacacctcggatggtgcctgtgtgtgaccatcacacgcgctctgagccccgtggggtgcagcgtgcaggcaggtcacagggtgcctggctgattcccggtgaggctgtgggccctcaggcagccgctattctgtgtcagcgctaagcttggcctgggatgccccagggaacaggacagatggagcaggggcgggcatttagggagcggtgacagaaagagttgatgaggatggagggaggtcacgaggggaaagcgcccagtgtggcatcgcgtgcaccagcgctgccctgggagatgcctttagctgggcccagggaaggagcaggtgtgtggggcaggagctacctgcagagggcgtggtgttaggttggtggcccccaggtcagggaggagctgacagagtccgtgtggggagcatggagggcgctgaggacttaggccgaagtgaccctggtgagggtggacactgctgggctgtgggttccgctgagggaggttggcttcccctgggaaggctccaggctgggagggactcggtcaccctctggtggacagggagggaagtgtgaacggcagcaatcccaggccaggctgcatgttttattccacgtggatctgcacacttcacacgaggtaacacgtatgttatgttacagctccttcaccttccagccccgtgagacccagtctttgtggctgtacgttcactgttctccctctttcacagtcagatgtcccaaaggcagatttttgtcacctttgtgagtttgtgtttgtgtgcagtaggtggcactgtgtataccctgggagcagtgatgtctggggctgagcagtgcacgtgggcttgggagcagaagagggagcagcagcgtgggaagatcaatgtcagaggggcagggacaagtcattttcattttctcactcccagggaccaatcccaggattctgactccagggcacagtaccacaccctgcttgtgtccctggatgtcatgatgctcatagtgtcatgttgccttggcattcattttttaaggtgtaagtttatttgcctcaaatcagaggcagggcttggtcaccatggcagttttcaatactgtatctggttcaagtggctccagttggtggccagagataaaatcttagaggtatctctcctgcttggtgtgctgggctcacctctctccagctgctttctttaaactgataattctgacatttgccctcacatttaaagtgaccacctctcagtcacagcttgagctcctggtcccagtgtttgctgcttgctttgaacacatccattaaagctccctgctggaaacctgtcagataacaccctggacttaataaaggcattggcttaccggtctcttctctcctccctgcctgggctcactgacctctgtgtctgtggcctccaggtgtgctgagtgctccctagtgtctgtaagtagtaaaaatacttatattttcacgttcttgttatatcattatagcctcacatgccatccagggcctgacattgaggctgccctatgggacttgtgctggttgagcttctgctggagctcttgttttggggcctctggttctcctggggacaggagcttccagctaacttgattgaaaacctgatgcctttcattggaacactgggtcaggtgatgtattcatgggcttcacctgccataacataaccttagcctgggtgaattaaataatagaaatctatttttcacagttctgtgaataatgtgctattttaaccactttaaaatgcacaatcaagtgaaattaaccacatacaccatgttaaattaccatcaccactatttttcctagaaaatttttatcattttaaactgaaactttgtcacttttaaacaatacctccctgtatgttccaccctagaccttgatcatctccactctctctctatgaatttgcctattcttgatgtttcatataaatggaattatacaattatgttattttgtttctgacatatttcacttagcataatgtttcccaagtccatgcatgttccagtgggtgtcagagcttcattcctctttatggcaggttaacaatctgttgtatgtgtcaccatatttgtttattcatgtgttgatgaacacttggattattttcatattttatcttttgtgaataatgctgcaatgaacattcccatgcaagtacctgtttgaggccctggatttaattctttgggtatgtacctaggaatgcctgttgtttcaaatgagaattctatgattagctttttgaggaacagcaaaactctttctccaagtggctgtaccttttcatattctcaccagccatgtatgaggattccaaattctacataatgctgctacttgttgtttaacattttaaaagaatggtagccagttttgtaggtgtgatgtggtgtctcattgcagctttgactttgtattttcctaatgactatagatgttgagtatcttttcatgtccttcttgactatttgtatatcttctttgaagaaatgtctatatgagtcttttgcccatttataaattggatggtttgtccttttgttattgagttttagctagttctttatattaactggatatgaaaactgcctatatgtggtttgcaaatattttctttcattcttttctattaattattttcttgataatttcctttgatgtacaaaaggctcacatcttgataaagcccaacatatcttgtttttcttgtttctcatgcttttgtatcatatctaagaatccattacacatttgagttcatcaatatttacctctatgtctagtttaagatgtttttatggttataggtcttatattttactcactcatcaattttttagagaattgtttgatatggtgggaggcagagttatctaaattcactgttttgcatgtggttatctagttgtttctgtactatgatttgaaaggagaattgttcatccattaaattgtcttgacaccctcttcaaggagtaattgaccataagtttgagggtttatttctagattcttaattctatcccatttgtctttatgtctattcttttgccagcagcttatgtctattctttggcagcagcttccattttaataattgtactcttttgtgagatttcaaataagaaagttcaagtcctacaatttattttggcaagattgttttagctactcaggggtacttttttgaaaggtggggaggccaatgtttcacaattgggaaagccttttctctcttcttcagggggaaatttgggagaagcttttaagaaactttatctaagtaggtaaactgtcaccactttatttgctgaagtgctatgttaaagtgtgcattgcctcttgtggaagaattatgagaccctggaagcacttgcccatgtggtgagagacagtgaattccacgatgaggggcagagaggacattgttttgggatacagtgttgttgggggagttgtatacatctcaacttctttatgtctctgtacagtgggtgtagggagcagccccacagggtcgttgggtttttctccctgtgtgtggagatgagagattgtggaaataaagacacaagactaagagataaaagaaaagacaactgggcctgggggaccactaccaccaagatgcggagaccggtagtggccctgaatgccaggctgcactgatatttattggatagaagacaaaggggcaggataaggaatgtgtgccatcttcaatgataggaaatgccacctgtgtcacatgtccactggacagggggcccttccctgcctggcaggtgaggcagagagagggaggagaatgagagagagagcttacagcattatttctgcttattagagacttttagtactttcactaatttgctactgctaactaaatggcagaaccacgtgtacagtatggaacatgagggcggactaagagtgtgaccactgaagcacagcatcacagggagacggttaggcctctggataactgtgggtggacctgactaatgtcaggccctccacaagaggtggaggagtagagtcttctctaaactccgccggggaaagggagactccctttccggtcggctaagtagtgggtgtttttccttgacactgaggctaccactagaccacggtccacttggcaaagggtgtcttcccagacgctggtgttaccgctaggccgaggagccctctagtggccctgtctgggcataacagaagccttgcactcttgtcttctggtcacttctcactatgtctcctcagctcctatctctgtatggcctggcctttcctaggttatgattataaagcgaggattattataatattggaataaagagtaattgctaccaactaacaattaatgatattcatatataatcatatctaagatctgtacctggtataactattcttcttttatattttatgatactggaacagctcatgccctgagtctcttgcctcagcacctgggtggcttgccgcccacaagtgggcatctccattggacacagtaggttttgaaatccttgtttatcctctggggtctgggtcttggcttacctattagctgcaactgaaagaggagtctgttaagtcaatgactcctgtacggagtagaaggtttcagcagagtgaaagtagctggggttcatagaagccaggaatgtctgactcttagaaactgtgtgtcagcagatgggtgtcctcaggggtacatgggccatgccagtagccactgcagtggactggaagaaggtaagggatgctgggtatcccatgttctctctcagctctgcagctgaagatttgggccctgggcttgtacgaccctgaagcaggggaagggtatacaggaatggctgcatatcaggaccaagtccatgtcatcttctgaggcattgttactgcagatggaggattctgttcagagaccaggcctggacacatgggagggcccaccccattcttttaaaattgttttaagagaacagtattagcaaatgtagtacatgttttattctgctagaatcagtcttactgtcacgttttacaatgtatctcttaggaaatggtgagagccatccacacaatgtgcatttaaaggggagtctactataatttcagctttcctactctttatagaaaccatcttctctgcaaacacacaggcaatatctctgtgttcatttctattgggagccctgtatgcaagatggagagagccacatttcctcctgagatgttatgtaaaagtctgaggttgagatgacatatctgacactctgttgttaccctcagaagctcctatactacatgtgaaattctaatgactgcattatcctgccaagtgaaagaggcaggcacaagcaaggacagctaagaggggtgagagcctcatcatgatggggagtcttattctgacatcttgggaaaagctgtccacagtgtgaagtcatcaacttgttttccttgtttacagtttgagcagctgttgttatggtgttgaacattttggtgagttctgagtggctcagacatcaggtacaaggattttcccatgaaatttacattgagttgtccaactctgacttatagggcttctggaacagagtgggtcttgctctttgaggttccatgggagaagatggaattggaggaactagtagaattcagggtaatgtccagtctacagtggataataaaaacacagaaacaatgaacagagctgcaatctcataacaggtgtactacggttttattttccacataatttttctctctatgggcatctctagttttaccaatgataatttcagtagaataagtttgtttgcaaaataggttgagtttcttcaaacttggtctgattgtttacataagtgcagcaagagtagcaatggactatgtaggctctcttttaaaattttctttgctgtaagtttttataaggaatctcagattaaacctttacaaaactcttgagaataggaagccaaaccaaggctgacttcagagtttgcctgcagttcatactggttcattctagctatattcttaaatataacatcccagtcaaagccttggtaatataaccaatgatttgaaatgtgtcctgttacaaagagagcaggttgttactctgtttgtgcaaatatctgtattaccataaacatatcaatactcatgaatagttgcccaattctggggcattcaggtagagagcaaaagtaaatatttcaattatcattcccagaagtatagtttattgaaccactataagctagagatagattaaaagacaaatttccataaatctagaaaactatccacataaagaatcagcatattttcaaataaaaatcataaaaacattatcctcattattatcaattatttcaatgaaatcaatgtttttcctgcttggtctaggctgggaatgttatgaagatatcagcctgtttgttaaagttttcgaagttcttagacaaatttggagggttcaggaggaaaatttgggatttgcttgtgcccatgggacacaggctgggaatacaaatgttttcctgacttttctctgaaagtcagatagactgcacctaaaaccctattgccaaggatgctgggatccacttaccagagactctgactgtcacggatttggagctttccttgccagtggctgagttacgaacagagcaagcatagagcccgctatgctttgtagtaatctgggggatagaaagcttttgtcctgatagctgaaacttcccattaattgtccaagaatactgtgccggtgggttagagtccgcaaagcaggacaagtagaggttttgtcctgaatggtaataggtgaatgaagggtaaattctggggaggtctggaccatctggaggaaagagaataaagccacaggtgatgttatccgagggaaggggatgctcctggtctcttaaagggacagagtgaccctctgagccgagacacaccctcaagtgacagccaaatcccctctatgttcactgagccgaagcctgaggtattcacctgtttctcccatcacaagctgtgggccccaagtctcccatgacaagagcgtccactccccttatattcttggttaaggctgtgcctacccaggttttcccagggcagggagtcatggccagctcggatgtccagaagtaaatatgtctatacttggaccggagagagactgagaggactggcctctggtcgtttggagttaagctggtgtcctggcccacagaggaagaaaggatactcaaggatactcacagaggacattcagggtgactgggtcactgcggatgccaccatatcggtcccgtatttcacattgatagggtcctgtttcatttctcgtgacactgggtagaatgaggatcctgttttcaatgcgtcgctttaccctgggactgaccgggaggctctgaccatttagccaccaaatgtaggtgtagttctcactcttaggttcacaggtgaaggttgagacatccttattctccctggggtttaagttattgatggtgatgtagggcttgggcagcttcgctgtgtgaataacagagagaagattgtcctgtgtggcacctttgattcctccacaggcatccttcaattagagttggcatctcccacctgtcaacacgtgtgagtccttgaaagccaatagctggtgtgtgtgtcacaaggtagatgcatgatgatctaagggctcaaagactgtgaggccacctgctcagtcttagggaagcatagactttctcaagtgtcaattgagcagcagtgctgggtcatggacagacatgtcagtgggagtcacagcgcctggtacccctcccagtccctcactaatgagttgactggctggctcaccctgggttcattacctggaatgtgcaactgctgggccctttccaaattgcatcctactttgcccccctagatgtgatttctctgcaacttccatttccaaggacattctagagatgagtaataatgggacttcccattgtcctgaaaccctgcagatactgagcagcctggcctgggactggatgtttcagcagaaataacacaggggagaccatagtcaagcctggaggtcagttcagtcatcaggcagtggaggctcaaggtggggcagttttttgcaggtgtttcatgatgacttacttgaaccagtgacctctaaagatagagcagagtgcaaggaatgatctagaaagagtgaaggggacaagcaagagctggtggttttggagcagaagcatgttccctgtcctgggttctttaagtttcctctccttctgcagagggcaggtgaggaccatgtggatctttccagaaatacatgtggacatttgcaaatgcagaactgactggtggaaagtgtgggaatgaactgctggaaatctggtcctcatggaccatgtgtgtttgatggatataagacaaatttggagagaagttttgcaaatattttctttcactggacattctactctctgattccttggggttgactactctagggacctcatgtaagtggattccagagtgaatatgagaagagactgctggttgccaggagctgggagtggggagaatcagaagttgttcatgggtgggcagtttcttttatgcaagatggggagtttctagagatctgctgtagagcttgatgcctatagttcacaaagatggagtatttcttatgcctacaacttaggacaaaaagtgttttgcatttctttcattttttgattctgaaatatttgtcatatacttactggttaagcatcccaaatctgatagattcaaagtctaagatgcttcagtgagcatttcttttcagcatcagattagtaggcataagtgggaggtgataagccaaagatattcttgcccttttttttctctcaccacgtttctagcttggtgattagttttcggtgaattccatactggccatgctgcacttgtatatttttgaatgccttggcatgtgagaaaggctgattgctattttctatgtcatgagaactttccaccttttcatggttgcatctttttctcagtgtttttgttgtggcagtcattaagaagagcctgtcagctcagatttaggacagagttttctaattctgcaaaaaatgttactgggatgctggtaggggttgcattgaatctgcaactcactttgcgtagtattttctttctaacaatattgattcttccaatccatgaaaatgaaatgtgtttccatatattgatatcatctttaatttgtttcaggaaggtttgtagttttcagggtataatcatttgacctttttggttaaacttattccaaaatattttattccttttgatgttaatgtgaattgaaattattttcttaatttcttttcagattgttcattgttagtgtatagtctgaagaatgatctagaaagagtgaagggtacaggcaaaacctggtggttttggagcagaaatatattccctttcctgagttttgattttccctctccctctgcagagggcaggtggctcttccctgatagccagatagacttccctggaaaacatattgccaatgctccagggatccacttaccagggactatgatcctcttgattatgagatttgttccaccagtggctgagttatggatgaaagagacatagacccctctatatgttttagtgaattggggtataaagaacacttgtactgattgctggaacttcccatcaatcagccaagaatgctcggccagtggatgagaatctgtgaggcaggggagcttggggacttctcttgtatggtaataggtgtatgaggaaaaaatggtgggggcatccaggccatgtggagcaaagagaataatgtcacaggtgatattgtcagagggaaggtaaaatcctggtctgtggaagggccacagtgaccctgtgagtcaagtcgcaacactgaagtcccagccaaatccccgctgtgttcatgatctggagcctgagacattcacctgtttcttccatcacaagctgtggaccctgagtctcccatgacaggagcagcctcttttctcttattgtggatcaagcctaggcctactctggtttgcctggggcaggaagtcaccaccagctttgatgtccaggggtaaaggtctacatacttggacctgagagggactgagaagcccggcctctggccatgtgtatttgggatggcagcctggctaacagaggaacagaagatactcacggaggagattcagggtgactgggtcactgcggctggcactcactgggttccgtatttcacattcatagggtcctgcagtatagtttgtgacaccaaataggtagagggtcctgttggtttcagacagctgcaagctgtgagtcatagggaggctctgaccattcatccaccacaggtagcttgcatctggagtctcaggatcacaggttaaaatcacagcctccgtggcctccctggggttgaaattgctgctggagatggagggtttgggagtctccactgtgcggaaaacagagagaagattgccctgtgtggcacctttgactcctccaaaggcatttttcaatcagagttggcatttccaacctctcagcccacccaagtccttaaaagcccatggcaggtgtgtgtgttacaagacagatgcatggcaatctgagggctcagagattgtgaggctgcctgctttatgtgggagaagcatggactttctcaagtgtgaattgagcagcagcattgggtcatggaaagacacaggaccagcagtcacagcttctggtgcctctctgagtccctccatctccaactgcctgcctggcccaccttgtggtcctcacttggagcattcagtgctggaatcttcttagtttcaatcttactttgccccctgtggtatgttttctcttcagcttccctttccaaggacatcctagagatggatgatggaacttcccattgtccttaaaccctttgggtactggaaagcctggcctgggactgggtacttcagcagaaataacacaggggagaccagagtcaagcctggaggtcagttcagtcatcaggcagtgcagccacaaggtggcgcagttttcccaggtgtctcatagtgactgacttgagccagtgacctctaaagatagagcagagtccaaggaatgacctacaaagagtgaaggggacaggcaagagctgataggtttggcccaagaccatgttccctgttctgggtccatgatgctccctttcccctgtagagggcaggtgaggaccatgtggatctttctagaaatacatgttgatgtttgcaaatacagaactgactggtggaaagggtgaacatgaactgatgatggaagtctggtcctcatggaccatatgtgtttggtggatattagaccaatatttgggaagaagtcttgcagatactttctctcattagacattctaccctctgattctgagtttgactactctatgtacctcatatcagtggattccagagtgaatcagagagtagaatagtagtttccaggagctgggattaggggaatagggcactgttccgtgggtgtgtggtttcagttatgcaggatgagggggttctagagatctcctgtacagcctcatgcctatagttcatacagataaagtgctccttatgcagaaaggttaaaacaaagtgttttcaatttctaatttttttattttggaatatttgcagtacatgtactggtttagcatcccaaatctgaaaaatttaaaatccacaatgcgccagtgagcacttctttttagcatcacatcagtggtcagaagggttgagttttgagcatttcagattgtggatttctggatttgggatgctcaattcgtaatactgtaattttcccataaaatgttgtcaggagtttagacctcaggttatgttctgactctaataacaaaagaaaaatttggaggaaacattaaaatgttttcattagtggaaatttttactgatggtccaaacatctaagatcaattgctggtagtagtatttctcttgagacgaaaatgaggtttaggtgtgccgtgaattccagcaggatcacattatgctcaaagaaagatgccaaaggtgatttgaattagcagctccttaagtagagagagtcccgttaaaaggacagaactggtcagtgcatcaattacataaagagaggaaggatgccaaattaaaagaagtgatgagtgttatgttagtaaatatagaaagaactgcctgcttataatttctgggcagagttaggaaaaatgcggaggaccccaaaacaggtatgtgaaatgctttcttcattttctcttaagctcaggaaacaccactagagtttaagtttgtgtgaattagtaagaggctaagtgagatggcaatggctcgtgtgtctccccacacgaagaactccaacttatgaaaacggcatcatcatgaggaaacagttgtatgtggcacaggcagtaaaaccatgagatagcacctacctggccacctcgatctggtccccaaaccacctgtattcccattaagggtatgttacagcctttgtagttgtcccacaactacaaaatttaaaaattgctattgtcaaaacaaaatactaaatatgaagttgaaatgttgttccactttttttcccccactctttttgaactttcctgtttcagttttggaagtttctattgacacattctcaagctaggtattctttccacagctgtgtgcagtctaccagtaagcatcaaaagcattcttcatttctcaaacagcattttttttttctgagacagagtctctctttgtcacccaggctggagtgcagtggcatgatctcagctcactgcaagctccgcctcccggtttcactccattctcctgcctcagcctcccgagtagctgggactacaggtgcccaccaccacgtcccactaattttttgtatttttagtagagacggggtttcaccatgttagccaggatggtctgtatctcctgaccttgtgcctgcctcggcctcccaaagtcctgggagtataggtgtgagccactgtgcccagccatctctgagggattttaacgagttgttgacttttgagtttgttcagcgttttacttagtgttagaaccgagtgacaaattccaagcttgttatatgcctgacagaaagccagaagtctctaggaagtgacaaaagaatgtgagctccatagcaggttgagaatggagtcacgagtgaaatgggtgaaatgagcccatgggctttgggaactgcaggcccttccagcctctgacaccctgatgagtccgtgcaaagattacaacagtgacagcaaactagcgtggctgactccatctggcatctagtctcaggctggctgtcctcactcattcctggacataggccaggctatccttgggaagaatttggtttatggtttaactttgaagcaagaatgatgatagttcctccataaaactaacacccttactttgcccagggactgccttggtaaaactagtgaaagaccatgagatttagattataagagggaactgaattctgctaaaatgttggcacagtttctataatccctgactgctccagtgtcatttggcaagagtttacaaaatttgtaactaattgctcctatagataacatcactattgtagaacgtgagattggtcttttgagatgtttctcattcttttgcattctggcaaccggctgacctcatctatacctatgactaatggctcagccagtcatgtggtccctacctagaggcagattcaagcactaacagatcatttccctctgcccacatgattccatcaccaaacaatcagcagtactcattttttagtcctgtgcccctgaaactatccttgaaaatctctaacccctgatccactggggaggctgatttgagtaataataaacctctgtcctcctgtttggcagacttggagtcattaaaatcattctttactacaaatcaccatttcaatatatatatatatatatatatatatatatatatatatatatttttttttttttttggtgtatgtatgtgtgcaggaggccagaagaacttgtctggcaattataagagtggatggaggaactgcctatccctgtcccatggtcttgtccacaggtcagcctcacaaagtgaaagagccctggatggaaatacagtggaagctcattctcttagtgacctggggtcattggctcgagatgaagcctggcaggagtggcaactccaggtgatttctgcacctttcctatttcctgggaggtgggccaggccacagtgttagcgggaagggaacagaacagtcagcctagttagagggagtgtctgcggaaggcctagcagtggaggaagaagctgtgcaggacagggcttgccagtcagaatgaagtgggaggaagatgagggacacagagaagcagagagaggcagagacaccatggcagtgagcagtgagggctacactgacttcagtgaccccagggacaaggtgcccccatttccacagtccaggaccaaggagccctgagaaccctccgtggccaaagagcttcagagttacatgaggtggggtggctttaggggcaagaggtagtggggtgatgaaacatgggtgtcagcctccgaaggacaagggacaggtgtggctagaaactcctgggattctgcatccaagatccagtctctaaagaggttttggatcagtcatttctgcattcaattcctttatttgttatgtgagagctcctgagtatgtgtctctggctgggcctgtgctggtgcagggtgtgagtggggaaagaaaacaaggtcctctccttgatcctctcatgacagtgacatgggaactttgggaaacacaggatttcaggttcaatgatgggtgttaagatctgagggggagacctggacattttttttgcactgactctgatggttgaggcagctgatttagttctggagtgcagactaatcaggtgaccacttgctctcactcctctgaggtttggatgcctaagaagagaggatttgagccaataaatgagtatggggtgcttggaacccagtaagccctcacttctggtggaggagaggatgggcctgtggctgcagacagacctcatgtgaccctgatctcccctttgtgtttgtgtgactctggctcagtgactgtgctttcctgtgactcagttttctctcaatcaaataagctaaatggcaaatggactgtggcttttcatgctatctgtgaataaatgttaaattattcacagtcacctgacctaatgcgtagcactgtggaaatgttcaccaaacagcatttattattaatttgcttccatgagaaagcacctttacgtcagatccctgtggacaagctgctacctggtacatcttctctcttctgtttctgcttctggggatattagactttctatggagtgtcctaggcctcctaaggcagttggctgatggcctacaaagcttgtctttctgtcctctccactctgagtgtcaggtgaagaaagctctgtccttgcccagatgaggctctgagggctgagccctggctggtgaacagctgcaggagacacagtcctcagacagctggaaaattcttagtcccagtaagccctgcccaagaaaccataacccagtcctggcacaggctcctcagctttatctggagcaaggatttagggacaggggtctggggttgaggcttctagggctgagcttctctgagggtctcagggggcccctcaggccaagccctactcagttttccagggtctttctcagggtcaaatttatgaagagggcatgaggtgcttggctgagactgatctcctcctgctgagtccccccatcagactgtccttcctctgcagcaagtttctgcagggtctggatgtgagaaaggaattctgatctgttgaaatttgtctcctctgtgtgtttcctgcaataaatgcccaaaccccagcatgggacataatgcagagagggacacaggcacagtccaggcctgacaattctgtgtgtgtgaagtagaaatgacccctgccccccaacacccagggaccatgtggaatcactcacggtataaggtgaaggtgaaacgtccagttactcctccagtcccatcacctcgctttatgatgtgtaaagtgtaggatcctgtgtcttcctgggtgacattctggatcagcagggatgcattggaatatactgtttctcatccactgtatgcaggcccatatttaattatttgaccgtctactatatatgatgtaacataatggtagaggtccctgatttgtcctttgtaccagatgtggccagtaagattctggggcaaattgtggacaagtagaagaacatccttcccctcggaaacttttggtggctgggcttcaatcgtgacttgggctgtggtgggcgggttccagaagtttaaaagtgatgctaggaggtggagagagcatcagtcaatattgagacctatgtgttgggttgaaaagatgggcccctgggtcctgagaaggtctcttcaatcctcagccttgaagacacacacacacacacacacacacacacacacacacacacaaacacacacacacacatataaaaggggcatgtgtgtttctgtgtgtgtcctactgtcctactaggtcaaggtcagcagcatgacccccattccttcaacactcctgactttggcatttttctgtttggaatcctcttccccaggggtccgcacggccccctccacactgccctcaggttctgctcacatcagggcatccttagacttctttcctgacacctccttcagagaacctgggtctttcctttttgacctttccctgctctgctccctccagggttcttgtcaacacctgatctcacattctagatctctttgcatgtctgtcttcctccccatgacagcatgagctccgtgaggacagggacttttgtgatcttggtcgcaccccagtgcctggaacaggctgcagactcctgtagatgtgagagttctcaggggcctccatgccctgggtgttttttttcctcccaattgttgaggttttttgctgaggacagtgtttcatgccctgcttatatttttatttcaagtgtcatctgatatagttattattttcatttttcaaaatgtggtgacccctgaggattaatcagaaaaacagaacacttaagattttcctacctcttaccaattccggttcaatgtgactttcctattttgacccctgtccctctctggtgtattttcccctatccaggctccaacagagccttctttccttttttttcttttttcctttttttcttttgggacggagtctcatactgtcacccaggctggcatgcagtggtgctatctcggctagctgcaacttctgcctcccgggttcatgtgattctcctgcctcagcctcctgagtagctaggattacaggagcacaccaccatacctggttaattttttgtatttttagtacagacagggctacattgtgttggccagactgatcttgaactcctgatctcttgatccacccacctcagcctcccaaagtgctggcttcttttattttttagaaccccatcctctctaggagaccccatccagtcactctgcttccttttcctgtcctctcccaggaagttctctcctcacctgtgagcaggagccctttccaggttatatgctgtgtgcagggaggggctgagaggggccccatggtctctgctccctgcgtgttctcctctgtggagatgagcctaggatccagaatcttcctgagcacggctgtcagctgtgctgtccttcctccttctgcactgagcctcttcccggggcaggagcacttctcaagctcatgggtggggtcaggcccaggacacctctctgtcccctcctctctcagttctgcctccttgtccctccttctgtttttccttttgtctgtgtttcaggtccctgggaattgtggagccctctgcctttttcagcagtgattctttcaccaaacctcaacacacactttgtgcagacacacacacacacacacacacatacacacacacacacacacacagaagagacacacacagacccacagagtcacacacataccctgcaggttgggcaagcgcagtcctgggcctcagcctcctgctctccgcatggctctggttaggggtgcacattcacgccctttggcctctttcatccccatctggctctcccctgcagtgcaggaggctgaagctgcaccaggtccctgtcacagtgatgccccattgtgctgtgtgtgaactgtgtgtttcctggtgagagggacccttcctttctctaatcgtatctagcttggctgcagcttccaaggatggacgttcaggacctgggtgtcccagaggaaactgtccttcctagaggtgtgcagggtgaatctctcatgcctcttgggaggagaggcctgtgctgattgctcagtgggggctgtaagtcccatagtcaaagagagagttctcggtcactctttggctccctggggtctggcggctgagctggagctcaggatttctcgtgttcttcctgaccatctttgatgtcctctcttatgtgcccagctgattgtcctgtggtcaccacaccttccctgtggtggtgcaggtggcagtgaagagttacccaggaaacccgcgggacatggctcgttgagacacaggagggggagcctgggacagagcaggggttcagagctggagagattcatcctgacttactccgtggccatgatgggctcagccctccatgtgccgacatacccaggggtctgtcctgagggttttgacctggccaagctgctgtgtgtagaggaggaacaggcagtggccagagatcctgtctgcagggacgttgctcacgcctgagatggtgggtgggggtgggttgtgttctgtgtgcaaagagcaataacacccccctttccccgcaagcacacaggagaggactgtcttcccaagggacagctgggggtaggtggccacatcccagatggtgcctgtgtgtgaccatcacacacgatctaagccaccaggggttcagcgggcaggcaggtcacagggtgcctggctgattcccggggaggctgtgggcccttaggcagccgctgatctgtgtcagctctaggcttcacctgcgaagccccagagaacaggacagatggagcaggggtgggcatttagggagcagtgacagaaagagttgatgaggatggagggagttcacgaggggaaagcgcccagtgtggcgttgcgtgcaccagagctgccctgggagatgcctttagctgggcccagggaaggagcaggtgtgcggggaggagctacctgcagggggagtggtgttaggttggtggctgccaggtcagggaggagctgacagagtccatgtggggaacatggagggcgcgctgaggacttgagccgaagtgaccccggtgagggtggaccctgctgggctgtgggttccgctgagggaggttggcatcccctgggaaggctccaggctgggagggactctgtcaccctctgttggacagggagggaagtgtgaacggcagcaatcccaggccaggctgcatgttttattccatgtggatctgcacacttcacacgagatcacacatatgttatgttacagctccttcaccttccagccccgtgagtcccagtctctgtggctctacgttcactgttctccctctttcacaatcagatgtcccaaacgcagatttttgtcaccttctgtgagtttgtgtttgtgtgcagtaggcggcactgtgtataccctgggggcagtgatgtctggggctgagcagtgcacgtgggcttgggagcagaagagggagcagcagggtgggaagatcaacgtcaggggggcagggacaagtcattttcattttctcactcccagggaccagaacccaggattctgactccagggcagagtaccacaccctgcttgtgtccctggatatcatgatgctcatagtgtcatgttgccttggcattcactttttaaggtgtaagtttattggcctcaaatcagaggcagggcttgtacaccatggccgttttcaatactgtgtctggttcaagtggctccagttggtgtccagagataaaatcttagaggcatctctcctgcttggtgtgctgggttcccctctctccagctgctttctttaaactgataattctgacatttgccctcacatttaaagtgaccatctctcagtcacagcttgagctcttggtcccagtgtttgctgcttgctttgaacacatccattaaagctccctgcctgaaacctgtcagataacaccctggacctaataaagccattggcttaccggtctcttctctcctccctgcctgggctcactgaacactgtgtctgtggcctccaggtgcgccgagtgctccctagtgtctgtaagtagtaaaaatacttatattttcacgttctggttgtatcattgtagcctcacatgccatccagggcctgatattgaggctgccctatgggacctgtgctggttgagcccctgctggagctcttgttttgggacctctggttctcttggggacaggagcttccagctaacttgattgaaaacctgatgtctttcattgaaacactgggtcagatgatgtattcatgggcttcagctgccataacaaacaccttagcctgggtgaattaaataatagaaatctgtttttcacagttctgtgaataatgtgctattctaaccactttaaaatgcacaatcaggtgaaattaaccacatacacagtgttaaattaccctcaccactatttttcctagaaaattgttatcattttaaactgaaactttgtatcttttaaacaataactccctgtatgttccaccctaggccttgatcacctctactctgtctctatgaatttgcctattcttgatgtttcatataaatggaattatacaattatgttattttgtttctgacatatttcacttagcataatgtttcccaagtctatgcatgttccagtgggtgtcagagcttccttcctctttatggcagattatcattctgttgtatgtgtcaccatatttgtttattcatgtgttgatgaacacttggattgttttcatattttatcttttgtgaataatgctgcaatgaacattcccatgcaagtacctgtttgagtccctggatttaattctttgggtacatacttaggaatggatgttgtttcaaatgagaattctatgattagctttttgaggaacagcaaagctttttctcttagcggctgtaccttttcatattctcaccagcaacgtatgaggattccaaattctacataatgctgctacttgttatttaacattttaaaagaatggtagccagttttgtaggtgtgatgtggtgtctcattgcagctttgactttgtattttcctaatgactaatgatgttgagtatcttttcatgtccttcttgactcttggtatatcttctttgaagaaatgtctatatgagtcttttgcccatttataaattggatgctttctccttttgttattgagttgtagctagttttttatattatctggacatgaaacctgtctatatgtggtttgcaaatattttctctcatctgtgtatattaattattttcttgataatttcctttgatgcacaaaaagctcacatcttgataaagcccaatttatcttgtttttcttgtttctcatgctttcgtatcatatctaggaatccactggatacttgaggtcatcaatatttacctctatgtctattttaagatgtttttatggttatatatctgatatttaactcactgatcaattttttacggaattgtttgataaggtgagaggtagggttatctaaattcactgttttgcatgtggttatctagtggtttctgcactatgatttgaaaggagaattgttcctccattaaactgtcttgacaccctcttcaaagtgtaattggccataagtgtgagggtttatttctagactctcaattctatcccatttgtctttatgtctattcttttgccagcaacttgtgttttaataattgtactcctttgtgagatttcaaataagaaagttcaagtcctacaatttattttggcaagattcttttggctattcaggggtacttttttgagaggtgggtaggccaatgtttcacaattgggaaagccttttctgtcttcttcagggggaaatttgggagaacctttaagaaactttacctaagcaggtaaactgtcaccactttatttgctgaagtgctatgttaaagtgtgcattgcctcttgtggaagaattatgagaccctggaagcacctgcccaggtggtgagagacagtgaattccatgatgaggggcagagaggacattgttttgggatacagtgttgttgggggagttgtacacatctcaacttctttatgtctctgtacagtgggtgtagggagcagctccatagggtcagtgggtttttctccctgtgtgcagagacgtgagattgtagaaataaagacgcaagacaaaaagataaaagacagctgagcctgggggaccactaccaccaagatgcagagataggtagtggccccgaatgccaggctgtgctgatatttattggaaagaagacaaaggggcaggataagcagtgtgagccatctccaatgataggtaaggtcacatgggtcatgtgtccactggacagggggcccttccctgcctggcagctgaagcagagaaagagagaagaaagagagagagagcttacaccattatttctgcttattagagacttttagtactttcactaatttgctactgctaactaaacagcagagccagttgtacaggatggactatgaaggcggactaggagtgtgaccacttaagcacagcaccatagggagacggttaggcctcttgataactgcgggtcgacctgactaatgtcaagctctccacaagaggtgaaggagtagagtcttctctcaactccctcggggaaagggagactcccattcctggtcggttaagtagcaggtgtttttccttgacactgagacaatcactacttcatggttcgcctggcaacctgcatcttcccagacgctggtgttaccgctacacgaaagatccctctagtggccctgtctgggcataacagaaggctcgcactcttgtcttctggtcacttctcactatgtctccccagctcctatctctgtatagcctggcttttcctaggttatgattatagagcgaggattattataaattggaacaaagagaaattgctgccaactaatgattaatgatattcgtatataatcatatctaagatctatatctggtataactattcttcttttatattctatgataatggagcagctcgtgccctcagtctcttgcctcagcaccttggtggcttggtgcccagaagtgggcatctccgttggacacagtaggttttaaaatccttgtttatcctctggtgtctgggtcttggcttagctgttcgctgcagctgaaagaggtgtctgctaaggcaatgacacctgtggggaggagaagggttcagcagagtgaaagtagctggggctcagagaagacaggaaagtctgactctttgaaactgtgggtcagctgatgggtgtcctcaggggtacatgggccatgccagtagccactgcagtggactggaagaaggtaagggatgccgggtatcccatgttctctctcagctctgcagctgaagatttcggccctgggctggtacggccctgcagcaggggaagggtacacaggaatggctgcatatcaggaccaagtccatgtcatcttctcaggcattgttactgcagatggaggattgtgttcagagacctggcctggacacatgggagggcccaccccattctattaaaattattttaagagaacagtattagcaaatgtggtacatgttttattctgctagaatcagtcttgctgtcatattttacaatgtatctcttaggaaatggtgagagtcatccacacaatgtggatttaaaggggactctactataatttcagctttcctactctttatagaaaccatcttctctgcaaacacacaggaaatatctctgttcatttctattgggagccctgtatgtgaggtgaggtggagagtgccacatttcccttgagatgttatgtaaaagtttgaggttgagatgacatatctgacactctgttgttaccctcagaagctactacatgtgaaattctaatgactgcattatcctgccaagtgaaagaggcaggcacaagcaaggacagctaagaggggtgagagcctcatcatgatggggagtcttattctgacatcttgggaaaaactgtccacgtgtgaagtcatcaacttgttttccttgtttacagtttgagcagctgttgttatggtgttgaacattttggtgagttctgagtggctcagacatcaggtacaaggattttcccatgaaatttacattgagttgtccaactctggcttatagggcttctggaacagagtgggtcttgctctttgaggttccatgggagaagatggaattggaggaactagtagaattcagggtaatgtccagtctacaggtggataataaaaacacagaaacaatgaacagagctgcaatctcataacaggtgtactacagtattattttccacataatttttctctctatgggcatctctagttttaccaatgataatttcagtagaatatgtttgtttgcaaaataggttgagtttcttcaaacttggtctgattgtttacataagcgcagcaagagtagcaatggaccatgtaggctctcttttaaagttttctttgctctaagtttttttaaggaatctgagattaaattttacaaacctcttgagaataggaagccaaaccaaggctgatttcagactttgcctgcagttcatactggttcattctatctatattcttaatataacatcccagtcaaagccttggtaatataaccaatgatttcaaatgtgtcctgttaaaaagagagaagattgttactgtacttgtgtaaatatctgtattaccataaacatgtcaacactcaggaatagttgcccaattctggggcagtcaggtagagagcaaaagtaaatatttgaattattgttcccagaagtatagtttattgaactgctgtgagctatagatagattaaagaaaaaaaattccataaatctagaaaacaaaccatttaaagaatcagcaaattttcaaataaaaatcataaaaacattatcctcattattatcaattctttcaatgaaatcaatgtttttcctgcttggtctaggctgagaattttatgaagatatcagcctgtttcttaaagttttggaagttcttagacagtccggtggtataatgtgaaaattatcagaaacttgtattagagagtacttgtcagcatcttttccataaatctccttgaaaaggaagcaattttggactgtagctgattggaaatgctttgaggaagaacaaaaacaacatctgtgaatgacaaagattttgaatgactatggttaaaactctgatgagaattcattatgataacacagctcacataaaaagttagttacttctgtggtacatgacattatggctgataacatatttaatttctaggaatctactttttccttcggggattacattaattttgtgggagggttgctggtagatgattagccaactatattcttgcagtttttttctatctcaatgtgtttctaggttagtgatcagtcttctgtcaatttcatcctgaccatgctgcactcagatatttttgaaggctttatgatgtgagaaaggctgactgctattttctgtgtcattagaactttgtacccttttatggttgcatctttttctcagtgtgtcagttgtggtaggcatgaataagactctgtcaggtctccatggcagcttgtgtttctcaagaggattactgagttcttggtggagcacattaatgaataggaccgagaaagtataggcttatgtatgttgaaaaatgtccctaggtaattccagcactcccagctaataattgattaattaataatcaattgacttgattgacagaaggcccaaatcagtgcattccagactgacaacctactttgcatagggtcctcactttcctgaagctcccagcagggatatgaaagcaagcccagttctatgagactctgttttattctcctgggtgactggtgggaagactccccatcagtcttcccatgctctctttgaactgtagctaaatcttctgtctctttctccttcgcaggaatcagatttgcatagtggtcccaaagctccccagatttttaagcctgccccaccttccctcacagacatttttcctaatacattatcctgcatgtctaatctcatcttggatgcatctcagtgggcataaactaacataccaggcttgatttttttgcacttagcttttttctgtctctcccacatgtagccagtaaccatgtcctagtgttttatgtgttacctcttttttcatgtttatagggaaaaaatatgtttccatatacttatttatatgtaatatatataataaaatgtgtaatataaaatgtataataatgtaaaacatatacacattttccatatatgtatatggaaaaagaggtaacacataaaacaccaggacatttacgtataataaaattgacataagttatatatgtatgtagtgtctggtagtcttaccctctttataaatacacactttctatcactgccccttccttccttcccatgtagagctcccatggccaaatctccctatttctccaagtttgtgtcactcactgtcctctgtgctgtgtcccatgtgctgtgtccgcagcctcctagtgttttatgtgttctctgtttctatatatatatggaaaaagcatatacatatttctctgtgtatatttatatacaatatataataatataaaaatatagaatatataacaatttaagatatatacatatttccatatctatgaaaaaaggtaacacataaacactaggccatttatatataaaattctcatatgtaatataaatgccaattttatcatatataaataagtatatacactatagatttatcatatataaggtgaatttggaatgccctgacctgggccctctgtcagtcaagtccttgccatggaggccattcatggctgccacaactgagacaccgagagaaagatgcaactatgaaaaggtgaaaagttctaaagtcatagaaaacagcaatcagcctttctcatatcccaaaattttcaaaaatatctgagtgcagcatgtccaagatggaattaaaaacttcaatcttgaaaaggaaaaaggaagctggaggattcacactttcagatttcagcatctactgcaaagctacagtaatcaatacagtgtggtactggcataaaggaggacatagaaatgaatgacatggaatagagaacccagaaaaaaagcttgcatatatggccaaatgatttttgtcaagagtgccaagaccattccatggggaaaggacagtctttttaacaagtgatactgggaaagctggctatccatggacaagtatgagttgaacctttacctcacaccatatacaaaaaatgaacccacaatggatcaaagacctaaatggaatagtgaagactaccagactcttagaagaaaacataaggaaaaagcttcatgatattgaatttcagaatgatttattagttataactacaaaagcataggcaacaaaaagggataaattggacttcatgaaaattaaaaacttttatgtatgaaaggccattatcaagaatgtaaaaaggcaaactatgacatagggaaaatatctgaaaatcatatatctgataagggattaatttccagaatacatgaagaacactacaaatcaaaaacagcaaaaatacaaaagcccaattaaaaaatggacaaaggactgaaagagagattttattaaagaagatatacaaatggccaatgaggacatgcaaggattctcaatattactaatatttagagatttgcaaagcaaaaccacggtgatacatgacctcacacacattaggatggctttgataaaaacaacatgaacaacatcacaaaacaagtgttttcaagtatgcagaaaaaatgaagctctttgtgtattgctgatgggaatgggaagtgttatagccactgtggaaaaaatggcatggcacggccggctcatgcctgtaatcccagcactttgggagctgagatgggtggatctcttgaggtcaggagtttgagaacagcccggcaagcatggtgaaaccccatctctactaaaaatacaaaaattagctgggtatggtggcatgcgcctgtaatcccagctactcaggacgctgaggcatgagaatcacttgaaccttggaggtggaggttgcagcgagccacgattgcaccattgcactccagtctgggtgacagaggaagacccggtctcaacatcaacaacagaaaagaaaatggtatgtcagtttcttaaataaattaaagcattaccacttgaaccagcaattctacttctggacatacagccaaaagtattgaaaaatatttaaacaggtatttgtacaccgatgttcacagcagcatcactcacaatagccaatgggtggaaacaaccaaaaagtctattgaaagataagtggatgaacaaaaagcaatatccatactttggaatgttcttcaatcttagcaaggtataaaattctgacacatggtgcaaaatggatgaaccatgaagacattatgcaaagtgaaataagccagacacaaaagcataattattatatacttccatttatgtaagatagttagaatagtcagttacttagagacagaaattagaatggtgattaccaggggttaaggggaggaggaatgagagttatcatttattgggttcagaggtttagtatagtaggataaaaaaagctctggaaatagatagtgttgatagtaacacaacactaaattgcacgcttagaaacagttaatagtaaatcttagatgtatagtgtctggtactcttaccttctctataaatacacactttttgtcgctgttcctcccctgccatagggagcttctgtgagttaatctccctatttctccaagtgtccatcactcactgtcctctgtgctgtgttccaggagctgtgtccacagactcagacaggcagtgacttcagagccaggacacagtcctattcccattttttaaagccttacccatgggaggcttggcttctactggccactcgatttagccagattcagaacaggccaccgaggcaccttatccacatgccctggccccagcccgggtggagtcagggcaggggcagtcactgggtgagcccacagcaatgcagggagcagtgtccgagctgcttctccctcacccaaggggcttcctcctctcatttggggaaaagtgtgggcttgttttgaagcctctgatgttcattgcagctcatggtgtacacacacacagacacacacacaaaggagacagaagggatgttttggtgacagaaacagcttgaccatgaggaccctcctctttctccctctgtgaaggcccttatactgcatagtgcttggggctgataaagccatttccctacatttctcaggctggacccaaggtcatccaccagaaatccggaaaacaaagggaagagaatctgtagatatgaattgggagtgttcaggagaaaaatttgggatttacttttgtgcatgggacacaggctgagaataaaaatgttttcctggctctttcttggaaagccagataggcttcacctgaaagcatattgccaatgctccagtgatccacttacaagggactctgattttcttggttgcgaagtttttgccattagtgactgggttatggacataacacagatagtccccactattttcagtagtgacttgggggataaagagctcttgtcctatttgttggttattcccattcagcagccaagaatactctgctgatggattagagcccgtgaggcaggagaggttgaggtttgaccctggatagtaacaggtgtctgaagaataagttgtgggttcatctgggccatctggagcaaagagaataaagccacaggtaatgttatcagagggaatgggaagctcctggtctgtgaaaggggcatagtgttcctttttgccaagtcacaaccccgaagtcccagccaaaacttcctctgtgttcactgaactggaggagtcaacgacattcacctgtttctcccatcgcaagctatggaaccagagtcccctaagaccggagaagcccctcccttcctgggcctacccaggtttgcctgggacaggaagtcatggccagcttgggggtccaggggtaagtgtcttcatacttggacctgagagggactgagaggcctggcctcatgttatgtggatttgggctggcagccttgtccatgaaggaaaagaggatactcacagagaacatccaggagactgggtcactgtggctggtgctcactatattcttcctttgacgttcatagagtcctttgtcactccttgtgacactgagtagagcaaggatcctgttatcattggacatctttagcctgggactgagtgtgagtctatgactatttacccaccacatgtagattgtgccatgagtctcaggttcacaggttaagaccacagcctcctcatcctctgcggagttgctggtgacatagggcttgggcagattggctgtgcagataacagagaagattcccctgtgtggcatcattgatttctccatgagcgttttccaataagagttgacatctcccacctctcagccaatccaagtccttaaaagcccacagcaggtctgtgtgtcaaaagacagatggatgcatgatgatctgagggctcagaggccatggggccacctgctctgtgtgcaagatgcacagacttctgaagtgtggatcgagcagcaatattggtgaagtgtgaattgagcagggtcaaacaattagagtttgattaactttgtttaaattgagaagagtccaagtgaggcagcagtggctcatgcatctccccaactgaaggaccccaccttataacactgttgttattatgaatacacaggtgtgaatgaaacaggcagtaaatcagacagcacccacctggccagctccacctggtcctaagaaccaccagtattcccattatgtgtatgttacagctttttaggctacaaaatataaaatacaatcacagaatataaaatatgctactgtcaatacaaaacattgaatatgaagctgaatatgttgttccactttttctcactcttgttaaactttgctgtttcagttttggaagtttctattgacacacacttaagctagagattctttcctcagctgtgtgcagcctacgagtaagcccatggagggcattctttatttctcttaaagtgtttttaatctctagcatttcttttgcttctttcttagaatagccatctctgtttaaatcacccatctattcctgaaaggtgtctccttttaaaatcataatccttaaccagagttgttttaaatttccagtctgataatttcaacatccttaccacatctgtgtctggttccaatccttgctctgtctttcaaactgcatttttttttttttgccatagtctgtcttgtatttttttgaaaaccacacatgatgtactgggtaaaagggacttgagtgggcaggcattcagtgacacggtggtgagtgtggggagggaagggttctgtggttctggatgaggtctgtgtcctgggctgtgaatgtcacaagtgcccctcaggtttttctttccattaggtgggatatgatgacttgaggaggctggagttggatacttcccctccctctggccagttaagctcctatcaaaccgcagctaattaggctgcagtgaaatagtttctcttaaatgtaggtcttaccaagaagaatataaatcactgacaactttccaagtgtttttttcccttcttccaagaagaaggatgtggattcttttttgatattgactgtgagaacctggtagagctccaggagctaaaagtcataaaactgtccccctactcccaagactaatccatcctctggtttgtttatctctgcgctgtgtccacactgagcctccagaatttcctgaattacagttcaggttttctgaaccccagcactggttcccgctggggtttctgtgcctgtgtttctgctcaggtacggtgcgctgctctgtatttgcctgtgggtctctccaatatgtgggccagttagcactgagaccttgcttcctgagaaatctaaacgagttgttgatttttcagtttgttcagctttttacttgttgttagaactgagtgaaaatttttaagctacttacatgcctgatggaaattcgaagtctctagggcatgacaggaggatatgagccccacagcaggttgaggatggagtcatgagtgaaatgggtgaaatgagcccacgggctttggaaactgcagatctgtccttctgcctctgaccccctggtgagtccatgtagaaagtgaaaccacctttgcaaagcatatgatggtgagaggaagctagcttggctgaccgcatctcacctctagcctcaaacttgctctctttgattcctgggcataggccagggtaagcatgggaggaatttatagtttaactttgaagcaaggatgataatagtccctccctaaaattagctcctccttgtcgggggctaccttggtaaatctaagaaaaaagattgaatggtctcatgattcagcaggttgtagagtaagcatcattctggcatctgctcagctttcgaagaggcctcagaaacttgcaatcacggagtaagccagtggtggaggaagacatcttatataatgggagctggaggaagagagcaagggttgcacactggtaaacaaacaggtaaaaactcacttttgctacaacagcaccaagaagaatggtcttaaagtatgagaaaccacctccattatccaatcacattcaaccaggctccacctccaactttggagattacaatttgacatgagatttgggtgggggtaaaggtccaaaaaattattattatttccatggtccctcccaaatctcacatctttctcacatttaataatatgaggatggcttcccaacagtctctagagtcttaactcattcagcattaactcaaaagcccaaaatagcaagtttcatctgagacaaagcaagttccttttacctatgagcctgtaaattcaaaaacaagttagttactttcaagacacaatggaggtataggcattgggtaaatactcccattccaaagggaagaattaggctgaaggaaataggatacaggccccatgaaagtctgaaagcttgcagcacagtctttaaaatttaaagctccaaaataatctcctttgaccccatatctcatattcagggcacactgatgtaaggcttaggcttccaaggttctgggaatcacagaaacattccaagagagtgaaaaaagaatttgtagtgtggcttttgatgctaaacagcgtattagactgagtaagtcactgaagagaaaaaagtcagaggagaagatgggtgagggtgacagaaatggaatggtgaaaggaaaggtctgataaaaatgtttaccggctggacatggtggctcacacctgtaatcccagcactttgggaggctgaggtgggcagatcatgaggtcaggagtttgagaccagcctgaccaatatggtgaaaccccatctctactaaaaatacaaaaattagccgggcgtggtggcatgcacctgtaatcccagctactcaggaggctgaaggcaggagaatcacttgaacttgggatgcggaggtagcagtgacctgagaacgcagcattgcactccagcctgggtgacagagtgagactccatctcaaaaaaaaaaaaaaaagtttacccaagggctcatctggtacctggctctgtgactaatgtcttacacattttgatttactcttccactttcattttctgatgcacaaagggtcacccttctgctgaagatgagaaaagaggatgagggagctcaaatgagtggtctagagtcatccagctacttcatagagcttgtgtgtttcaccttgatgtttgtgcacagacagaaaagtgagacacagaaggaaggcaaagcaagtttatgctgttggtgacacttatgaaagttacctgtgttggcagaataatggactcctaaaatgtttgcaccctagctccagaacctgtgcatttacttttcttggtaaaaacacagtgcaggggtgataaaattaaaatcttaagatgtggacgttgttctagattatctgggtgggcccattgtaatcagaagtgtccttgtaagtgacaaagaaaagcaggggcatccatgtgagaatgatgagcctgtgaaactccactggccaatgctgggtgtgagcatgcatcaaaagacaaaattacaactaatgtagttatagattttatttttcatttattatttgaggcagctctcactctacaaatatagtgacagccctccctgggctatacaataacaaaacagtgggttttgtcaagtgggaactggtaaacaaagccatataaataaataaattggtgaacttcaggtctcttttctgtaaaagttaaagcagaggaaacttttattctgctgtctcaggtagagtggaacctcctgttttcaacaaaaaacaaaagtctgttctggtatctctttgcttcattaaaatttcagttgtagactgtagcatttagcatgagtggttctattttggagtctctaggctctcacttaggtgagagtgtgaccaaaatttaaagcattggcattcatctcagtaaccatcatattgggcttccatcatttataggtttatgatgtcttcctgatcacacatttctttgagtttttgtcatttcagccaaagagagaccctttggtatttgttgatggctgcacacaaaactttttaaaaacttttgtagaattcaccacaccaaaatgtagaatttaaaaacctatagaatttatcacaccagagaggctactaatatgactattaggaggataacaccaaaagtttggagtatgcactttaggcaagatgcaaaccaactaaaatagaataggtcaaagaatgagccagaattgtctagcaattttaaccaagtagtatgtttggtaacttctgtgattgagtcattattatactcgatatatttgtttatgtgcaacagtcagtgtcagaaactgcacaggctcctccctctttagctggtagggaacaattttattatgtagcattcaatggctcattaaattaaaacagggagtgagaacaagtgagtctgaaaatgtaactttaaaagggaccactgtacatttgaagaaacaattgtgttaaaaatgctgctaatgtcagccattgggtggactaaatgatatcttatgtaaaaatttgagggtgacatgatatatctgtcactctgttacgctactctcagaagctacttcacgtgagattctaatgataccatcatcctgccaagtgaaagaggcaggcataagcatggacaaattaagaggggtaagagcctgattttgatgtgaagacttgttctggcaacttaggaaaagcttttcacagtgtgaagttgtcaacttcttatcctggttttaagtttgagtgtctgtagttatggtgtcaaacatattggtgagctccgagtgactcatacttcaggcacgagggttttcctgtgaaatttacattgagctttccacctccagcttataggacttcagtaacagagcagattttgttcttactgattcaataagaaaaaactggatgggaggaactagaagaattcagggtctagtccagtctaccggtgaataataaaaactcgaaaacaatgaacagagctgcaatttcatagcaggtatactacactttttattttcaacattatttttctctctataggcatatctatttttaccaaagacaatcccagtaggacaaatttgtttacaaagtaggtttagtcttatgaaactttgccgggattctttacataagtgcatcaagagtagcaatggaccacagaggctcttcctaaagtttggttcgctagaaatttttataagtagtctcagattaagcttttacaaacctcttgagatgaggaagccaaatgaaagccatcttcagactttgcctgcagtacttatgggtccattctatgtatattctcaaatataacatcttagtcaaagccttggtaatataaccaatgttttgaaatgtgtccttttgtaaagagagaagattcttactagtgcaaataactgtatcatcataatcatatgaatactcatgaatagtttcccaatcctgggacagttaggtaaagagcaaaaatcaatgggcttcaattattgtttccaaaagtatactttgccaaattgctttagatatagctagcttaaaagaagaaaaattacataaatctggaaaaaatcatttaatgaatcagcaaattttcaaataaaaattataaaaacattatccacattatttatttcaatgaaattatttttgttctgcttggtctaggttggcatatttcatgaaggcatcatcctgtttgttaaagttttggaagtctatagacggtccagtgatataatcttgaactgctcagaaacttgtatgcaagagtacttgtcagtatcttttccataaatcttttgaaatagaagcaattttggactgtaggtgattgcagatgctttcaggaagaatcaaaacaactatctgtgaatgaccaacatgtaaaatgactattgctaaaactctgataagagtttggtataagaaagggagtaactccagccagtactccagtcatgacgctgacaggggccccaactgagagaccaaaagaactttcttatcctgaagcagctgtcatggaaaaaaaaagaggagaaggaataaataataaagacagcaaggattttagccaattaatttttgagatagggtctcactctgttgcctaggctggagtgcagtggcacaatctcagctcactgcaacctgtgcctcccaggctcaagccgtcctcccacctcgctctcctgagtagctgggactacaggcacacaccaccatgcatgcttaatgtttgtattttttgtagagatgggcttttaccatgttgttgaggcttgttttgaactcctggactcaagttatccacccgccttggcttcccaaagtgcagggattacaggtgtgagccaccgctcttgctgctttcatgctttttataataagaatgaactccttatgtaataataaataaataaatgaaattatttgctttggatgtagcaaatgtagacttagattgtccagagtcaggagctaagcctcatttttttttgttttagctcagtgtagagtgcattgaaggtgtcctaaaaataattccatatagtaagccaattttaaaccctgctcacagctaaatctgccaagtatgagccaggtaaaattaccaaaaaaggtggttctgactgattccttaacaataacgtggcttacaaacaaagactgatatgaaatagttgatccaacccaaacactttgctcatttcccaaaattttctatacaaacatatacaacttaccacaacataaagatcataatgaaaagtttgccttttattcctttaaatgaccatatgtttagatctgatgtactgacagcaataattctcctttaagcggaaaactaataaaatttgaaaaatagtgattttatatttagatgatactcagatcttctgctacgtatgtggaaaatggaattattgctagaaacattgtttaaagattagggtatgaaaggagtattaggaagtcaggaggttctttctttaggaagcagcttatctggattcattcaaagagctttaggttagtttgaggtctttctgcaaaatgtaaattgctatatgagaaactatatatagtccaatgatgaaagaatgcaaagccttagaagcacaggcgacaattccagtatcttccctaaagttctgacaaaaaggaaaataactatcaaattcttcaactcgaatgcttattatgtatgtataagtcagttgtcagatgaagagaggctggaaatatgacttctacccctagggaactcacagtcttgtgggggccactaggggtggtggtgtgacctgcctggagcagggctaagtatggacttgtgagtcaagggctatcaaaacctaagtaaactgattgctgttcagagaaggtagagttccatttcacagtttgcaagaaggactatttcatggaggaggtcacgttggactagacctttaaaagttggtagaatttaaaagcaaggatatggaagcaggaagagtgaaagtgagcagaggtacagaagtgaggcaagggtgagcagttttaattttttaatggtggtattataaaacacacatcaaaatttgccatattattattattattttggagacagtgtctggctctgttgcccaggctggagtgcagtagctcaatcatggcttactgtagcctccacctcctgggctcaagcaatcctcgtacatcatccccctgagtagctgggaccacaagcatataccaccatgcccagctaatttttatatttttgggagtgacaaggtcttcctatgttgcccaggctggtcttgaactcctggactcaaatgatcctcctgccttagccccaaagtgctgggactacaggtatgagccactgcacctgaccccatcttaaaaatttttaagtgcacagttcagaaatacatttgcattgtgcaaccatcagcgccacccatcttcagagaatatttttcatcttgtaacagggaaaattcatatccatgaaacactaactcctcattcttcctcctccccaccccaggtaaccactattccagtgtctctatgattttgactgctctagggacttatataaatgagatcatacactgtgtatctttttgtgactggctgatttcacttagcataatgtcctcaaggttcatccatgttgtaacatatgtgagaatttttttccttttgaaggctgaataatatttcattgtatggatagaccacattttgtttatccattcatctatccatggacacttgggttgccttcactttttggctattgtaaataatgctgctataaacatggaggtaccaatatctgtttgggtctctgctttcaattattttgggtttatacccaggagtggaatggccaagtcatacagtacctctagttttagttttctgaggaaccaccataatgtttttcacagtggctgcaccattttaattcttatgaatagtgcacaggggttccaatttttccacagtctcattaaaacttattattttctggggtttttgctttgtgtttgagagtagccatttaaattggcataaggtataatttcactgtggtttatattttcatttccttaatgattagtgatattgatcaatattttctatgcttgctggccatttgtacatcttctttggagaaatgtttattcaggtcgtctgcctattttgttaaattgggttgattttttttttctgttgtttaggtagagaaggcaatccttgaataccagtgatgtttcactaatgctgggccattgatttcacaagaagttgtatgaggtattagaatgtgtgtttggtttcaatcatggctgaggttgaatgccttttccaaaattcagtgtgaagccacaaaggatccaggagcaagaacatggtgtgactgctctctgctaaagaatttcagcctgatgacagtgagcaggctacacatgagactgacacaagaacaggtggaaagggagaccttccactggaaaaaggtgattctaacatgcagaatcaccttcaaggagcaagtaagcagaaaaatagacaatggcacagtggccaggcaagaagacactaggtccagaatctgaggttcaaatcctggctctgtgagacaacaacatgccttggtttcctcatgctactgaaacaccaggggttggggctaggtcccattgcttgctgcacagaaagccaaccactgagacaatgaacattgccagggaagaaggctttatttggctgctgcagccaaggaggtgggagatcagtcttaaattcatctctccagccaactcaaattggatggtttatatagcttggaagggaagtaactacctgcagggaaaacagcaattaaggagggctaaggaagcaatcatgataaatgaggagtctggtgtctcattgtctgatggtgatgtggtgagtttcagtctcttgcctgaaggtccgtttcctaactcagatgactgacaaatgttaagtttcaagttttaagaccagatgggtcaatttctatgtttattcaaaaaccctgtaaatatcagttctatgtggaacttgagctggtttgcccccagttatcacagttagggttaaatgatgcaatataagtaaaacaccagcagtttctgacacacacacagagtgcatgacacaagtggtgtgttgggacaatatagctcagtgaactccctttgtctactcagttatattgagtgatgaggcatctctgaagatgccactttgctacttctcccctgataatttcaccagatccagccatatgagcactgcaagtggggacttagcttaaatcattcctcgtatttcctgtgcaggcaaatcatttggcaccaaaacaggcacagaagtccaagtcctgctgccagctccacgactgatgacacagacagactttgggattagtcctttaatctctgtcctctattaaatgaaggtcatcatgctgctgcctaatgtaaaaggattgtggggattttcatcattcattaccgattatcttattctttgaaaccccaagaaaactatacaaattccaaagtctaataggtacacaagggctttattatggatgatgaaatttcaaaggatgctaaaccaaaaaaaaattgtttttcttttttgagacagagtcttgctctgttgcccaggctggagtgcaatggtgcgctattggctcatggtaagatccaccattctcctgtctcagcctttggagtagctgggactacaggcacccaccaccacacccggctaatttttgttgtatttttagtagagacggggcttccccatgttagccaggatggtctcaatctcctgaccttgtgatcagcctgcctcggccactcaaagcactggcattacaggcatgaaccaccgcacccggccaaaaaaattttttttaatgcgctctcttttccatataatcccaaggttggtgaatcacctctaagtcaggagtttatcttagctgatactgccttagtgttggcacaacttaaatttagttaaactaatatttgcatgatctttgcacaacacataaacacccaggaacaggtggtgctcctcggtggtcaacaccaggatggctatggcagggcacattctttctctatagcccaggccactggcattcaaagaaatatttttcaatgtctgatttttctctggaagtaggaaaatgctttcctaactgctttacttataagggtgtttcttgctaattctgtgcccagagtaactaatggggacatagacatagacatcattcaaatggcattctctctttaccataacccatgctttaaaatgaaataaactgaacccatgccttaagacgacaatcaagaaatacattctgcctaaggaaaagtcctgcgttcaaaggtttttgtccaaataatctgacattgtggtcatgaaacattgaaaatagcatttggagcagtaagtataaaaatttagaaggagtaaaactacttgaatgcttgttgggaggtttacaatgtagtcaaacaccagttaagcaaaaataaaatttactacttaactatttacattttctaatgtgtggtttcatggaattgttgagataaaagtagatactgaaataggagtacttgaaagtaataagacagagatttttataaaatcatttctgacctgattaagaaaaatataatctctatcacatatgaaataaacacctttagaaaaatgcaatgtcaaagaaaacacttggaatggccaacaaatatctactacagatagaaatgaaaatatttatgttatgtaaatgtcgggtatcaaattgtctccgaagttgccttctagagaactttgtttagttggtatattcttcctatgaatcaaaggaatacagtgttacgatcataagtcatgagggacatgagacaattttaaggatttaggaaagtagggaagcagtgaggtgaagggtaggcagatacttcagagggtaaaaagtgtttttgattcaaaagaaaagctaaggtagtttgaagaaaacatgcatcatctactagttaatctggggtacaatgaaggtggtgttattttaacagtgttcagaaaagaccaattaattctgtggccatacagaaagaatggaaagattgcataaaacagattctgaggaatacaaatcaatatagcaaggaactttatgatgaaggacgaatgtgagcatagaatgcactgtttttttaattattattattagcagcatcattggtttggtgatgttacctacttttggagtggagctagatatgagagctgcatgtcccttgaactttatttggggtaaatagtgaaaacaatatctatgatgagttaatggctgcagcacaacaacatggcacatgtatacatatgcaacaaacctgcgtgttgtgctcatgtaccctagaacttaaagtataataaaaaaagaaagaaaaccatatctaaataaaaaagaaaacattccagaggtgcagaattcaagctagaagaattgtgtccttggatgtcccaaggtcaaattttaatatgtcattgaatgaaggttccaatgtttggaataatgaaaacagtcatattgaattttgtctttgctctcctccctccccagtgtctaccaaaaaggctgagtaaacattcatgcaagtcaatacactgtcacagccacaattcatcctagcagtctttcctggaatagtcacttaagacgtatctggtgaggacccactggcacttttagagcaatcagaaaatacctcaaattgctcacatctagtgtaggagaaggctaatccatccctgtttcatgaagcatcacttcaatatcctggaacagtcattctacccaaatcttctgtccctagagcccaagactctccgcatcttcatccattcttcacggggcttgatttccaagactctctaccatcttggccacacaccatgttacgcattcactatggacactgcaccactgcggatgctgcaccaagggttctgaatccaagggcagattgttatgaacagcccctttaaaagtcttaaacgtgatacactggtctgtcagcagatgtgcagagcctcttatgggagacacagtttttgactcatgtgattcaatgtccataaatctgcatccaaaagatgcccatagagacaaagagcagagtaaagtccttgcagcagtgtttctcaaacttagccacccaccagaactgcctggggaactttgaaagatacccatgctgaatcccacccaccaagattctgatgtaatgctatggggtgagatctggacatcaggatgtttggaatctccccaggctcatttaacgtgcaaccaagactgaagcccactgtcctcagcaatgtgcccagcccagccttcctgacatccccccatgggtacaggatgacagtttctcactctgaccctttcctttattcaatacagcacagcacaatccaacagggtgagcactgttatgacagagaacctggagtcggatctgattaaatgtcttcaacaaaaccagtgccaagccttggccattcagctatcaattactattttcaacccaggttctaaaggctcttcattagaaacttctcgggttgataatgattgggcaaatgtgccctttggatttgattgctaccatgattattaattaactgaattgtagagatatcgagtacctttctgcctcttgtttttaagaacccatgagagacaaggccaattgcagacaatgaggacgtcctcatgatagtgagatgaactgcctagctatcttccgatatcgttacttcccaccagttttgttgcttgcaaaacaacagaatcttctctccatgaaatcatggttatcagttaggaagtagcccacttggttctggatttcgtttagagatttaagatagtaacagagggtgcaggatgacaaacagaatttgtacactgtgtctggtagtggaaaatacccaacattgtactgtatgctgactctgtcatttcctgccttctctcctccttttctccctccctcactccctccctctctccctccctccttccttccctcatgaaagcatagcttgtttgccattctttcctccagtcaccagccatttacttatgcacatcaccatgctcatgccattaccaggggactttctatcagcatgaagacaagaaaatgcctggggcagaaagggtgtggggagcaggcagcacccctgcaactgcccggtagcatttatacattgctctcccaccttggtttctatccatagctttcctcgtcagagcatgttcactttaacatcctctagagcaatttcttggatccttcaagggctcaagaactaaacataagttcaaaagaaactgagtaggcacctaccttctggaaacaacatccatagaaaagacttgattgctatggtctgatttatgaacctgtggctcatatcaaggttagcatttgcactagcattaaggtattttcattgagataatttatgttttgaaagaaatactacaagatcaagaaactgtatcagttggagaatagaagtgtgtatgatttgtgtatataaatatgcacatcaaagcatttatttatttcagagagttgtataacaccatcagagtaaaaattgagtgattctcttctatttctgaccctacttccaatgtcttctctgtccctctgggcaaaaccatttaaaccttttatcttggtttcctttgtgagaaaatggggataatagatacccctgagccattctggagacatgtttggatgccagcccagttatatgattataggagaaaaaagctttgagcttttggcacttaggtgccacataaagattattagcaagctgctgaggttttatctttggaaactaataagcatttctcctctaaagcctcaaatctttagcccctggacacatgttcctgatagctctctctttacaaagatccccttggctccacaaggatacagatagtgctttgctgagagagtcactaccgcacattcagatgaaaggtattcattccgcttggcagagtcatggttagagtagctgctgatcccagcaaggcagggtgggtgatgggaagggattagattaggaagaaaagggatcctctcattctctcactgagaggactttaaacctgcagaagcacaacagtgagtggactacgtgtatgtgccaacgtgcaaagtcgatggtgcacacgttacaggttggctcgagacgatgccactcagacctgagtgcaccgtggaactctcttgaattctctctgcaaatgggttgccctggatgtatagagttattctacaggagtcctgctcctaactcatcagaaacgtaatgtcctctgttgatctcaaaggcattttcttctgttaaaagtattgtccattcagcaatatggagaaagatcatttgtgagaataaaatagaagtgtctgatggtagtggggggggtgtaatttcctccctatgtgagtagcattaagttcactcttaatttttttcttcatttctgtaattggagactgatttatcaagaggatatagaattcagtgactaattccattaaatgctgaaagaataaaataaaagtagaattcaaaaggcttactcctgattagttttcaagatgtgtctaggtacaggaagttaaaaataataccacagtgaatgctctgacccagtgctaacaaaagcttcctttttttggtgagacttggcatagaaaatcacacatgtcattcagtggtcctgaaaaatgatgactgagatttggactggttttccagggaataaaattgagtgactttttaaaaagttctactcctagaatctgggatctaatcaatccaatatcaacttcaagggaatagaccaacaaccagagatgaaattagaagaaaaataattagaatagcaagcataggctggttttccatgctatgattctgcagcaaatgtggtaatttgggaatactgatttgggggatctcttgtcatgggaataagttgtgttttgtcagctttgctgagtgtctccggtgagctaaaagtgattaaaacagagtgctggccctggtatgtaagctgtaatctatactccatatctaccactagccattttgaaggaggagagttccctgatccatctcacatgatgtgcaacaggcgtgtggctcgcccgcttggttgctcaaacccctgatgggagatggagcacacagatgggcaggtgcaggggctggagtgagtgctttgggctccagcctggcagtagtgtctggggagagggtgttcctgcagcccaagtctctttagtcttgctgtctgcaaatggcttaagtgttaaccggctcaatagaccctctgccttttcacaagggcagagggccagtgtgacagctttctgtattcccagcttttgcccagtgttctagaagaatcgggtcacacacacaggcttgaaggatgaatgtgggattttattgaatggtggaggtggctctcagcaggatggatggggagctggaagggggaatggagtgagaagatgatcttcccctggagtttggtcatccagcagccaaactcccctctgaccacccccagtttaactcctggcattcacacgttccttcccttctctctttctctgctgtgtcatctgttgtttgtctgcttgtctcctcatctcctcatctgcttctggagcctggggtttggggtttatatgggtacaggatagagggacatggcaggcaagaaggcaacttttcccacttagggccacgggtctccaggcttgagggtggggcctttgctggggaactaccttctttacccagtatttccctgtctcctgtccatatcaatttcatgaatgtgtggtcacaacatgaacccagaatttggaggttggaaagtaggagtgaatgcactcaatctaatagggtgccaattcgtagcatctaatttggtaatgatgaatgagtaatagaatcttttggtaggggcagacttggtgaatcttcaaatgtagcaggattttaaaatgaatcgaatactatctctcagtcaatacaattacctccaccactcctcagttcctaattcaagggttatattttcagtaactttatgtattcaaaactgtattagatgctggaaatacaaagatgagtcagacattattaatctctgtccctaaaacgatgaaaactagtgtggaagacagccaaaaaattagagattaatcttatctagaaaattctagaaacaggatgaagcacaacagaggagtattttaggcaacctcaaggcatttaacacaacctggagcctttagttaggttagaatatggccaggaaccggaagtcaagattcaacaaattgcaacactgcaataataactaacatcactttctaatagtgtttatagtgttttctaatatgaaatcaaaatctgtctttggataacttttactcactccctggtcttgtttctgttctctgggatgacacagaatatatggaattcactcttactctgcttagtactgagaaagcaaaaattaaataaggcattcaaaattcttgtctgtatatgggccaagggaaagcttccccttcaccctctgaaggtttgctgataaccaactgacaaaaggaagattcacaggagaaaaagcttaaatatttatttgatcacagttgtatatgacatgagagcctttagaatgaagacccaaagatacagaggaaaccgtccatttttatgcctaggttcaacaaagtatggacagccatgtagaaatagggttggattcttcttggcctctctgagcagtgcttcttccttctgggtgtgggaaaaattcaccatattccttaggtcccttcaaagtcccctctattcactctatttcaggaagggtgagaggaccaatgaataaccaactttctggaaagggggtcttaggatctacagtcaaacaaagtaggtcaggtcatttcttcttttgttttctcttttcaagaggcagggtctgattctgtcacccagggtgaagtgcagtggcctgatccatggttcaccacagcctcaaattcctggactcaagcaatctgccagtctcagcctctgaagtaggtatgactacaggtgtgtgccaacataccagactaatttttaaaaatttttgcagagatggagtcttgcagtattacccaggatggtcttaaactcctgggctcaagcaatcctcctgcctttgcctcccaaagtgttgaaattacagatttgagccaccacacccaacccagataatttctgtatggccagtttttacacagaaaggtagagggaaatttagagtccgatttttaggttttatggctttggggaaaaggggttctggtttctaggacccgtcatggggaagagggattctagtttctaaggtgcctccagggagaatgggactcagagacaggaaggcagaagaagctcagagagaaagttttgcttctgaggctctttcagaaggattccttgagctcaggagttccagaccagcctgggtaacatttcaagactccatctctgcaaaaaattttgaaaaaatagcctggtatgtggcatgaacctgcagtcctaactacttgagaggctgaggcgggaggattgcttgaggccaggagtttaaggtgtggtgaacttctgaggctttgattttggggtactgctttctgagccttagacctagaaccagtattcaggtcatgggggaagttcatataagaatctctattttttaactatcaaactgtgacttccacatgggccacttgggaatgctctcacccatagacctgtcatacacctttgttgggtagggacaggaaaagagattgagtagcataagataaagtcctcccgaccccacccatttcaataatgggatccgcatttatcatatgcagatctgagacccttcctgaacttcaggattcatacagtattagagagtggtctatacctttccccatgacctccagcccacacgaggttcagtgaccctaatgccacggaggccaggatgctgtgattaagatgagagcaggggtaagaagggtcttttctctgctcatggagcactggaaggaagtatctttttgggtgctggacagtggggaggtcaagactgtgggcagaggaacactggagccaatgttgggaataattctcatgcaagcaaagacgtggtgtttagctggtcacaaccccagaccttgagactccagttccacaggggtccaggatattgtttccatgtacaagatccatctgtgagaatccagtactttccaccacctgccgtggtatggctgtggtcccatgcaccatcaccttgcgcttcaacttctgcaatgaccccctaattgataacctggctcttgacttgaccttacagcaaacattctttttgaagaaaagtcacagagcttcaccccactggccgaaaccctccactattagctgccactgcacacagagtcgaagcctaaggcattgcacttacacattttcatgttatattgttgcatagatgttgttagtttctgagtagccaggagagcattttttctgcaattaaacatatcgaatgcaccacattctttaggtcccctcaaaggcccttctattcactctatttcaggaagggtgagggaaccggtgaataaacaaaggtccttgctttaaaggctgttatgaccataaagtctgtgtatttcacagctcatgacagcagcatcctgagatattatttattgtcaaacttctcttctcaggccacacatcccattgcaatggggaatgggacagagcaaattgcaagttcttggttctatgttccagttgcaatgttgctttcagttttcctgctgttaaaacagcttttgctggtaggactgtgggaagtgagaatagatttcattttacctgctgtgcatcagcagaaaaaacaagtctttcttttctcctagcagctgagatttctcagagttcttcctagaattggatgttatatatgatctactttactcatgccaaccggcatacacaccaaagcctgatgagtggtacaaacccacccaatgttttcccccaaaacagaagtaacataagcccatgtggaattgtcagaggtgtttgaaccagagcaactgcatcttgaataggagcagggtaaaatgaggctgagacctactgcgctgcattcccagacagttaaggccttctaagtcacaggatgagataggagatcggcacaagatacaggtcataaagaccttgctgataaaacagtttgcagtaaagaagctggctaaaacccaccaaaaccaagatggccacaagagtgacctctgggggtcctcattgctacactctcaccagcaccatgacagtttacaaatgccgtggcaacgtcagaaagttaccttatatggtctaaaaaggggaggcatgaataatccaccccttgtttagcatattgtcaggaaataaccataaaatgggcaagcagcagcccttggggctcctctgtctatggagtagccattcttttattcctttgctttcttaataaacttgctttcactttatggactcgacctgaattctttcttggtgagatccaagaaccctctcttggggtctggatctggacccctttcctgtaaaagaactattcattttatcttttggtcgtcaccaagcaaacacaattataaataaggaaaataatatatgattgtaattttactcataatcccgaatgtctctcatgaccagcacacctttggtgtattgggtctaaatcaaagaaaaattcgaggagttgaatgaacgacgttttgatatcttaatgcattttggagaaaaccaactgttgcaaaaagctaaagaaaacaaaaattcattgtttatagatcaggtcacgtgtttttcatttctgcaatggcgatgtggttgattcccatggaacacaatgagagtgtggtctcctttgagattgtatttattgataaatgcaaaaatgctaatgaatgctaacttgctggttctccatggccttccttcctccctccctttccaagaaggatgttgtatctgtcagaggcatttgaaccagagtggctccatcttgagtgagggctaggaaaacgaggcttgaacttgctggtcggcattcccagaaagttaggtgttcctagcctctagatgtttacagttaagggaatagattgataacattcactaaacagacccagaattgggagtgtcctgatatcccgatatcttgagaacagaagcattcctaattttgctttaaagataataacgttgattcttgaaaaatatagtaatttaaaaaattaatcctttatcacaaacccttgtagcagagcacatctccccatgatctttttaaattctctatataaacaagcactgtacctaggggttggtgtgttccttctcttactttctggaatgccctactctgtctatggagtcgctgtactttcaccactttactcttttaataaacttgctttcactttgcactgtggacttgccctgaattttcttgcccaagacctaagaaccctctcttggggtctggatcgggacccctttcctgtaacatatccacctggtcaatttaggaggcagctgttatgtttatcaggatgaagaaaataaaactcttttacttcaaaatgtatttctatgatatagtttgagatggctgttcagaaagccagcaaacaggaggggccctgcaaagctgtcttgtatggggcgatttgcatctgcagataaattctgcacggatgcagccaggctttctcagaggccatcctccctcgtcctactgtaggaaagatggacagagagtctgacatctttaaaggtctgaaagaaacattcgccatctattctctctgaggcctgctacccgggaggtttcatctatatgacaagaccacctcggctagcttggcctcttcttctctttctcccatagcctgtgttgccacaatgcgagcctccattcttcaacctcaagatggtgtgaaatcttctgcactccatccggggcatggggttgggtaatcaccctatgagttaccctacgatgctccctgtgttcaggagagtatatttgtttgacttttctccaattaattttgcctttcatgagtttattttccagcaaaacttcagagcaaaaaggaaggttttaccttggcctctgcaatgataatgagttcagatgtaacatgaaaaatttaggaaagattgggagaattttttttaaagatccaggaatttatcttaggggaaaaaaaaggaatagtactggaaggaggatgcaggaagaatgagagagagagagagaaagggagattggggcaagtgaggaggaaggagggtttgtggacgtctgacatgctggagagataatgaggagaccagttgggggaatatgagcttaagaggttctagtgtgtgcctattcgagacactggagaaacaatggaattattttttagagcttctctggatatagaagatggtttccatttgaatgggatgccaccatgttgagccaggaaataaggctttccttaaaggggctgcttaccacagacattgattctctcgcagtcctggaggctggaaatctgagacaaggtgtgagcggggctggttcctcctgaggcctctctcctgggcttggagatgctgtcttctccctgtgttctcccatggtggttcctctctgtgtaggtctatgtcctcatctcctcttcttataaggacaccagtcctgttggattagggcccactctagtgacctcgttttaccttaatccaatcttgtccattctgcagccctagggccacatgcagcccaggacagctttgaatgttgcccaacacaaatacgtacttttttaaaacatgagatttatacacggacctgttttttcgctcatcagctattgttagtgtattttatgtttggcccacaacaattcttcttcttccattgtggcccagggaagccaaaagattggactcctttgccttaatcacttctttaaaggccctacctacaaatacagtcacattctgaggtcttgggggctaggacttccatggatggattgggtgagggggcctcgactcagctcataacagcagagttctaatggtggttctcagtctttgttttgaggaaagtggtcgcttaaataacgacatatggaaaagatacaatttaagtaatagagacttcccaggcaaaccccatgtaaggggaggaatcgaacgtatcaagggcattccccaagcccaaggtgatagaggtgagaaatgctcacttattagtgcctatttcagtctcctgatagattttcatttagtatgctgtaaacaaaaatatccctgcagacactggcacttgagggattacagtggtgaggagaaattcccttatttatttgtggaattcagtgaagcatttcacagtccaccttctggggataatctgttcattgccatggagtaaatcaatagccttcatttagattcttaactggcaatttgatctcattcactttacccaacactcattggctggagggatgttggagactgggagcaggctcctaaaaagggtcttgaaaatgttatttcaacaaagattaattttgaggcattgagagtttcagaaaggttgacttttttttctgaagctcttctaagccaatcttaaatgaatcctcagaggactatttctgtgggtgtgtgtctgcttgtgtgtgtgtgtgtgtgtgtgtgtgtgcatgtgtgtgtcttgccccattccaattctccatccccatgctgaggaggctggaggattcagaatgcagaatcaggtgtatttttaaaaaatcattatgtctgtcctcaccaaaacactggctatttctatctttccttctcattttactctgctataggaatctaagtaaatcatctttaggaaataccaagacctaccaggggttttagattgatggcggccgacacaacctagtattgatagcccatgtaaatgtttgccatccagatgacaaggataacgacaaaactaacatgacctgccccatggtgtgctagacccacatctcttggggaatgttttgaagcaagttaatgcaagctacttgataaaaggcttctgtgatgaaatgagaatggggaagctgagttaaacaaaatcaaacagtgttctgtgttggaagcttctcaaatccttaaccatgctgaaaagcttagagtatttccaggagaatggcatggcaccccgcatcccagacctgcacagcccctgctcaggccatcttgtgggatgaacagtatgcaaaacacacattctggaacatgcttgaagagaggggaggccactctctagcttgggcacagttctggctctggcacacactgacaacgtgacaccgggtgacagtccctctgtaaactgcgcttcctcatatgcgagaggccatggaacgttggcctctcagacgttactggctctaacattattttgccaaaaataaaataattagggtggatgtgttacaggaaagtggtccagatccagaccccaagagagggttcttggatttcaccaagaaagaattcaggtcgagtccataaaatgaaagcaagtttatgaagaaagtaaaggaataaaagaatggctactccatagacagagcagccgtgagggctgctgcttacccatttttatggttatttcttgatgatatgctaaacgaggggtgtattattcatacctcccctttttagtccatatagggtaacttcctgatgttgccatggcatttgtaaactgtcatggcgctggtgggaaggtagtagtgaggatgactagaggtcactcttgttgtcatcttggctttggtggagtttcactggcttctgtgcaacctgttttatcagcaaggtctttatgacctgtatattgtgccgacctcctgtctcatcctgtgacttagaacgccttaagtgtctgggaatgcaacccagtgggtctcagcctcattttacccagcctttattcaagatggagttgttcttgttcaaatgtctctgacagatgtaataggtaacgctcagacactgacatcagaggcaatgcaaccttaacagaattggctgacatatatctctgggtataaataaagtctcagctttcccctgagacgtaatgatgagtgtccctaaagtttgcttcacccttccacgctaaactcgctccactgttccatcatctgctttaaagccacaaggacagccagttaggcctttgtcatcatcacttttaacttttgtttaacttttaacaaagattggcctttttaaaggctcagttatattaaaaaaaacaactgcctgccacttacgcagtccatggattttaaacaaagctggcaatgcaagtcaatgggaaaagaatagtctttttcaacacatggaattggaaaaactggatacctatatggataaaaatgaactttgatcccttactccatactctgcacaagcattaaattaagattaactgagatttgatctgaatgtaaaatctaaaattgtgaagcttttacaataaaacaaagctagacaaagactccttctacaaatacctggcactaaacattaaaaaatcataaattgtgctcatcaaaaatacatctgctcttcaagatagatgaaaaggcaattcactgactttgagaccaagtgtttctgttcagaatatgtaaaggaattctaaaactcaacataaaaagacaaaaataaaacaaaaacacatgcaaaaaataaaaaaagatagaaaataagcaaattatttggacaaaaggctcccaaaaaaggaaatgcaaatagctagcaatcacaggaaaagatgctcaatattattagttatcaaggaaataaaaagtaaaaccatgagatactcatacccattagaatggctacagttaaaacgactgacagtactaagttttgctgaggatgtggagcaattggaatgctcatgtattgaggtgagaatataaaatggtgcaaacacttttaataactaccctatggctcaacaattccacttatagatatataccaaagagatatgaaagcatatattcatccacacaaagacctgtacacagatattcattgtagcgttattcatgataacttcaatcggagcagaacccaaatgcttaccaaaggatgaatggataaacatactgttacatattcatataatgacataatactaacagataataaaaggaataactattgttacctgcaatggaaacacatataaatgtcagaaatagtacgttgttaaataggccagatacgaaagagaatatgttgcatgattccatttatataaagttctagaagagacaacgtgaaagtcatggtaataagaacagcagttgcctgaagttttgtggtttggcgatatgaggaaattttctggagtgatggaaatattctatatttttattcggatgatgttttcacaggtgaatatatttgtgtaaactcatcagaatatataaaaagattctacaactcaaaataaaattttaaaaaaccacaaaaagttattgtgatggttaatattgagtgtcaacttgattggattgaaaggatataagtattgctcctgggtgtgtctacaagggtattgtcaaaggagattaatatttgagtcagtggactgggagaggcagccccttcctcaatttgggtgtgcaccatctaatcagctgccagcgtggtaggataaaagcaggcagaggaacgtgagaggactagatgggcttagtcttctggcctacatctttctcccagctggatgcttcctgccctcgaaaatcagactccaagttcttcaactttgggactcggacctttgaacacagactgaagcctgcactgtcggcttccctagttttgaggctttgggacttggactgacttcctggatcctcagcttgcagatgacttattgtgggacctcaccttgtgatcatgtgagtcaatgctccttaacaaactcccctttatatatacatctatgctactacttctgtccatctagagaaccttgagtaatagagttatgcatttttattaaatgtaaattatgccttaattaaaaataaatatcttctcaacctccaaaaagagactttctgtctgaaacttgagaataagtctaaagttttcatttaataatgaatttgtaaaagacaggaaaattgattttggcattaatttgttcaacaaatatctgttgagcatgtcctatgtggcaggggctgagtgtggggtgtggattgggtgaatgtaaggaacatatagttcctggctccctagagctcatggtctaggggttggagagaattggtacattgggattttaaagggggtgccaaaagtggtgatgacaaagctcagggaagaacaactggagtggagggagggcatcaacatggatgctgaaccaagccaatgtactgctaagagtgaggtggaaagtatcatgtgaaccccagagcttcaattgtcaataagtattggggtgtgaccagcagattgatagaagacagcaaagagagaggggtgaatgccaatagagcagaatagcatgacttgtcaagagacaggacttttcaaggtgaaaggaagggagatggtcctgaagcagcagtcatgtctatgacccacctaagccctaagcaatgacagataggaacagagtcagggtcctcagaggacaacctagttttaattaaggacagaagttgagaagaatattttaagaaacatttgaggacatattacagtttgctggctatgggttagggtagggtggaagagagatatttggaataaagggtatggatgggacaagacaaagcagggcaccagccctaccttggacctttccttaacttgagacagccatgtccatgttgattcagccaatctgactcaggtattatgtaacttgaagttgaaccatcccaactgatataagtggtgatactgagtaacacaaatgtgctttctggattcacacatgtactttttttacatgaaaagttcaaacttctatgtggagaattttttcttttttttgtttctttttttgtttttttttttttgttgttgttttgtttttttttttgagatggaatctcgctctgtcgcccaggctggagtgcagtggtgcaatcttggctcactgcaagctctgcctcccggattcacgccattctcctgactcagcttcccgagtagctgggactataggcgcctgccaccacgcctggctaattttttgtatttttagtagagacagggtttcaccattttagccaggatggtctcgatctgctgacctcgtgatccgcccgcctcggcctcccaaagtgctgggattacacgtgtgagccactgcacccggccgatttttttcaacagtatcctcaagaagtattcatcattcaactctttctaggaaaggtatttaaaaaagaagaaaaatatcatttctggcctggaatgtcaagacatacatctcttagagatttagttctaataattattgtagagtcttgtggatgtttcttataattttaatttttacaaaaacaaatctgtccatccatgcatctacgtatgtatgtatatatgtatgtatctatctatcttcatcatcataattatgcatctaggatctatctattgtgtatctatctaataatctatctatgcagaactgcaacatttacatgactggcccataccgccctctgctccccactttttctaatcttcaaaatcaagtttctggactcagggctatgaaatgcaaagtgaaacagctcatgtccaatggtctgacactctgctgctcatgaaaacctgcaacatccaactgagtttttcatttttaacatcagcagatctagttctctatcttcatagagagttatttttaattttattaggggataaattcttttttaataaagaaattattaggtatcaaaataccacaatctctttttggatacaactagattatgtgtatgggtgaagtattttcaacttaagaataacattcctgttccttgaacactattttggaagtttgggttaagggatattaacttccttaagacaaaacagactcacagttgaaaactactcaccttctctatagaagttgcttaatatcaataatttttattgtattggaacaaaatagactataactttttataagatacatataggtttactactaaatattcttaaaatgaatataatgctataatattcttattttgaggtaatatatatatagtctgcaaaaattaggtttcctggtgtcattaaccacttatgcaattatttttctgaaatgaatacacatgctgtacgtgcagttttgcctgatacaagttttaaaacaacgtatattggaatcttggaactaaaaatgagaaaatcagtgtccccttgatgtcaatttcagttcaaactgcacttgctattttatttttaattggttacttacattatctgtacattgtcacagttgatggtatttgtttacttctctgtgaccataatttgcacagatttaaccataatacatccttaaagattacaagaaatcttttagacacagctcctctcagttgctgaggatccaacttttactcatttgttttcttcatgaatatgtatttcctgagttgtatgtttgtacatagctatttgtagcctttgaagtttatggaagtttgtttggttgcattcttggggcacattttctttccctgatgactgttaaggttaggatatttgacccttccaaagctcatgttgaaatttagtccccaatattggaggctgggcctaatacaaggtgtttgggtcatggggacagatcccccccattgaatagattaatgtcctctcctgatggtgaatgaattcttcctctattagttcctgcaagacctggttgttaaaagagcgggccacctccccggtttctctcttgcttcctcgctcatgtaatctctgcacatgctggcttccccttctcttctgccatgagtgggagcagactgtggccatcaccagacgaagatgcccaattttgaactttccagccaccagaatcataagccaaatcatccctttgcctttataaattatccagcctcgggtattctttatagcaacacaaaagggacaggactttttatatcttgccccactgtcttctagcatttcatgtgtcccataaagaaatcttagtctcctaggtttttttttttttctgaatatccacagaattctttccataacttcaaataccaggaatttattggggtatttgttaattattcaatataaacacagccttgtaattcttgggctatttctgtctgcagattcaaatttcactgtatttcaggaatttcaccttgaattgtatctttgaaaatttgttttcatgttccattcattttttaacccatgcaaggcatttagtgttaatgatatttgatctcttccctaccactccctcccatccccctctttttctctatctctgtcttccatcttttacttttcgttcttttccatctcacatgctcattttttcttctcaaaaccatccttcgaattccttcagtggtgtctcatctcccttttgctgcttctatcatgacctttgattttggtctctttttgtgtgtctctctctctctgagattctgaggctctgcctattccgtttttattctcatttgtttctaattgtttctaagactctgtatactcctttttcattctcatttattactaatttatttctgaggctttatccactcacttttcattcccatataacctaatgtattatcagttcttccttaaagccttatattgcttctttaaattctcatttcagagaaacaatattgtctttaattgattccttagaaataaccttgttcatggtttttggctgcgttgtggtatataatctttccgtttctcatcttcataaatcatgttctgttcttcttttttcatttcagcatcattataaggcccccggctggctccaccctttttaagtagcattgttcctcatctttttggactagaattttgggcaaagttctggggaaaggggaagaagaatgtgccaaacaagtgggaagattgggtttcagtctgttatctctaggatgtttctcagctggacttggcctgtgggttatctgttctagcatagcaggatatcttccaggctcacaaggaggctgtgcattttacagaacattttaatgtgattattttaccttgacttatcttcaccaggcagctttgggcaaagacggccaggtagcttttatcttattgactcttccttctatcctatgccatgattgaaacatgatgtaggcttccaaaaccaggccatgaaccttgatcttaactttctaagcatgggatagacacatttcctttcaatgtgtgccacccatccactttggataactatgagctgggtccactctgcctgagtcagacatagaaagataccttctcttggagttcccaaatacctccatccacttctcatacacttggctttcttcctgcatctactgtaatccagtgttataggggatctgtagcttcatccaagataacatttgtttgtttcttcttctcttgtttgctttggattggtttcataaaggaaatcagacaaaaatatatttatactaccatttgaaaagaaaagataaattccttctttcaaattcattcctttttgtttctttccagtgaatctcatggggtgaggggagcactgaagggaatgtccaatctactcaaatccaaaaagtcacaggtataaggcacagaaaattttaccagtctaatgatggcagttttaatgctatataaggacagagtatgcaaaaatgctattaatgaggatgaggagctgggagttcgcaaaatgttggcccagatgagtgcagcagacatttggcccaggtgagcctagcagatatttacatgaaatattagggagcatccatctgggctatgtgacttaggctggcgatacacgacagaggattccaatttgttgtataaatcaccctcagagcccccagcagtgaacacatagggggttcttttcattttcatgatgcttaatatagtctttaaaaataattaaaattaggtgaagtgtgtagatttctgagaaattacagaaagacattagttttgatacctcttgcttgtagcatttgaccaacataaacaaactaaaaggtttaaaaagaacagggattcttcccagtggtatagtgtaatgggtagggaaaaaaagttcaaaattgataaatagaccaatattattctcaaaactcataccactgtcattgggaagaaatgaatacatattacttagtcacttcatgttaccatatacttatattaacacaacaaaaaggaaattatacgaaaaaaagtcatacatttaaaggatggaagaaaatcctaggtttactcggagctcaagatcccattgagatgaatattgttctttcctcagattgttccttcatttcattcattcacttatgtatgcatttatttatttagagatggggtctatttctgtatttatttatttatttattgatggagtattgctctgatgcccaggctggagtatagtggcacaatcatagctcactgcagccttgaactcctgggctcaagtgatgctcctgcgtcagtctcctgagtagctgggactgtaggtgtttgccaccacgccccgctaatttttaagttttttttgtattgattgggtttccctatgtttcccatgctggcctttaacttttcagctcagcgatcttctgccctggcctcccaaagtgctgggattacaggtgtgtcccttcatttctaatgaaggaaggttttcctttgaatattcacaacagatatttttaaaagaaaggcagatttgaagcaaccatcaacaagctttacctgaaaattaatctgatatttacaattgcattatataaaagaaatgttacagactgaattgtgccacacctaccccaaaactcttatgttgaaatcctaacacccagtacctggaatgtgattgtatttggagatgggtcattaaggagtaaattaaagtaaaatgaggtcacatgggtgggccctaatccaataggactggtgtccttataagaagaggagatgaggacacagacacacacagatagatgaccctgtgaggatacagggagaagacaccatctacaagcccaggagagaggcctcaggaggcaccatccctgctgacaccttgatctcagacctctagcttctagaactgtaagaacaattgttgctgtttaagcattcccatatgtgggactttgttatggctgcctgagcagcctaatgggagtgcaaagactttctttaaataatgtataacaatgctggtttggaaatgactatccagtgttgagttcaaaactttatctttatggatgctgctatgagtgagtgtctaatttgggggcataatattgacattcttcgggagaaatgcagactccaatcagtgcagaaaatggcacagaataatgtttaaatatgccctccaggccataacatggttgggttaggaggaggaatattaaccattcccatcctaaaacacagaattttgggtttctttctgtgagttcaccacctctgaccttcacagttaagggaccatcacacagacatctgccattttcatataactgtctatccaaacaaaggctgaaaattcagcatggaggaactctcccagcacccgtggtcagccccttggcctgcatccccaccctgggcactggtgtgggggtgggattctttatgaacttgggccccaattctgcttcccctggaaagctggacccacacaacatcaccctcatatgcagaccctcatgtctgggcacctgtgcctacccggagctgggggtctgctctaggagctggttcaggacaggatactcccatccaatctgtgcccaccatagaaaagagccagccaagtgcctgctactacagggctcttcacacatggaaaagctgccctggggaagtgtcccaggaaagggcagggggacaaaaaaaggtcacagtgatttgcctccagacactggacactcttccctggagagtacagggcatgctcctctccaaacctgatcttgctacatttgtgctgcccacagtagtggtgccactgagttttcaaagaagacagcaggccctgaattgtgcaaggaaaataagtgcttgaattttgtagcatgcatgcagtgttctacttttaagaatggtaccaggctcctctgatattcaagaaaggcccccaacagctcagatggtagttttctaatcctgtcttcccacatgcacatttacctcctccacccaagaactgaataacagacatgagtgctcaggacgtcatgctgtctactgtcatccccttcctaagaccccctctccccatctcttgacacccctgttcttagctccctctttctttctggcctgttacactcaacctctccagcatcctaacaagtacccactcaaacctatttcctcccctgctgtgctgcttcttcaaaagtgctttgcttctcatcctcaccttctttccttgccctcttccctgcttccctcttcaaagcacttctcagctacaaatgagaaggaagggatctgattaaacaggctatgagcagagtcatgttctgaggagatttgcatttttaagaggagattaatgaccacatctgacaatgtgaccctggaatcttatgcagagtgataggggatttgggatgagctccgttcagggtaggaagcgagagtttggatctgaaatacttttcagatgctgaagtcataggagcttgcagttgcttcctgggcagagccataaacaaacatctcttctgcagagtgggggctgagaagatggaacagtgacccaggagctatggaattatctggccatgttacacttgcaggactacacacatttaagtgaaaaaacatgcttttcgtccgcctggctgacctcttagcctgctctcctcttattgttcccttgaaggcatcattttttgaaagagaaatttaaaccctgtccatctcatcttctttggaagaaagttaagattcctttctgaggtctttcatcatctggagtttaaaagcttcctctcctctatcaactctctttgaatccctcatgtcacaccaaacttcaaaagagacaaatacttttgcatgattccctgcaggctctgttttgccctgtagtgacagccccatgtcttcgctttcctgactggaaaaacttctcaagctttctacattcatgatctccacttcttcagtgcaaccttctccagtttgtctctgatctccaatggtccctgcattaatcttgtccgagccacaggtgaccctcgtatcatctcagcttctacttcccagtctctctctgttttttttttttttttttttgagacaggggtctcactctgttacctaggtttgtctcaaactgttgggctcaaaagatcctccgacctcatcttcctgagtagctggggtaggggtgtgagcccttctgcttggtctccagtctttgcttttcttttttgacctatacgtttggtggttgatgtccatgttcatgtaattgtcttctctggcttctcagggccaccatgcattcccttctccctcttttcatttattatcttttcatctagtaaaacccatcttcccctaaagatgtatattttcctcaaagcaaggattggcgtaccttcacaaactgagtctccaatgacaacacaaactgaaatgcaatataaatcatggacagatgtgagctcctcttctacttcctgtgtcctctgctggttcttctcaccaacatcacgtattgctaagtaagccagtgatgtcaagttagaaaatggactgagtccattaattcatttggcacgctccaaagtcctcacctgagatctatctactctccaaataattacacttcttagaaatacaggaagatccttttcacatgagctaattagggcgaatacatgtaagtgttggtaagaagtactagaaatactggaatttgtgagatttcattgaagaaccaacttccacccagcccttcacattgttctctttcggtagtttcttgtcatttcctccttttactatcaatagggctgctgtgaacatgcatgtacaagtttctgggtggacatatgttttcattttttgggggggagtagatatcaaagagtagaattgctgggttgtatgatgaatgtgtgttctaacttttcagaaactgggcttctactgcttcctaatttcaccttccacgccatttctgtagtgaggcccactccttggccttacaagacctgaattaagttaggtgccagagtcgttctgtcattgactctgttctttcccttgctagcctgtgtaataattggcagtcagacctttacataagcaagggtttcatatgtctccccagttatattacaagttccacaggggcagggctatgtctatctccttgacctctgaatctgcgatgcctggcagagggctgtggacaccggtcaccctccataaacactgggagacaaacaagggagtcagtagagttatttttttgcttttctacccccagaactgttagaatatgatttgagctattccttcaaggaagtcctggggcaggtgatcattcatagatgatgtgagggagtgcacagcacatgagtttgcaggaaaatgcaaaccccacgttgaaatttgatccccagtgttggagatggggatttacaagggggtgtttgggtcatgggggtggctccctcatgaatggcttggtgctgccctcatggtaatgagtgggttctctactcaatcctgcaagagctgattgttagaaagagcctggcaccttcctctcctctttctctttctcctgcttcttctctcaccatgtcatctgtgcacacaacagctccccttctcattccaccatgagtgcaagctccctgaggcctcaccagaagcagatgctggtgcaatgcttcttgtacagcctgcagagctgtgagccaaataaacctcctttctttataaattatccagcctcactcaggtattcctttatagcaatgcaaaactgactaagacagggtatcaggagacctagatttgcctgcatctgagaacgtcatcaggactcttggaacaatttagcccacagttccaaggttgatttttgtcacagcgaagttcaggtagtaagaattctcactggtggctgttgagggtggtggtggtggggatgggtcatatggagaattagcagtgggagactagaaattaaagtggagaaagggaagaattaaaagtcaaaaacagtgtgagggaggaaagcaatggatataacacctcggatctttatccttgagaggccttaaaaatctacttaataatcagatggtattctataagaactttgagactagacatgtgatgacttttaggaaactgccctggagctgaaaatgcatgcaaatctagctgactcagctccagccttaactggctcataacttgtttcataaacatgactgtatgttagcaaggaaatgagagagaataacagcacatcacataggcatgaaaagtatttgcaaagcagcagttctcaaaaatgacattttgcagagttttccagaagcagattcagaaaactgaagaccaaagtaatgagggagctgtctcatgcctagatgagcagaagcataccaaaggcttagtatttccccaagtaataggcacctgaaacttatttaaggaaaatactcttcttgatgaaacaggcactgcagttgaagcaggaatgtgtttggtgtgctgccttaaatagcatgggtagatgttcaaacatgttaggactcactggccctaggaaagacccgcaagtatctggtctacaccaggaaattgacaatgaaacaccaaacaccttttctcctctaattaccaagaaaagtatttctttcccaatggtggaagacaataatgttgggaatgatgaagttttctggagtgtgaagtggatatgtcttataagtttaatccacagcttcaccacttcataagtggataatcgaattgtgcctcagtttcctcagacttggggatattaagagtaccctcagtcaccacaaggtgggtaccaacataagaaaagggtatagcaaaagcccaggggtgcatgttcttaaagtgcctagtgtgggattagaatgacaagtggtagatgacttacttgtgcagaaatttagagttattttgtgattttcaaatgatcatgggtgctttccatatgctgtccagactgggggtgctgcagctagaaagggaagaaggtttccgtatttcctgagactggagtcacatcctctcaccaatgcactcacctgctgactaaccagtgtacttctgggaattgcaaatgcatgaaatggcacccattctagactagtcacagcagtgtttttgatggccacagaccaggaacgaccctgatgtttatccgtagggaactaggtaatgagccatgatcctcatcatggatactgtgcagctgtggcaaagaatgaggtatccttctgtctgtgcaccgggaaaggtttccaagatacactgcacagtgagaaaaacaagaagcagaacaatgcacggtgtgctacctcttgcattacaaaggaggaaatgtaaaactaatttacaaatggccaataagcacatgaaacgatgctcaacatcactaatcattaggaaaataaaaatcacaactacagtgggataccaccttacatccattatgatggttgttctcaaaaaaaaaaaaaaaaagaaaaacagaaaagaaaaatgttgacaaggaggagttggaacgcttgtgtagtgtttgtgggtatgtaatatggcgcacccactgtcatcgtttctcaaaaaattaatcatagacttaccacaaaatgcagcaattcagcttttggtgtattccaaaaagaatggaaagcagggaccccagcagatatttgcctgtgtttgttcatagcagcattatttataatagctaaaagttggaaacaagcccagtgtccatccatcgtgaatgaataaacaaaatgtggtctatacgtgcaaatgaatgggattcagctgtaacaagaagggtggttctgacgcgtgcttcaacatgatcaagccttgagttctttctgctaagtgaaataatcagactcagaaagacaaatattacatgattccacttgacagaggtgcctaacgtcatgaaatgcatagacggaaaatgaacaggtggttgtcagtggctggagggagggggaaagaggagttggcgtttaatgggtatagaattccagttcgggaatatgaaaaagttctgggtggggatggacagtggtggtggttgaacaacaacctaaatgtacttcctgccattggatgtacacttaaaagtggttaaaatgggccgggcgaggtggcttacatctaatcccagcactttgggaggtcgaggtgggcagatcacaaggtcaggagatcgagaccatcctggataacaagatgaaatccactctctactaaaaatacaaaaaattagctgggtgtggtcgcatgcacctgtagtcccagctactcaggaggctgaagcaagagaagcggttgaacccgggaggtgaaggttgcagtgagctgagatcacggcattgcattccagcctgggtgacagaatgagaccccttctcaaaaaaaaataataataaaaaaaagaaaaaagaaaagaaaaattggttaaaatggtgaattatatgttatatatattttatcagaatttacaataattcctattgttttgcataaaacagctgtagaaagctttgcaggtcatgaacagcacagctggccactggggctggtgtggggctaggacctggttgcacagggaacagggatgagacacaggctcttcatgcctgcacatatatacggatacacacagatgcaaatttctaagccatctaaatacaacacctattcaaaaaatcaaacagaaaaaggaaatgttatggaggtgaaggatgagggtaggtggggtggctgctcaggacagtggaggccacatcacgcaaccttcgaggcctctcttagctgctggagcacatcccagggacttgggagctctggaaagaggagcaggagagggccatggccggaggaggcctgaaaaagatcatctctgccacagagaagaagctggctcagatgcttgtggccactgtggagacagggagacccagggagacaacagtattcactcaaggaggaatgggtggtgatgcaaacttgggtggaggccacagggtgcagaagacaggacacagcagagagtgatgtaggacatggaagggacagaaaggagtgaccaccggacataaaggggcaaggaaagtggaagcatgagaacatctgctgggcatctggtggagggatcaggttcccagggtgcccatccctaagggagaacccaggataggagcagattcagagaaaaccacccagctcactccagcaagaagcagaaaagggactggttaaaggacagggtaggaaggtcaccaagctccaagggccctcatgaatccagcttgtaggccacagggcccagggcaaggaccaaaccacaggcacaggacagctccggccaagatcttctggctactgcaggaggcagaaaccacaccctacaccctgcactgctgaggctagccctggagtccagaagcttctgcaccagaacctttggtcccccatccccctcaaaaaattaaaaacaaaaagcaaatcggtgccatgcacactctgtttcctggtgctgttctggatcctgagtctttcatgggagcacctgatggggaaagcctggacctgtgttggtgtccctcctgcaaggagtgctgggacaatgaaatttctggcttcctccttgggaaggcagaacattccccatgtgtactggtggcatttaaaaactgcagggcagccagagaacatgcaccgtgttccaccaggagagtttctggcgggttgtcccggtgcagacacccgtcccaaggtgggtatttgagctgaggaactgagaagccggtttctgcctagagttagagatccgaaaggcatcaccacatggaagggaggaaagctacgatgccttgagggtgggagatcagatgaaccaggagaggcagggcccgggaggaaccccggggagcagccgcctttaaagcctgggggaagtagcttcagagaaggtggggtaggtttgtgtggggggtgctggaaaaatataattaagaaagaaatttctgctcagtccagaaacccctgtcacatccgtagaagtaaaagaaacctgtgttatgattgagtaaccattaagccaaaatgtgatgcaatctgctaagagatgacaaagacagaaagaaatcccacctttgtatccagccaagcaggtgcaacccgttacacatatggtctccagatagatggtgactagttcccagttgagaggactcaatggccccatttgtcacacatagttcatcctaaattcacccagtaactgtgttggttctctgtgaggttaattggctttatccacaggaaaaacaaacctctcttatctatgacaggaggtagttttgcaactgggaatgagatgcccccagaactgaggttccttccttctcacagaaactgggagacaggggcgctttctggccagatgcctgcctttcaaagagatggctcctatggccttgaggaggatagttctgggttgtgaggcaggcaagatgcttatgtatgtttagaaagctttacatacatcttcaagggacagagaaagaattttcaattacacctcttctaaaaaaaaaaatgctctcaaagtccagcctaggcaacatagcaagatcttatctccacacacacaataataataataaatttgctgggcatagtggggtgtgcatgtagtcccagctactcaggaggctaaggagggaggatcacctgagcccaggaagttaaggctgcagtaagcttggatggcaccactgcactccagcctgggtgacagggatggcaccactgccctccagcctgggtgacagagggaggctctgtcaataaatgaatgaatgaatagaaaatgctctgagtgaaaagaggagagtctctttatctttttgcaacaggctaaacaaaatttttagaatgtatatttgcctcacagagattattccaggaaaagaagtggccctcagtgtcaaaggatgcaaaactaacctgtgagttcctggcaggtttagcaataaagcaggatgtttctgatctcagtacaagcaatgttagagaaaggggaggatggaagtggacgtggaccagtgagtggaaggtgacaaatggaagcaaaggaacgtatccagaccattgaagatgcttgaccgagaggaaaggggcggtggagggaacggaagcccgaggaagtcatttgttgcaataagaggcctcagagcacgtgtagggtgcggggcagagcccatgcagaggggctgtggaaggctggcagggtgcaggtggccccactctctgtcaccctgaggagtatgtggtcagagttaaagctcagtctgtttctgggatcaggtaagaggtcagcgtccggagaagggaggtggatcttcagatcctgcagacctccaccgcgccctctgtccctcttgactgctttttctccatctctattgtctggctcacattcctgtcacgtcttcctttctccctacccctcttttctcttttctcctctctttttcttaacccttgtacctttggaagtcccactaatagaatttaaacagcttttcaagttggttttttgttcccagaaattgacattagactctccatgaataatgtagaaatcaagagtataagctggttcatgtctctgcaaataaacaaataaaatctacattccaatgctttcttcttccagagtagcccacatttgatatttgtttttaattactgtcacttgcgatagatttttaaatcttgtaacctggttacacaaataccatggggcaaaagccttacttcctgtgagaggaaaccaggcttgactagcctcatgctggctttgaagaagtaaaatcaggggttgatgaatttgcatagggtaaatatcaaaggtcgaaagtcaacaataggtgatagagggaataccccaaattacaaaagaacaaactgtttaagccacaacagaattatcgtagaaataaaccacggtccttcctgctaaaatattccacttagaattgtaaaatattcttctcaataactcctggaagagcctattaagaaattagtgaggctgggtgcggtggctcacacctctaattccagcactttgggaggcctagacgggcagatcacctgaggttaggagtttcagagcagcctggccaatatggtgaaacactgtctctactaaaaatacaaaaattacccaggcatggtggcaggcgcctgtaatcccagctattcggtaggctgagggaggagaatcgcttgaacccaggaggtggagattgcagtgagccaagatggcgccactgcactccattctggacgacagagtgaaactccgtctcaaccaaaaaaaaaaaaaaaaaaaaaataagaaatcaacgaatgtaagagcatctatgttccaaatgcagtgtattattttatgcaggttttcacaagctccaaaagattcactgtgcagaactggaggttctagagaaagaccacgcctcctcctgcaggtaactcttcattcaggaagcagctcttggcttatccctgggcttagtggaattcgaatacctgaccataggacaccaagggctttgggacctgagtggcacatcatgtcctggtgacatctgagttacctggggcgtgcacagcagcctccagcatcccagggagagctgtgtacggggtcaggctcaagcgggtcccagggcaccagtgacccaatgggtgactcagactcccatggcacctgctccttctgtttctccctccgccgtatatatgagctcatgggaagtgctgtgacctcttacagaggaggaaagtgcatggacttccagcttctagaactgggatacaataaactcctcttgcttgtctattcctctgcagtattttgtcatggcagccctagcaaactactacagggactgtgggggttaggatgacaccaagcatcaaatgccactccctgttccaacactgagaccattccacagcccctgaatgacaagacaggccttcaagctcaagactacttggctaggtaagtactttagtcacaccacttctgaactttcttgcctacctgcagggcaggaatttttaccattttcaaatgaggacactgaagctcagagaagtgatgctatttcctgatggataagaggtgatatatttcagtcctcagaccaactctgaagtagcaagcttctagtcttaagagtcaaacttggctgggcatggtggctgaagcccataatcccagcactttgggaggccgaggtgggtggatcacctgaggtcaggagttagagaccagcctggccaacatagtgaaaccccgtctctactaaaaatacaaaaattagccgggcgtggtggtgtgtgcctgtaatcccagctactcaggaggctgaggcaggagaatggcttgaacccgggaggtagaagttgcagtgagccaagattgtgccatttcactccagcctggggaacaagagtgagacatcatctcaaaaacaaaacaaaacaaaaaagagtcaacctcgagccaggcacggtggctcatgcctgtaatctcagcactttgggaagccgatgaagtcaggagttcgagaccagcctgggcaacatgctaataccctgtctctaccaaaaatttaaaaattagctgtgtatggtggctcatgcctgtaatcccagctatttgggaggcggaggcacaaggatggtgtgaactcaagaggtggagcttgcagttagccaagattgcaccattgcactccagtctggagtgccaaaaaaaaaaatccatctcaaaaaaaaaaacacaaaaagaataaatatggggcctcatgactgtatattactgggcttctgacctagactgaaagatcagggaagagtttcctgaagagaaagtgagctatgatgggcccactgtactccagcctgggcaacataatgaggctctgcctcaagaaaaacatgcagaataaaaccacaaaaagataccactacagaactattagaatggctaagattaaaaagaatgaccacgccaagttttggcaaggatgtggaggcactggaatgctcacgctgctggtgggaatgtaagatggtacaatatctatggaaagcagtctggcagcttctaaaaatttcagcatacacccaccatgccactcggcaattccattccattcccacattatttttatttaaaggaaaatcaagtggaatgatctttaaagcatttttgcctgacaaatacatgaaatgtgggtagcagcccaacactccctggtcagtcttcacagggcatatgtggcctcgtggcccccaggaaatatggctctttccacaagtgctaagtccagtctctccatcaatcctaagatgttagttccacagcactgccagcatggggctttgtctatttctttctttctttgtcttttttgagaggggtcttgctctgtcatccaggctgaagtgcagtgatgcaatgttcgttgtaatagctcccatttcatttctaattgatcttatttggctcttctctcttcttttcttggttaatcttgccaatggtttatcaactttatttattattcccaaaaatcagctttacattttatttatattttgtattattttgtttcaatttcatttagttctactctgatgttggttattttctttcttctgctgggtttgggtttggtgcattcttgtttcttgagtttctagaaatgtaaccttagattgtctatttgtgctctttcagtctttttgatgtaggcatttaatgctataaacttttagcacactctttgctgtattccagatgttttgatagggtgcgtcactattgttcagttcgaagaatttttaaacttccatcttgatttcatatttgacccaatgatcattcaggagcaagttatttaatttccatgtgtttgcatggttttgaaagttccttttggagttgatttccagttttattctaccgttgtctgagagagtacttcatataatttcaattttcttaaatttattgagacttgttttgtggcctatcatatggcctatcttgaagaaagttccatgtgctgatgaatagaatgtatattttgtggttgttgggtagaatagtctgtaaatatctcaagtctattttctctaggacatagtttaaacccattgtttcttccttgactttctgtcttgatgaccagtctagtgctgtcagtggagtactgaagtccctcacaattattgtgttactgtctatctcatttcttaggtctagtagtaatagctatataaatttgggagctccagtgttaggtgcatatatatttaggattgtgatattttcctgttggataaatccttttattataatattttattattatataatgtccctctttgtcttttttaactgctgttgctttaaagttagtttttttgatataagaatagttactcctgctcacttttgtggccatttgcatggggtgtctttttcttaccctttaaccctttaaagtgtttatgtgacactttagggttaggggagtctcttgagggcagcagatacttgcttggtgaattattatcaattctgcaattctatatcttttaagtggagcatttagaccacttacattcaatgttagtattgagatgtgaggtactgttccattcatcctgctatttgttgcctaaataccttggttttattcatttatttattgtatttttgttttataggtcctgtgagattcatgctcaaagaggttctgttttgatgtgtttccaggatttgtttcaagatttgggttccttttagcagttattgtagtgctggcttggtagtggcaaattctctgagcatttgtttgtctgaaaaagactgttatctttcctttatttatgaactttagttttgctggatacaaaattcttggctgataatttttttttttttctgagatggagtcttgctttgtcacccaggctggagtgcagtggtgcgatctcggctcactgcaacctccacctcctggattcacaccattctcctacctcagcctcaccagtagctgggactacatgcgcctgctaccaggcccggctaatttttttttgtatttttagtagagacggggtttcaccttgttagccagcatggtctcgatctcctgaccttgtgatccacccgccttggcctcctaaagtgctgggactacaggcgtgagccactgcacccggcctgataatttttttttaaggaggctgcagatgggtatgcatgctcattggaggtgagcattcttcccttattgaagattactaaaatcacatgtattgaaaagcatttgggattatttacttaattgatgagtactcatttatttttacatttatttgataccacgtataaaaaagtatggacatatacatatgtgatatgcgatacaccatagaacatatacatgtgcacataaagatagagggagacagaaatacttcagattttttcttttaaaactttttgcatgaacccataaaactcactgttaaaaaaaacagctggatttaaattgtgcttttgcaaaaagcaaaagttaacatttaattgaggaagcccttgctgagttttagagaaagtaggtagtaaatttacatctcaaagcacacacacacacacacacacacacacacacacagagagagatagagagagagagagaaggaatttgggtgtgttcaaggaagattaaaagtagttgccaaggtaacacaaaaatgatagaaatttataacaggattttataaggagaccaattttatttacatatatagcttttattttggtctctgttttccaactgtactccaggaaacacactacacaggctcccttcttaagtgctggtgggccactgcacatgcagacagcccactttaagggaagaatcaggggagaagagatgcagaccccagaattatgccaacatacaaaagcctaagtcaaaggtcaaaccacacacttgaaatctcatcgcctgtttggccctgttttaagtgtactttactttctttaatttctgctctaaagcttttaaataaactttcactcttgctctaaaatttgcctgtctcttcttctgctttatgacacttagttgaattctttcttctgaagaagcaagaattgaggctgcagcaggcttgtacagatttgctgccattaatatagtttagtgccattctacatgatagaatatatatattcttatatttatatatatatatatatataaaatttatgtattcatagaggccttgaatctacattcttgctgcactttatgtaaacaatccaggtataagactaaaacttattttggaaatacattggtcccatatgatttctatttcataaaaatgggagacaggagggggaaaattatttttcagaagaaaacaacagaacaatggttattgaattttagatctgttcatttttttttaaattttgttatttacctacaatttggactgaatcctaaattttttcctggctcaaatttcaaaactaatggtttcagaattttcttccatttttcttccattttggtatattataaattaaaactgtgatttttaaatttttatcttttttattacacttttaagttctgggatacatgtgcagaatgtgcaggtttgttacataggtgtacatgtgccatggtgttttgctgaacccattaacccatcatctaccttaggtatttctcctaatgctatctcttccctagtcccccacccctcaacaggccccagtgtgtgatgttcccctccctgtgtccatgtgttctcattgttcaactcccacttatgagtgagaacatgcagtgtttggttttctgttcctgtgttagtttgctgagaatggtgtttccagcttcatccatgtccctgcaaaggatatgaactcatccttttttatggctgcattgaattccatggtgtatatgtaccacattttctttatccagtctatcattaataggcatttgtgttggttccaagtctttgctattgtgaatagtgctgcaataaacatatgtgtgcatgtgtctttatggtagaatgttctataatcctttgggtatatacccagtaatgggattactgggtcaaatgatatttcttgttctggatccttgaggaatcgccacactgtctttcacaatggttaaactaatttacattcccaccaacagtgtaaaagcgttcctatttctccacatcctctctggcatctgttgtttcctgaccttttaatggtcaccattctaactggcatgagatggtatctcattgtggttttgatttgcatttctctaatgaccagtgatgatgagctttttttcgtatgtttgttggtcacataaatttcttattttgagaagtgtctgttcatgtgctttgcccactttttgatgggcttgtttgttttttttttcttgtaaatttgtttaagtttcttgtagattctggatattagccttttgtcagatggatagattaaaccttgcaagctgaaacttgacgacttatgtaaacttctggagaaatcatagcaacttatatataaacaacctttgtgcctgctgatgtgtggactacacaaaaggtacacatgaacactgtattcagactgcaattcagaaaaatgtgtcagattgccattgcaattggaagacacttcagaaactctagaaaacctagtctatacagttagagcgatgtttgccaaatgaattcctctaattgaagcagcagttgtgtgactttaataaggttccaggattatactgtcccttttttgctgtgacttccctttgcccttttctgaattgtcttcatccccttttccacggggcatgacttcttaagaatgagccttcctagtgatgtaggatcagatggaacatacagtcacaaagtcatgtcttctacaatgatttctctgaaagcttttgaggaattgaggggccaggtgtgctggcagaggcctgtaatcccagcactttgagagtccaaggcaggaggatcacttgaaaccaggagtttaagaccagcctgagcaacaaagggagaccatgtctctacaaaacataaaataaatcaaattagccaggtgcagcggtgcctgcctctagtctcagatacttgggaggctaaggctggaggaccgcttcagcccaggagttcaagactgtagtgagtacactccagtctgggtgacagagcaaggttttttctctaaaagaaaaaaaaaaaaggaaaggaaaagaatagggtaaacaggaaagccaaagatcttgggcatctccagatgtttgcctgaacaaattgttttttcttggcttcaaaacctttcaagatgcatatttctttgtaaaagaaggacatacgaatcgtaactttaagtgagcaatcaaaatctaggtcctaaaactgaagtattttaactctcattctgataatatttattttctgaggcaaagaagaaagacaagattagatcaattgtttctctgcccactccatctcttccaacttgccttgtcccctttaatcaaatgtataaatactaagcctcctgaaacgtcttcagagaaaacacaagccacagaggttttttgcaactcatgtattcccagggtgcactgtcaagctctggctcaataaaactcaattggtcaagacccttgcctcagtcagtcattctggataaccaccatgagtcctgcaaagcccttcagtaatctattgcctgcctaggtgatgtgtacctaggtgagtcagatcttcatgagtccaacactcgtcttccttttctgtctttcccaaccctaccactcagtgctgtgtgctctgatctgaccccagctcccaggttgtttgtattggtctaagaaagcaagaccaggaggggcaggttgagaaggaagtaagaggccaactgccatggaaagtggcaggtggggctgtcattgctcaaagccacacactctgggtgcattttatgaatttttctggattcataatcttctccctctgtgtctatctagaaactcaccctcctcctactttcttctcattactctttctgtttctagtgcactcatttatggccagagaatggccatgcaaatagttgacaatagaataaaaaatgacattttgtgagacttggaagctggcctttcttttttctaaaagagattgaggtttctaaaagctagcttttatggagggctgtgcagttatgattgtagttttacagaacaggtgcataagtgaagggtgagacagaaaacaaaatgctggctgtttgtcaaatcctgaaagtgaatgggacaaaaatcatgtttgaaggaggatgtcattcaggagaccttgtacatcttagagtgtcctcttaccagatgaagtggaggatgaggttgaattgtggggttaggtgacagtgggtacatacttctctgcctcagtttttgttttttttaatctgtaaaaatggggattgtggcacttgggatcttttggtgaggagtgtagttacctggaaagctcttaggatagtgcctggtacatagtgattcctgcatcagtgtgagctattataattatgggaatagaaaaaggtgccaccctggacatccagagtggggagatgttttccagtcagggtccaggcaggccagctggagacgaagctgattagtggggaagcttaacttccaggagtggaagaatttaggaggagtaaacagaatgcacaacatactgtaaacattcctttacccaacagtaggaatactcagagtgggtgtgtcttccgtggcaatcattatctcctgggaatctaagaatgtgtcctagagtcaaatggctttgatgtaagccaaacccagaaatgggcttcagggctgccttgcacatagcattcattcatcttgaaaaaggaaagcattcatcttgctaaaggaatcccctcttctggcccagaccattatttttgtttttttactatcctaattttaagatgtaaggagaaagactgaagaacaaaataatgaagtacatgaatgaaataacagggtagaattgagactggtatgtgtaagttaagagaaattgtgtataaattttgtgtgaacagaaaattgatttcttgttgcaaacagacctctctacataaataatacctcctgccttgagtggatagcagacctcatcacaagaacattccagcagagtcatgagagaatgggtagtgtggcttctttaattggcaggttagactgagtaagttactgaagagaaagaagttgaaggagaagatgggtgagggcaagaaaaatgggaaggtgaaaggaaaggactgaaaggaatgtttaccaagggctcatcaggtaccaggctctgtgactaatgtcttacacatgttaatttactcttccactgtcattttctgatgcggtaagagtcagtcttacactacaggtgaggaaagaggctgagggaggtcaaatgagtggcccagggtcatccagccacttcatagcagagctagtgtgtttcactgtggtttgtgcagacagaaaagtgagacatggaaggaaggcaaaacatttttgttgtgggtgatgtttatgaaagtgacccatatgaggcagaataatggcctcttaaaaatgtccacatccgggccgggtgcaggggctctcacctgtaatcccagcctttggaaggctgatacgggtggatcatgaggtcaggggttcgaaaccagcctggccaacatggtgaaaccccatttctactaaaaatgcaaaaattggctgggcgtggtggcacatgcctctaatgccagctacttgggaggctgaggcaggaaagtcatttgaacctgcaagggggagattgcagtgagcccagattgtgccactgcactccagctggggcaacatgagggaaactctgtctcaaaaaaaaaaaaatccacattctaactcttggaacacatgcatttacttttcttggcaaaaacactgtacaaaggtgatgaagttgagtatcttgagatggaaagcttattctggcttatctatgtggctcccagtgtcatcataagagtccttgtaagtgaaagggaaaggcaggaggggccgggtgagaatgatgaggcctgagagactccactggccgttgcttgctgtgaacatgtgtgataagacaaaattacaactaatttagttatagatgtaattggcttttatttgtgatttatgatttggggcagctctccctctacagatgcctcagcatcccaagtagctgggactatattgcaggatctgaccagaagcctgcaatgcaatggggctctttctttgttcccaggcagatcggcaggttgagaaataaaaggcacacacaagatagtgaaagccatatcgagaggggtcaccgccttctggtcctgcaatgctgccaatgcactggatataccagcatttattattaagtttagtgagagtggggataggttactgagggatttagggttatttataggctctccacaagggtcacattccattcccagagctatggacatctgcttttctgggataggaatcttggtaatgtgaaacctccctgactgcatgtccgttcataggctctctgcaggggtaagcacatcatgtgctgttagctcattctggcagcccaacctggcatttgtctttacacaatcctgcatgcagtttcatatttacaataatgaggagcatttcatcttttattccgtagcaatagtttcagggggtctccctacatctcccccttttctctgatttcaatgaaccatagcaatcatagcttggcactgatcacgattggattgaagaatattttttccaattttacacatgaacaataaaccaatagcacaaactgtctaaaacttcagcactgggtaaaacagttaagagtgcttgagaagcttcaaaaatctgttcttttagcttccttatgtctaaacttaaattatcttcacttccttgtaaatggcattttacgattcccaattgtgaacagactcattatattggaatggagttatacaaaaatcagaagtattccaatcacgttgcatttgtaatctatgttctaatctcataattctatctcccatccatataacagaagcacatcacgcgctgtaggctcattctggcagcccaacctggcattgtctttacacaatcctgcatgcaattttgtatttatcataatcaggagcatttcatcatttattctatagcaatagtttcggtgggtctccctacaggactacaggtgtgcaccaccatgcccaggtaatttttgtattttaactagagacagggattcaccatattgaccaggctgatcttgagctcctgaccttgtgatccacctgccttggcttcccaaagtgctgggattacagatgtgagccactgtgcctcgcccataaatcacacatttctttgagtttttgtaattccagcacaagagaaaccatttgatgtttgaagaatggctgcacacaaataaaaacatctgtggattgcgccacacgagggagactaccagtatgactatcaggaggaaaatatcgagtttggtatatacaccttaggcaagatgcaaaccaactacaataggatagatcaaagaagaagccagaagggtctagtcattttaaccaggcagcacatttaatgatttttacaactgactgtgtaatacccaatgtatttatccatatgcaataagaagtgtcagaaactgcacaggctccccccgttcagctgatagagagcaattctattatctagcattgcatgtctatgttaaattaaaacagggagtgagaataggcaagtatagaagtggaagcctaaaaaaatctccatacatttgaggaaaaagttgtgttacagatgcagctaatgtcagcctttgggtggattaaaggatctcttggtatgtaaaaatgtgtgggctgggtgtggtggctcacgcctgtaatcccagcactttgggaggctgaggcatgcggatcacctgaggttgggagttcaagaccagcctgaccaacatggagaaaccctgtctctactgaaaatacaaaattagctgggcttggtggcacatgcctgtaatcccagctactggggaggctgaagcaggagaatcacttgaacccaggaggcggaggttgctgtgagccaagattgtgccattgcagtccagcatgggcaacaagagtgaaactccatcttataaaaaaaaaaaaagtgtggttgacatgatatatctgacactgttaacttactctcagaagctacttcttgtgaaatcctaagtacagcattattctgggaagcaaaggagacaggcataagcaaggagaaattcagagaggtaagagtctcatcatgattgatagtcttgttctgacatcttgagaaaagctgtccacagtgtaaagtcatcaacttgttgtcgtggtttgcagtttgagtgtctctaagttatggtgttggacatttggtgagctcttagtggcccacacctcagacatgagggttttcccatgaaatttacattgagttgtccacctccaacttatatggcttcaggaacagagccactcttgttcttaatgatttcattggagaaaattgaattggaagaactaaaagaattcagggtccagtccagtctaccagtggattataaatactcaatgataatgaacagtggttcaatctggtaacaggtgtactacagtttttcttttcaacatagtttttctgtctataggagtctctatttttaccaaagataattccagtaggatgaatttgtttgcaaaataggttgagtctcaccgaacttgcccagattttttagctaagtgcggcaagagtagcaagggaccatagaggctctttttaaacttctctttgctagaagtttttaataagaatctcagattaaacttccaaaaacctcttgagactaggaagccaacccaaggcccgcttcagactttgcctgcattccctatgggtttattctatgtatattctcaaatataacatcccagtcaaagccttggtaatataaccaatgttttcaaatgtgtcctgttataaagagagcagattcttactaaacttgtgcaaataactttattaccataaacatatgaatattcatgaatagattcccaattctggggcactcagagagcaaaagcaaatgtttcaatttttgtttacaaaagtatactttaccaattgctgaagaaaaaaattcataaatctggaggataaaacattcaaaaaatcagcacattttccaataaaaaattatgaaaacattatccttttgttatttagtccaatgaaatggagttcttttcttctttgtcttgaatttcatgaaggtatcagcctgttcatcaaaattttgaaagttcttagtccagtggtatgatcttgaagttatcaggaacttgtattcaagagtccttttcatagtcttttccataaatctccttgaagaaaaagcaattttggactgtagctgattttaaatactttgaggaagaatcaaagcaactttctgggaatgacaaagatttaaaatgactatgtttaaaaatctaatgagaatttattatggtaaagacacagctcacatagaaatctagttacttctgtggcttatgacactatggtaacatatttgatttccagaaatttcatataatttttagaacactcatttttttaaattttttttgagatggagtctcactctgtcatccagactggagtgcagtggtgcaatctcagttcactgcaagctctgcctcccgggttcatgccattcttctgcctcagcctcctgagtagctgggactacaggtgcctgccaccacacccagctaattttgtttttgcgtttttggtagagatggggtttcactgtgttagccaggaaggtctggatctcctgaccttatgatccacccacctcagtctcccaaagtgctgggattacaggcatgagccatcgcacccagcctagaatactcatattattaacattcccataaatattatttagagaaggtttagcatcacttatcccttatttgaaaatgctttctatataatgtaatatataaaataaggtggcttttccattcagcttctgtttctcaagaggattactgagttcttggtgtagcccattcataaatagggccaaaaaggtatagtcttatgtatgttgaaaaagatccttaggtaattccagtacttctagctgaaaatcattcatttagttttaagttctacctattgcaacaagagttctccatccttgttacatgttagtagtgtcagggaagacttaaaaattaccaatgcctgggtccgtctccagacctttaaactggaactaatgggtggggcttgagcatcctcttttaaaaatgttttccagtgattccaatgtgtagctctatttcccatcagatttctctgatttcttgtggcattcaattttttctattttggtatcatgattattttcaggtctcatttcctgtcttaggctttgtgtctcctggggtggggcccttgccttcttcatttctgtatgttttttgaacacatgaactgatcatcaggaaaagatctcaaccacacataggttgtgtcctgagtctcaggttcacatgttaatcctaaagtctttgttctccacgaggtcagatgttgcttgtgatgaagggtgtggttaagtctgcagtgcagatggtggaagggatttcactctgtttttagacatagcattggaactaagaattttatgtctatatgggtgaaggggcagggatgtgtaggaagacagttctaattaggatggaggaattatactaggaagtagaggtaaaggaagtgagaaggcttagtaaatagaagaaatgtgaacttatcaaataggctagtgtatacccctggagattcttgattaagtgaattaactagattttagaaaggtaatgaggcagttatatgcaaggaacatttcaaagtctggagacaagaagtcaagcaatactttgagaagtggttgagctttatgggaatggagagaattacactattgagatatgttaaaaataatgaagaaggtttcaccatgtgaaattgtgtttctcatttgaatctgagaaacaaatgagcagaggctggagataattatgtctaaaagacagtggggtacagggagcataaaggccagggagaaagggaactgcaggaattagtgctgagaagcaggagttagtggatgaaggaggagatccaggcccagatacaggcaaataagtcatttccctctcccaagcatggcagtcagccctgcaggaaccaggataagagaaaaggtcatcatacctgccagtcttcctgaaatacaaaaatgacatcacggctgctacgttggattattgaaagcaaaagttcctaatcctggaggagctgtcatggaaagaaaagaaaagaaggaatgaaggtgatgttattttacatgggggagcgtcaggaacaagcatgtaacatgagatactgtataattgtttcttcaaggactacattatttctgttggaaaattgatgggagatgattatattcttgcagttttttttccctctcaccatgtttctcagttggtgatcagtcctctgtcaattctctactgcactcaggtattttggaaggctttcagacgtgagaaaggctgattgctattttctatgtcattggaacttgtcacctttgcaccttttcatggttgcatctttttctcagtgtctctgttgtggcagtcatgaatgagactctgtcagatctccatggcagggacctgattgacagaaggcccaggtcagtgcatttcaaattcaccacctcctttgcacagaaagcttctttcctacaggctcccaggaagggtgtgaaagcaagcctagttctctgaggctctctttaacgctaatgggtgactggttggaggattcctcatcagccttgcaaaaactcttagaattgcattggtacctaaaacttctttctctttctttttcacaggaatcagctctgcatagtggtctgtgggttctcctgtactaccttcatgcctgccccacattccctcacaggtgtcttccgtgataaattatcgtttaggtctaatcccgtcttggatgcatctcagttggtaaaaactaacataccaggcttgattctttgcagttagctctttatctttctctcccacaagtagtcagtagccttgttctagtgttttatgtgttacctctttttccatatatatatatatatatatatatggaaaaaggaaggtactgttgaggggcacttcctatgtgccaggccctgtgctaaatactttacctgtatctcatttaatccacacaataaccctgtgaggtagacattatttccattttgccaatgaaaagacagaagcttagcgtgctgtaaaaactttcctggtgtcatatggctagtgacaggtggatctgagatttgattctaggactatttgacctcaaggttaatgatgatgatagtaatatagtagctgacattggttcctctgtatgtggcatcttgtttcattgactgcatgaaacctttaaaagaatggtacgaagaaaacactctcattgcaattttcaggtgaggaatcagaggttcagagaagttgagtcttgtgcaagaaatttataactgtaaactcttacattaaaaaagaagaaagatctcaggtcaacaacctactttaacacttcaggatatgaaagaagaacaaactaaacccaagcacagtgaatgagggaaataataaggattagagttgatataaataaaatggagaatggaaaaagaatagagaaattaatgaaaccaaaagttgattcttcaaaataaaatcaacaaaattgacaaccattaactagattgactaagaaaaaaagagaaaagtttaaaattactcaaatcagaaatgaaaatggactctgagcatggtgggtcatgttttaatcctagcactttgggaggtcacagcagaaggatttcttgagaccaggtgttttgaccagcataggtaacctggggagatactgtctctacaaaaaaattaaaaagccaactagctgcgcatggtgacatgcacctgtagtcctagcatcttgggaggctgaagaaggagaattgcttgagcccaggaggttgaggctgcagtgagccataatcacaccactgtattccatcctgggctggcctacagagtgagagtctgtctctctctcttaaaaaaaaaaaaagaaagaaaaatgaagcgattactaccaattataataaaataatgattatgaaagtactataaataattgtatgccaataaattggataacctagatgaaatagacaaactcctagaaacacacaaaaatatgaataaaactataatcagtaacaagattcaatccataaaagcatttgatgaaattcaatattttttcataagaaaaacattctaagaatggaaggaaaccacctcaacataaaggcaatatgtgaaaaacccaatgctaacatcatactcaatggagaaagactgaaagcttcccctctatgagcaggaacaagacaaggatgcctgcttttgacacttttattcaacatagtattgaaaggtctagtcaaaaaaattaggcaagaattttaaaaaagacattcaaattggaaggaaggagtaaaattatttctgtttacagataacttgaacttatatgtagaaaatcctaaaggtggaacaaacttattagaattaataaataaattcagtaatgttgcacaatacaaaatcaacattcaaacatcagttgtatttcaatacactaaccatgaacaatctgaagggaagttaagaaaaataatttcaatttatattaacctcaaaaagaataaaatatttaagaataaccaaagaggtgaaatgattatacctgaaatctgcaaaatattgctgaaagaaatgaaagacaatatcaataaatggaaagacattttgttttcatgaattggaagactcaatattgttaggaggacagtgctacccaaagtgagctgtggattcaatgcaattccttcagaatctcagtgacatttttgcagaaaaagaaaaatctgtcctaaaatttatattgaatctcatgactctaaatagacacacagctttgaagaggaagaatgaagctggaggactcagacttcctgatttcagcatttactacaaagccccagtaatcaatacagtgtggtactggcataaaggaggacatagaaattaatgaaatatcatagcccagaaagaaatgcttgcatatatggccaaatgattttcatcgagtgtgccaagatcattcaatggggaagggacagtgttctcaccaaatggtattgggaaagctggatatccaagggcaagaagagtggaacctttacctaacaccatgtacaaaaattaacccacaataaatcatagatctaaatgtgagagcaaaaactatacaactcttagaagaaaagcttcatgatactggatttcacaataattccttggttgtaacaacaaaagcataggcaacaaataaaatcaataaatcggacttcacaaaaatcaaaaccttttatatatcaaagaacattatcaagaaagtaaaaaggcaacccatgaaatgataaaaatatttgcaaattatatgtgtgataagaaattaatttccagaatacatgaaaagctacaagtcaacaacagcagacatccaaaaacccaattaaaaaatgaacaaaggattaaaatggagttttatccaaggaaggaacacaaatatccaataagcccatgcaaagttcctcagcatcatgaatacttagagatatacaaatcaaaaccacaatgttacaccacctcacaaaatttaggatggttttgataaacaataacaatgacagcaacacaaaacaacaggtgttttcaagtagatggaaaaattggagctctagtgcattgctgatgggaatgggaaatgttacagccactgtaaaaattggtgtgctgtttctcaaaaaattaaacaatgaattaccatttgatccagcaattccacttctggacatactccccatagaattgaaagaaatttgaacaaatatttgtacactgatgtttagagaagcattactcacactagccaaaaaatggaaacaactgaaaagtccattgaaagataagtgtgtaggcaaaggaggtgtatctatacattgaaatgttattcaaacttaacaaggaataaaattccaatatatcgtgcaaaatggatgaaccttgaagatattatgctaactgaaataagccagacacaaaaggtaattattatataattccatttataaaagatagagtagccagttacatagagacagaaagtagaatggtgggtgctaagtgttagggggagaaggagtgagagttactgtttattgggtacagaggtttaatatggtaagaggaaaaagttctggaaatggatagtgtgatggttacataacactaaattgcacacttagaaacagttaatggtaagccttatattagatatatatagtgtctggtagtcttaccctctctataattacacactttttggcactgcccctttcctgccatgcagagccccaggggtgaatcttcctatttctccagctctgcatcagtcactgtactcagtgctgtgtcccacgtgctgtgcccacagcctcatacagccagtgacttcagagccaggacgcagctcaggagtctgccctgaggttgcttctcttcttatttccttgcagcctggcccgggggaggcttggcttgaactggcagctcaatttagccaaattcaggacaggccaccaggactctttctccacacatgctggtcccaccccaggttgagtgaggcagggccagtcaccagaggagcccggagcagagcaggaagcagagtctgagctgctcctccctcacccaaggggcttcctcctctcatttgggggaaaagtgtgagcttgtttcaaagcctcagatgttccttgtagttcatggaagaggtacaagaaaacaaagacgtgacagaaggggatgagttggtgacagtgagaagcaactcgatgttcagcactctccttcttgtccctctgtgaagcctcttctaccacatagggctcagggctgataaagccccctccctacctttctcaggccagacacaaggtcagtcatgagaaaacagaaaaaaaaggagaagagagtctgtagagacaaattgggagggttcaggaggagaatttgggatttgcctgtgcccatgggacacaggctgggaataaaaatgttttcctgactcttctctgaaagctagatagactccacctaaaaccctattgccaaggatgctgggatccacttaccaatgactctgattgtcaaggatgtggagctttcctcgccagtggctgagttacgagcagagcaagcatagagcccattatgctttggagtaatctgagggataaagagcttttgtcctgatagctgaaacttcccattaattgtccaagaatactgtgctggtgggttagagtttgcgaagcaggacaagtcgaggttctctcctgaatagtaagaggtgactgaagggaaaattctggggaggtctggaccatctggaggaaagagaataaagccacagttgatgtcatctgagggaaggggaagctccttgtctcttaaagggacacagtgaccctctgagccaagacacaccctcaagtcccagccaaaccccctctatgttcactgagctgaagcctgaagtattcacctgtttctcccaccacaagctgtgggccccaagtctcccatgacaagagcatcccctctccttatattcttggttaaggctgtgtctacccaagttttcccagggcagggagtcatggccacctcggatgtccaaaagtaaaggtgtctgtacttggaccggagagagactgagaggcctggcccctggtcgtttggatttaagctggtgtcctggcccacagaggaacaaaagatacagaggacattcagggtgactgagtcactgcggatgccaccatatcggtcccgtatttcacattgatagggtcctgtttcatttctcgtgacactgggtagaatgaggatcctgttttcaatgggtcgctttaccctgggactgaccgggaggctctgacaatttagccaccaaatgtaggcatagttctcactcttaggttcacaggtgaaggttaagacatccttattctccctggggtttaagttgttgatggtgatgtagggcatgggcagctttgctgtgtggataacagagagaagattgtcctgtgtggcacctttgattcctccacaggcatccttcaatcagagttggcatctcccacctctcagcccacccgagtccttgaaagccaatagctggtgcgtgtgtcacaagacagatgcatgatgatctaagggctcaaagactgtgaggccgcctgcttcatcttaggaaagcacagactttctgaagtgtcaattgagcagcagtgttgggtcatggacagatacgtcagtgggagtcacagcccctggtacccctcccagtccctccataatcagttgactggctggctcaccttgggttccttacctggaatgtgcaactgctgggccccttccaaattccatcctactttgcccccctagatgtgatttctctgcagcttccatttccaaggacattctagagatcagtaataatgggacttcccattgtcctgaaaccctgaagatactgagcagcctggcctgggactggatgtttcagcagaaataacacaggggagaccagagtcaagcctggaggtcagttcagtcatcaggcagtggaggcagaaagtggggcagtgttttgcaggtgtttcatgatgacttacttgaaccagtgacctctaaagatagagcagagcgcaaggaatgatctaggaagagtgaaggggataggcaagagctggtggctttggagcagaaccatgttccctgtcctgggtcctttaagtttcctttccttctgcagagggcaggtgaggaccatgtggatctttccagaaatacatgtggacatttgcaaatgcagaactgactggtggaaagggtgggaatgaactgctggaaatctggtcctcatggaccatatgtgtttgatggatatgagacaaatttggagaaaagttttgcaagtagtttctttcattggatattctactctctgatcccctgggttcgactactctagggacctcatgtaaatggattccagagtgaatatgagaagagactgctggttgccaggagctgggagtggggagaatcagaagttgttcatgggtgtgcagtttccgttatacaagttggggagtttctagagatctgctgtagagcttgatgcgtattgttcacacagattatttcttatgcataagacttaggacaaaaagtgttttggatttctgacattttttgattctgaaatatttgtcatatacttactggtttagcatcccaaatctgaaagattcaaaatctaaaatgcttcagtgagaatttcttttcagcatcagattagtagacaaaagtgggaagtgataagccaaatatattcttgcccttttttttctctcaccacatttctagcttggtgattagttttcggtgaattccatactggccatgctgcactcatatatatttgaaggctttgggatgtgagaaaggctgattgctattttctatgtcatcaaaactttccaccttttcatggttgcatctttttcacagtgtttctgttgtggcagtcattaataagtgcctgtcaggtcagatttaggacagagttttctaattctgcaaaaaatgttactgggattctagtaggggttgcattgaatctgcaactcactttgggtagtattgtctttctaacaatattgattcttccagtccatgaaaatgaagtgtctttccatataatgatattgtctttaatttctttcagcaatgttttgtagttttcaaggtataatcatttgacctttttggttaaacttattccaaaatattttattccttttcatgttaatgtgaattgaaattctttccttaatttcctttcagattgttcattgttagtgtatagtctaaagaatgatctagaaagagtgaaggggacaggcaaatgctggtggttttggagcagaaacatattccctgtcctgggtttttgattttccctctccctttgcagagggcaggtggctcttccctgatagctagatagacttccctggaaaacatagtgccaatgctccagggatccacttaccagggactatgatcctcttgattatgagatttgttccaccagtggctgagttatggatgaaacagacatagacccctctatatgttttagtgatttggggtatgaagaacacttgtgctgattgctggaacttcccaccaatcagccaagaatgctctgccagtgggtgagtgtctatgagacaggagagcttggggacttcccctgtatggtaataggtgtatgaggaagaaatggtgagggcatccaggccatctggagcaaagagaataaagtcacaggtgacattgtcagagggaagggaaaatcctggtctgtggaagggccacagtgaccctgtgagccaagtcgcaagactgaagtcccagccaaatcctcgctgtgttcactgatctggagcctgagacattcacctgtttctcccatcacaatctgtggaccctgagcctcccatgacaggagcagcctcttttctcccactgtggatcaagcctaggcctactgtggtttgtctggggcagaaagtcatggccagctttgatgtccagtggtaaaggtctctgtacttggacctgagagggactgagaggcctggcctctggccatgtgtatttgggatggcagcctggctcacagaggaacagaagatactcacggaggagattcagggtgactgggtcactgcggctggcactccctgagttccatatttcacattcatagggtcctgcagtatactttgtgacaccaaatagaaagagggtcctgttggtttcagacagctgcatcctatgagtcatagggaggctctgaccattcatccaccacaggtagcttgcgtccggagtctcaggattacaggttaagatcacagtctccatggcctccctggggtttaagttgctgctggagatggagggcttgggagtctccactgtgcagaaaacagagagaagattgccctgtgtggcacctttgattcctccaaaggcatttttcaatcagaattggcatttgccacctctcagcccacccgagtccctaaaagcccatggcaggtgtgtgtgttacaacacagatgcatggcattctgaaggctaagagattgtgaggctgcctgctttatgtgggagaagcacagactttctcaggtgtgaattgagcagcagcattgggtcatggaaagacacaggaccagcagtcatagcccctggtgcctctctgagtccctccatctccaactgcctgcctggcccaccttttggtcctgacttggagcatgcagtgctggaatcttcttagtttcagtcttacttttccccccaaggtatgttttctctgcagcttcccttgccaaggacatcctagagatggatgatggaacttcccattgtccttaaaccctttgggtactggaaagcctggcctgggactgggtacttcagcagaaataacacaggggagaccagagtcaagcctggaggtcagttcagtcatcaggcagtgcagccacaaggtggggcagttttcccaggtgtctcatagtgactgacttgagccagtgacctctaaagatagagcagagtccaaggaatgacctacaaagagtgaaggggacaggcaagagctgatagctttgaaccaagaccatgttccctgttgtgggtctatgatgctcccttcccccagtagagggcaggtgaggaccatgtggatctttctggaaatacatgtggatgtttgcaaatgcagaactgactggtggaaagggcaaacatgaactgatgatggaagtctggccctcatggaccatatgtgtttggtagatattagaccaatatttgggaagaagtcttgcagatactttctctcattagacattctaccctctgattctgagtttgactactctatgtacctgatatcagtggattccagagtgaatcagagtgtagaatagtagtttccaggagctgggatcaggggaattgggtgttgttccgtgggtgtgcggtttcagttatgcaggacgaggaggttctagagatctcctgtacagattcatgcctatagttcatacagataaagtgcttcttatgcagaaaggttaaaacaaagtgttttggaattctaattttttttattttggaatatttgcagtacatgtactggtttagcatcccaaatctgaaaaatttaaaatccacaatgcgccagtgagcacttctttttagcatcacatcagtggtcagaagtgtaaagttttggagcatttcagattgtggatttctggatttgggatgctccatatttaatactgtaattatcccataaaaagttgtcaggagattagacctcatgttgtgttctgactctagtaacaaaaaaaaaatttggaggaaacattaaaatgttttcataagtggaaatttttactgatggtctaaacatctaagatcaattgctggtagtagtatttctcttgagaccaacataaggtttaggtgtgccatgaattccagcaggatcacattatgctcaaagaaagatgccaaaggtgatttgaaattagcagctccttaagtagagagagtcccgttaaaaggacagaactggtcagtgcatcaattacataaaaggaggaaggatgccaaattaaaagaagtgatgtgtgttatgttagtaaatatagaaagaacttcctgcttctaatttctgtgcagttaggaaaaatggggaggaccccaaaacaggtatgtgaaatgctttcttcattttctgttaagctcaggaaacaccactagagtttaagtttgtgtgaattagaaggagtctaagtgagatgccaatggctcatgtgtctccccacacgaagaactccaacttatgaaaacggcatcatcatgaggaaacagttgtatgtggcacaggcagtaaaaccatcagatagcacccacctggccacctccaactagtccccaaaaccaccagtattcctcttaagtatgtgttacagcctttgtagttgtcccacagctacaaaattttaaaaatgctattgtcaaaacaaaatattaaatatgaagttgaatatgttgatccactttttttccctactctttttggactttcctgtttcagttttggaaatttctattgacacatcctcaagctagggattccttcctcagctgtgtgcagtctaccagtaagcatcaaaagaattcttcatttctcttacagcatttttattttttctgagagagactcttgctctgccaggctggagtgcagtggcatgatctcagctcactgcaagctccacctcccgggttcacaccattctcctgcctcgacctcccaagtagctggtactacaggtgcccaccaccatgcccagctaattttttgtatttttagcacagatgggctttaaccatgttagccaggatggtctccatctcctgaccttgtgcctgccccagtctcccaaagtgctgcgattataggcatcagccactgtgcccagccatctcaaagggattttaatgagttgttgacttttgagtttgttcagctttttacttagtgttagaaccgagtgacaaatttcaagcttgtcatatgcctgacacgaagccagaagtctctaggaagtgatcagagaatgtaagctccatagcacgttgacgatggagtcatgagtgaaacaggtgaaatgagctcatgggctttggagactgcaggcctgtccagcctctgacaccctggtgagtcagtgcagagattacaacagtgacagcaaactagcatggctgactccatctggcatctagtctcaggctggctgtcctcactcattcctgcacatagacaaggctaaccttgggagaaatttagtttatggtttaactttgaagcaagaatgataatagttcctccataaaactaacacccttactttgcccagggactgcctttgtcaaactagtgaaagaccatgagatttagattataagagggaactgaattctgctaaaatgtatgcacagtttctataatccctgactgctgcaatgtcatttggcaagggtttacaaaatttgtaactaattgctcctatagataacatcactattgtagaacgtgagattggtcttttgagatgcttctcattcttttgcattctggcaaccagctgacctcatccatacctatgactaatggctcagcccgtcatgtggtccctacctagaggcagattcaagcacaaacagatcatttccctccgcccgcatgattccatcaccaacaatcagcagtactcattttttagtcctgtgcccctgaaactatccttgaaaatctctaagccctgatccactggggaggctgatttcagtaataataaacctctgtcctcctgtttggcagacttggagtcattaaaatctttctttactaaaaatcaccatttcaataaatttgtgtgtttgtgtgtgtgtgtgcaggaggccagaagaacttgtctgacaatgataagagtggttggagggacttcctatccctgtcccatggtcttgtccacaggtcagcctcacaaaggggaagagcccttgatgggaatacagtggaagctcattctcttagtgacctggggacattggctcgagatgaagcctggcaggagtggcaactccaggtgatttctgcacctttcctatttcctgggaggtgggccaggccacagtgttagcgggaagggaatagaacagccagcctagttagagggagtgtctggggaaggcctaggggtgggggaagaagctgtgcaggacagggcttgccagtcagaatgaagtgggaggaagatgagggacacagagaagcagagagaggcagagacaccatggcagtgagcagtgagggagacactgacttcagagcccccaggaaccagctgcccccagttccacagtccaggaccaaggagccccgagaaccctctggtggccaaagagcttcagagttacatgaggtggggtggctttaggggcaagaggtagtggggggatgaaacatgggtgtcagcctctgaaggacaagggacaggtgtggctagaacctcctaggattctgcattcaagatccagtctctaaagaggttttggatcattcatttcttcattccattccttcatttgttatgtgagagctcctgagtgtgtgtctctcgctgggcctgtgctggtgtagggagtgagtggggaaagaaaacaaggtcctctccttgatcctctcatgacagtgacatggacactttgggaaacacagagtttcaggttcagtgatgggggttaagatctgagggggaggcctggacattttttttgcactgactttgatggttgaagcaggtgatttagttctggagtatagactaatcagctgaccatttgctctcactcctctgaggtttggatgcctaagaagagaggatttgagccaataaatgactatggggtgcttggaacccagtaagccctcacttctggtggaggagaggatgggcctgtggctgcagacagacctcatgtgaccctgatctcccctttgcgtttgtgtgactctgattcagtgactgtgccttcctgtgcctcagttttctctcaatcagataagttaaatggcaaatggactgtggcttttcatgctatctgtgaataaatgttaaattattcacagtcacctgacctaatgcttggcacagtggaggtgttcacacaagcagcatttattattaatttgcttccatgagaaagcacctttacgtcagatccctgtggacaagctgctaccaggtacatcttctctcttctgtttctgcttctgaggacattagactttctatggactgtcctaagcctcctaaggcagttggctgatgacctacaaagcttgtctttctgtcctctccactctgagtgtcaggtgaagaaagctctgtccttgcccagatgaggctctgagggctgagccctggctggtgaacagctccaggagacacagtcctcagacagctggtaaattcttggtcccagtaagccctgcccaagaagccacaacccagccctggaacaggctcctcagctttatctggaacaaggatttaggtacagagttctgggtttgaggcttctagggctgagcttctctgagagtatctcaggggcccctcaggtcaaattctactcagttctccagggtctttctcagggtcaaatttatgaagagggcatgaggtgcttggctgagactgatctcctcctgctgagtccccccatcagactgtccttcctctgcagcgagtgtctgcagggtctggatgcgggaaaggaattctgatctgttgaaatttgtctcctctgtgtgtgtcctgcactaaatgcccaaaccccagcatgggacataatgcagagagggacacaggcaatgtccaggcctgacaatcctgtgtgtgtgatgtagaagtgacccctgtcccccaacacccagggatcatgtggaatcacttacggtataaggtgaaggtgaaatatccagttactcctctagtcccatcacctcgctttatgatgtgtaaggtgtaggatcctgcgtcctcccgggtgacattctggatcagcagggatgcattggaatatactgtttctcgtccactgtatgccggtccatatataattatttgaccgtctactacatatgatgtaatgtaatggtagaggtccctgatttgccctttgtaccagatgtagccagtaagattctggggcaaattgtggacaagtagaagaacatccttcccctcggacactttgggtggctgggcttcaatcatgacttgggcagtggtaggcaagttccagaagtttaaaagtaatgctaggaggtggagagagcatcagtcaatattgagacctatgtattggggtgaaaagatggggccctgagtcctgagaaggtctcttcaatcctcagccttgaagacacacacacacacacacacacacatacaaacatacacacacagaaaaggggcatgtgtgtttgtgtatgtgtatgtgtgtgtgttctactgtcctactaggtcaaggtcagcagcatgacccccattccttcaacacttctgaccttggcatttttctgtttggaatcctcttccccaggggtccgcatggccccctccacactgccctcaggtcctgctcacatcagggcatccttagacttctttcctgacacctccttcagggactctgggtcttccctttctgacctttccctgctctgctccctccagggttcttgtcaacacctgacctcacattctagatctctttgcatgtctgacttcctccccatggcagcatgagctccgtgaggacagggacttttgtgatcttggttgcaccccagtgcctggaacaggctgcagactcctgtagatgtgagagttctcagggccgtccacgccctgggtgtttttttttttttccccaattgttgaggttttttattgaggacagtgtttcatgccctgtttatttttatttgtagtgtcatctgatatagttattattatcatttttcaaaatgtggtggcccctgatgattaatcaggaaaacagaacacctgtttcctacctcttaccaattccggttcaatgtgactttcctgttttgacccctgtccctcttgggtgtattttcccctatccaggcatcaacagggccttctttcctttttttttttttttttctctttttttttttttttttttttttgagatggagtctcgtactgtcacccagcctggcgtgcagtggcactatctcagctcactgcaacttccgccaccctggttcacgtgattctcctgccttggcctcctgagtagctaggattacaggagcacaccaccatacctggttaattttttgtacttttagaagagacagggcttcactctgttggctggactgatcttgaactcctgatctcgtgatccacccacctcagcctccctaaatgctggcttttttattttttagaaccccaggagcctctccaggagaccccatccagtcactctgcttcctcctcctgtcctctcccaggaagttctctcctcacctgtgagcaggagccccttccatttgatgtgctctgtgcagggaggggctgagaggggccccatgatctctgctgcgtgcatgttctcctctgtggagatgagcctaggatccagaagcttccagagcacggctgtcagctgtgctgtccttcctccttctgcgctgagactcttcccggtggaaggagcacttctcaagctcatgggcagggtcaggccgaggacacctctctgtcccctcctctctcagccctgcctccttgtccctccttctgtttttccttttgtctgtgtttcaggtccctgggaattgtggaggcctctgcctttttcagcagtgattctttcaccaaacctcaatacacactttgtgcggacacacacatacacacacacacagaagagacacacacagacccacacagtcagacacataccctgcaggttgggcaagcagagtcctgggcctcagcctcctgctgtccccattgctcttggtcggggtgcacattcacaccctttgccctctttcatccccgtctggctctccccttcagtgcaggaggctggagctgcaccaggtccctgtcagagtgacaccccattgtgctgtgggtgagctgtgtgttgcctggtgagagggacccttcttttctccaatcgtgtctagcttggctgcagcttccaaggatggacattgaggacctgggtttcccagaggaaactgtccttcctggaggtgtgcagggtgaatctttcatgcctcctgggaggagaggcctgtgctggttgctcagtgggggctgtgagtcccatagtcaaagggaaagttctcggtcactctgtgactccatggggtctggcagctgagctggagctcttggtttctcatgttcttcctgacaatctttgatgtcctttcttctctgccgagctgattgtcctgtggtcaccacaccttccccgtggtggtgcaggaggaagtggggagttacccaggaatcccgcgggacatgacttattgagacgcaggaggaggagcctgggacagagcaggggttcagagctggagagattcatcccgacttactccgtggccatgatgggctcagccctccatgtgctgagatacccaggggtctgtcctgagggttttgacctggccaagctgctgtgtgtagaggaggaacaggcagtggccagagatcctgtctggagggacgtagctcacacctgagagggcgggtgggggtgagttgtgttctgggagcaaagagcaataacaccccccttctccccgcaagcacacgggagacgtctgtcttcccaagagacagctgggggtaggtggccacatcccggatggtgcctgtgtgtgaccatcacacgcgctctgagccctccggggttcagtgagcaggcaggtcacagggtgcctggctgattcccggtgaggctgtgggccctcaggcagccgctattctgtgtcagcgctaagcttggcctgggatgccccagtgaacaggacagatggagcaggggtgggcatttagggagcagtgacagaaagagttgatgttgatggagggaggtcacgaggggaaagcgcccagtgtggcatcgcgtgcaccagcgctgccctgggagatgcctttagctgggcccagggaaggagcaggtgtgtggggcaggaactacctgtagggggagtggtgttaggttggtggcccccaggtcagggaggagctgacagagaccctgtggggagcatggagggcgctgaggacttagtccgaagtgaccctggtgagggtggaccctgctgggctgtgggttccgctgagggcggttggcatcccttgggaagactccaggccgggagggactctgtcgccttctggtggacagggagggaagtgtgaacggcagcaatcccaggccaggctgcatgttttattctacgtggatctgcacacttcacacaaggtcacacatatgttatgttatagctccttcaccttccagccccgtgagtcccagtctgtgtggctctacgttcactgttctccctctttcacgatcagatatcccaaacgcagatgtttgtcactttctgtgagtttgtgtttgtgtgcagtaggcggcactgtgtataccctgggggcagtgatgtctggggctgagcgctgcacttgggcttgggagaagaagacggagcagcagggtgggaagatcaatgtcaggggggcagggacatcattttcattttctcccagggaccagaacccacgattttgactccagggcacagtaccacaccctgctggtgtccctggatgtcatgatgctcatagtgtcatgttgccttggcattcattttttaagttgtaagtttatttgcctcaaatcagaggcagggcttggtcaccatggcagttttcaatactgtatctggttcaggtggctccagttggtgtccagagataaaatcttagaggcatctctcctgcttggtgtgctggactcccctctctccagctgctttctttaaactgataattctgacattcgccctcatatttaaagtgaccacctctcagtcacagcgtgagctcctggtcccagtgtttgctgctttctttgaacacatccattaaagctccctgctggaaatctgtcatataacaccctggacttaataaagccattggcttaccagtctcttctctcctccctgcctgggctcactgaactctgtgtctgcggtctccaggtgtgccgagtgctccctagtgtctgtaagtagtaaaaatactgacattttcactttgtggttgtatcattgtagcctcacatgccatccagaggctgacattgaggctgccctatgggacctgtgctggttgagcctctgctggagctcttgttttggggcctctggtactcctggggacaggagcttccaggtaacttgattgaaaaactcatgcctttcattgaaacactgggtcagatgatgtattcatgggcttcagctgccataacaaatgccttagcctgggtgaattacataacagaaatctatttttcacagttctgtgaataatgtgctattctaaccactttaagatgcacaatcaagtgaaattaaccacatacacagtgttaaattaccatcaccactatttttcctagaaaatttttatcactttaaactgaaactttgtatctttcaaacaatacctccctgtatgttccaccctagactttgatcatctctactctgtctctatgaatttgcctattcttgatgtttcatataaatggaattatacaatgatgttattttgtttctgacatatttcacttagcataatgtttccatagtccatgcatgttccagtgggtgtcagagcttcattcctctttatggcagattaacattctgttgtatgtgtcaccatatttatttattcatgcattgatgagcacttggattgttttcatatttaatcttttgtgaataatgctgcaatcaacactatcatgcaagtacctgtttgagtcctggatttaattctttgggtatatacctaggaatggatgttgtttcaaatgagaattatatgattagctttttgaggaacagcaaaactgtttctcctagaggctgtacctttttatattctcacgagcaatatatgaggattccaaattctacataatactgctacttgttatttaacattttaaaagaatggtaaccagttttgtagatgtgatgtggtgtctcattgcagctttgactttgtgttttcctgatgactaatgatgttgagtatcttttcatgtccttcttgactctttgtatatcttctttgaagaaatgtctatttgactcttttgcccatttataaattggatgatttgtcctttctttattgagttgtagctagttctttatattatctgaacatgaaaactgcctatatgtggtttgcaaatattttctctcattctgtgtctattaattactttcttgataatttcctttgatgtacaaaatgctcacatcttgataaagcccaatatatcttgtttttcttctttctcatgcttttgtatcatatctaagaatccattgcacatttgaggtcatcaatatttacctctatgtctactttgagatgtttttatggttataggtcttatatttaactcactgatcaattttttagggaattgtttgatacggtgtgaggtagagttatctaaattcactgttttgcatgtggttatctagttgtttctgcactatcattagaaaggagaattgttcctccattaagttgtcttgacactctcttcaaagactaattgaccataagtgtgagggtttgcttctagactctcaattctatcccatttgtctttatgttcattcttttgccagcagcttgttttaataattgtactcctttgtgagatttcaaataagaaagttcaagtcctacaatttattttggcaagattcttttggctattcagggatccttttttgaaaggtggggaggcgaatgtttcaccattgggaaagccttttctgtcttcttcatggggaaatttgggagagccttttaaaaaactttatctaagtaggtaaactgtcaccactttatttgctgaagtgctatgttaaagtgtgccttgcctcttgtggaagaattgtgagaccctggaagcacttgcccacgtggtgagagacagtgagttccacgatgaggggcagagaggacattgttttgggatacaatgttgttgggggaggtgtatacatctcaacttctttatgtctctgtgcagtgggtgtagggagcagccccacagggtcggtgggtttttctccccatgtgcagagatgagagattgtagaaacaaagacacaagacaaagagataaaagaaaagacaactgggcccgggggaccactaccaccaagacgcggagaccggtagtggccccaaatgccaggctgtggtgatatttattggatacaagacaaagtgtcaggataaggagtgtgagccatctccaattataggtaaggtcacatgggtcacatgtccactggacagggggcccttccctgcctggcagccaaggcagagagagaaagaagaaagagagagagagcttacagcattatttctgcttattacagacttttagtactttcactaatttgctactgctaactaaacggcagaggcaagtgtacaggatggaacatgaaggcggactaggagcgtgaccactgaagcacagcatcatagggagatggtgaggcctctggataactgcaggtggacctgagtaatgtcaggccctccacaagaggtggaggggtagagtcttctctaaactcccccagggaaagggagactccctttcccagtctgctaagtagtgggtgtgtttccttgacactgaggctaccactagaccaaggtctgcttggcaacaggcatcttcccagattctggcgttacctctagaccaaggagccctctagtgcccctgtctgggcataacagaaggctcgcactcttgtcttctggtcacttctcactgtgtctcctcagctcctatctctgtatggcctggcttttcctaggttatgattacagagtgatgattactctaatgttggaataaaaagtaattcctaccaactaatgattaatgatattcacatataatcatatctaagatctgtatctggtataactattcttttatattttatgatactggaacagctcatgccctgagtctcttgcctcagcacctgggtggcttgccgcccacaagtgggcacctccattggacacagtaggttttgaaatccttgtttatcctctggggtctgggtcttggcttacctgttagctgcagctgaaagaggtgtctgctaaggcaatgacacctgtggggagaagaagggttcagcagagtgaaagcagctggggctcagaaaagccaggaaagtctgactcttagaaactgtgggttagcagatgggtgtcctcaggggtaaatgggccatgccagtagccactgcagtggactggaagaaggtaagtgatgctgggtatcccatgttctgtctcagctctgcagctgaagatttgggccctatgctggtacggccctgcagcaggggaagggtacacaggaatggctgcatatcaggaccaagtccatgtcatcttcttaggcattgttactgcagatggaggattctgttcagagacctggcctggacacatgggagggcccaccccattcttttaaaattattttaagagaacagtattagcaaatgtggtacatgttttattctgctagaatcagcattactgtcacgttttacaacgtatctcttaggaaatcatgagagccatccacacaatgtggatttaaaggggactctactataatttcagctttcctactctttatagaaaccatcttctctgcaaacacacaggcaatatctctgtgttcatttctattgggagccctgtatgcaaggtggagagagccacatttccccgtgagatgttatgtaaaagtttgaggttgagatgacatatctgacactctgttgttaccctcagaagctactacatgtgaaattctaatgactgcattatcctgccaaatgaaagaggcatgcatgagcaaggacagttaagaggggcgagagcctcatcatgatggggagtcttattttgacatcttggggagaactgtccacagtgtgaagtcatcaacttgttgtcctggtttacagtttgagcatctgttgttatgctgtccaacattttggtgagttctgagtggctcacacttcaggtacaagaattttcccatgaaatttacattgagttgtcctcctcccacttatagggcttctggaacagagtgggtcttggtcttagtgattccatgggagaaaatggaattggaggaactagtagaattcagggtaatgtccagtctacaggtgaataataaaaacacagaaacaatgaacagagctgcaatctcataaccggtatactacagtttttattttccacataatttttctctctatgggcatctctagttttaccaatgataatttcagtagaataagtttgtttgcaaaataagttgagtttcttcaaacatagtctgattctttacataagtgcagcaagagtagcaatgagccagataggctctcttttaaaattttctttgctctaagtttttataaggaatctgagattagacttttacaaacctcttgagaataggaagccaaaccaaggctgacttcagactttgcctgcagttcatattggttcattctaaatatattcttaaatataacaacccagtcaaagccttggtaatataacaaatgatttcaaatatgtcctgttaaaaatagagcagattgttactgtacttgtgcaaatatgtgtattaccttaaacatatcaacactcatgaatagttgcccaattctggggcagtcagctagacagcaaaagtaagtgtttcaattattgttcccagaagtatagtttattgaactgctataagctatagatagattaaaaaaattccatgaatctagaaaataaaacatttaaagaatcagcaaattttcaaataaaaatcttaaaaacattatcctcattatgatcaattatttcaatgaaatcaatgtttttcctgcttggtaggcttagaattttctgaagatatcagcctgtttgttaaaggtttgtaagttcttagacagtccagtggtataatctgaaagttatcagaaacttgtattaaagtctacttgtcagcatcttttccataaatctccttgaaaaggaagcaattttggactgtagctgattggaaatgctttgaggaagaataaaaacaacgtgtgtgaatgacaaagattttaaatgactatggttaaaactctgatgagaattcattatgataacacagctcacataaaaagttcgttacttctgtggtacatgacattatggctgataacataattaatttctaggaatctcatacaatttctggaacaatcatatcagtaacatatccataaatataacatagagaaggtttagcttcctttactacttatgatttgaaaatgcttttcagataattttacatgtcaaataaagtggcttttccatgtagcttgtgtttctcaacaggattattgagtacttggtggaggacattaatgaatagggccaagaaagtataggcttatgtatgctgaaaaatttccctagataattccaatactcccagctaataatcatgaaattaggtctaagttttacctattagaacagctgttctttatcctggttacacattagtagcatctaggaagacttaaaaattaccaatgtctgagtctcactttagaccattaaattggatcctatgggtggggcttgggcatccatttaaaaaaacgttttccagtgattccaatgtgtagctgtatttcccctcagatttctctgatttcttttggcattcacttttttctattttggtattataattatttttctggtcttatcatctatcttaggctttatgttccttggggtagaaaccttgcttcttcgtttctgtatctttcatgaacgtatgagagggtcatcaggaaaatgttttcagtcacatgtaggttgtgttctgagtctcaggttttcacattaatgctggagtcattgttctctgggaggtcagaggttgcttgtgatgaagggtatgggtaagcccataatgcagatggtagatgggagatcaccctgtttttagccatagcactggaactaagcattctatgtgtatatcaggtggaggggaagggatgtgtagaaagagagatttagttacaatggggaattactctagggaatagaggtaatggaagcaatacaaattagtaaagagaagaaatgtgaacttatcaaataggcaagagtagatccctgaagatttttgaataggggagttaactagaatttaggaaggtaataaggcagtcatacacaaggaaggtttcaaaaactggagataagtcaagcagtacctctagcagttgttgaggttgtgggaatggagagaatgacacaagtgagagatgttaaaaaaaggatcaagagggtgttataaggtattgaatctgggagacaaatgagcagaggctgaggataatcatttgtaggagacagtggggtacagggagcatgaagaacaggggagaagagacctgcaggaatgagtgctgagaagcaggagtttagtgggaggaggaggagatccagtcccagatatgggcaaagaagtcctttccctctcccaagcatggcagtcagccctgcaggaaacaggacaaaaggaaaggccatcatacctgctagtcttcctgaaataaactacaccagggctggtagatcagagccacactggccagtactccaatcatgatgctgacagtggctctacctgaaaggccaggacaacttcctttcactgaagtatctgtcatggaaagaaaagaagagaaggaataaaggtgatgttattttacagtgtggtaccttaggaaccatcactaagtatgaagtagtttctacttgttcctttggggattacattaattttgtgggagggttgctggtagatgattagccaactatattcttgcagattttttctctctcaatgtgtttctaggttagtgatcagtcttctgtcaatttcatcctgaccttgctcactcagatatttttgaaacctttatgatgtgagaaaggctgactgctattttctgtgtcattagaactttctacccttccatggttgcatctttttctcagtgtgtcagttgtggtaggcatgaataagactctgtcaggtctccatggcagcttgtgtttctcaagaggattactgagttcttggtggagcacattaatgaatagggccgagaaagtataggcttatgtatgttgaaaaatgtccctaggtaattccagcactcccagctaaaaattgattaattaataatcaattgacttgattgacagaaggcccagatcagtgcatcccaaaatgacaacctactttacatagagtcctcactttcctgaagctcccagcagggaaatgaaagcaagcccagttctatgagcctctgttttattctcctgggtgactggtgggaagactccccatcagtcttctcatgctctgtttgaactgtagctaaatcttctttctcttttgccttcacaggaatcagatttgcctagtggtcccaaagctccccaggcttttttcatgcctgccccactttccctcacaggcatttttcctaatacattatcctgcatgtctaatctcatcttggatgcatctcagtgggcataaactaacataccaggtttgatttttttgcacttagcttttttctctctctcccacatgtagccagtaaccatgtcctagtgttttatgtgttacctcttttttcatgtgtatagaaaaaaatgtatatttccatatacttatttatacataatatatataataaaatatgtaatataaaatgtataataatttaaaacatatacatattttctatatatgtatatggaaaaagaggtaacacatgaaaaaccaggacatttacatataataaaattgacatatgttatatatgtatgtagtgtctggtagtcttaccctctctataaatacacaatttttgtcactgccccttccttccttcccatgcacagctcccatggccaaatgtccctatttctcaaagtgtgtgtcactcactgtcgtctgtgctgtgtcccatgtgctgtgtccacagcctcctagtgttttatgtgttctctttttctatatatatggaaaaagcatatacatatttctctctatagatttatatacaatatataataatctaaaaatatagaataacaatttaaaatatgtacatatttccatatctatgaaaaaaggtaacacataaacactaggccatttatatataaaatccacatatgtaatataaatgccaattttatcatatataaataagtatatacaagatacacttaacatatataaggtaaatttggaatgccctgaccagggccctctgtcagtcaagtccctgccatggaggccattcatggctgccacaactgagacactgagagaaagatgcaactatgaaaaggtgaaaagttctaaagtcatagaaaatagcaatcagcctttctcacatcccaaaaccttcaaaaatatctgagtgcagcatgtccaagatggaattaaaaacttcaatcttcaaaaggaaaaaggtagctggaggactcacactttcagatttcagcatctactgcaaagctacagtaatcaatacagtgtggtactggcataaaggaggacatagaaatgaatgacagggaatagagagcccagaaaaaaagcttgcatatatggccaaatgatttttgtcaagagtgccaagaccattccatggggaaaggacagtctttttaacaagtgatactgggaaagctggctatccatggacaagtatgagttgaacctttacctcacaccatatacaaaaaaatgaacccacaatggatcaaagacctaaatggaatagtgaagactaccagactcttagaagaaaacataaggaaaaagcttcatgatattgaatttcagaatgatttattagttacaactacaaaagcataggcaacaaaaaagggattaattgggcttcatgaaaattataaatatttatatgtcaaaggccattatcaagaatgtaaaaaggcaaactatgacatagggaaaatatctgcaaatcatatatctgataagggattaatttccagaatacatgaagaacactacaaatcaaaaacagcaaaaacacaaaagcccaattaaaaaatggacaaaggactaaaatagagattttattaaagaagatatacaaatggccaatgaggacatgcaaggattctcaatattactaatatttagagatatgcaaagcaaaaccagagtgatacacgacctcacacacattaggatggctttgataaaaacaacatgaacaacaacatcacgaaacaagtgttttcaagtacgtggaaaaattgaagctctttgagtattgctgatgggaatgggaaatgttatagccattgtagaaaaagtggcatggcacggccggctcatgcctgtaatcccagcactttgggagccgagatgggtggatctcttgaggtcaggagtttgagaacagcccggcaggcatggtgaaaccccatctctactaaaaatgcaaaaattagctgggtatggtggcatgtgcctgtaatcccagctactcaggatgctgaggcatgagaatcacttgaacctgggacgtggaggttgcagtgagccaagattgcaccattgcactccagtctgggtgacagagcaagatcctgtctcaacatcatcaacagaaaagaaaacggtatgtcagtttcttaaaaaaattaaagcattaccacttaaaccagcaattctacttctggacatacagccaaaagtattgaaaaatatttgaacagatatttgtacactgatgttcacagcagcattattcacaatagccaatgggtggaaacaaccgaaaagtctattgaaagataagtggatgaacaaaaacatatatccatactttggaatgttcttcaatcttagcaagggataaaattttgacacatggtgcaaaatggatgaaccgtgaagacattatgcgaagtgaaataagccagacacaaaaggataattattatatacttccatttatgtaagatagttagaatagtcagttacttagagacagaaattagaatggtgattaccaggggttaaggggagaaggaatgagagttatcatttattgggttcagaggtttagtatagtaggataaaaacagctctggaaatagatagtgttgatagtaacacaacagtaaattgcactcttagaaacagttaatagtaagtcttagatacatagtgtctggtactcttaccctctctgtaagtacacactttttgtcactgttccttccctgccatagagagcttctgtgagttaatctccctatttctccaagtgtgcatcactcactgtcctctgtgctgtgttccaggagctgtgtccacaaactcagacaggcagtgacttcagagccaggacacagccctattcccattttttaaagccttacccatgggaggcttggcttctactggccgctcgatttagccagattcagaacaggccacccaggcaccttatccacatgccctagtcccagcccgggtggagtcagggcagggtcggtcacttggcgagcccacagcaatgcagggagcagagtctgggctgcttctccctcaacaaggggcttcctcctctcatttgggaaaagggtgggcttgttttgaagactctgatgttcatcgcagctcatggagtacacacacacagacacagacacacacaaaggagacagaagggatgttttggtgacagaaacagcttgaccatgaggaccctcctctttctccctccatgaaggcccttatactgcatagtgcttggggctgataaagccatttccctacatttctcaggctggacccaaggtcatccaccagaaatttggaaaacaaagggaagagaatctgtagatatgaattgggagtgttcaggagaaaaatttgggatttacttttgtgcatgggacacaggctgagaataagaatgttttcctggctctttcttggaaagccagataggcttcacctgaaagcgtattgccaatgctccagcgattcacttaccagggactgtgattttcttggttgcgaagtttttgccattagtgactgggttatggacataacacagatagtccccactattctctgtagtgactagggggataaagagctcttgtcctgtttgctggttattcccattcagcagccaagaatactctgctgatgggttagagcccatgaggcaggagaggttgaggtttgaccctggatagtaataggtgtctgaagaataagttgtgggttcatctgggccatctggagcaaagagaataatgccacaggtaatgttatcagagggaatgggaagctcctggtctgtgaaagggacacaatgttcctttttgccaagtcacaaccccgaagtcccagccaaacttcctctgtgttcactgaactggaggagtctaagacattcacctgtttctcccatcacaagtgtggaacctgagtctcctaagaccagagaagctcctcccttcctgggcctacccaggtttgcctggggcaggaagtcatggccagcttgggggtccaggggtaagtgtcttcatacttggacctgagagggactgagaggcctggcctcgagttatgtggatttgggctggcagccttgtccatgaaggaaaagaggatactcacagagaacatccaggtgactgggtcaatttggctggtactcactacattcttgctttgacattcatagagtcctgtgtcactccgagtagagcaaggaccctgttgtcattggacatctgcagcctggaaatgactgtgagtctatgaccatttacccaccacatgtagattgtgccatgaatctcaggttcacaggttaagaccacagcctcctcatcctccacggggttgctggcaacatagggcttgagcagatttgctgtgcagataacagagaagattcccctgtgtggcaccgttgatttctccatgagcattttccaatcagagttgacatctcccacctctcagccaatccaagtccttaaaagcccacagcaggactgtgtgtcaaaagacagatggatgcatgattatctgagggctcagagaccacggggccacctgctctgtgtgggagatgcacagacttctgaagtgtgactcgagcagcaatattggtgaagtgtgaattgagcagggtcaaacaattagagtttgattaactttgtttaaattgagcagagtccaagtgaggcagcagtggctcatgcatctccccacccgaaggacctcaccttatgacaatgttgttattatgaatacacaggtgtgcaagaaacaggcagtaaatcaggcagcacccacctggccagctccacctggtcctaggaaccaccagtattcccattatgtgtatgttacagctttttaggctacaaaatataaaatacaatcacagaatataaaatatgctattgtcaacacaaaatattgaatatgaagctgaatatgttgttccactttttctcactcttgttaaactttgctgattcagttttggaagtttctattgacacacacttaagctagagattctttcctcagctgtgtgcagcctaccagtaagcccatggagagcattctttatttctcttaaagtgtttttaatctctagtatttcatttgcttctttcttagaatagtcatctctgtttaaatcacccatccattcctgaaaggtgtctcctttttccatcataatccttaaccagagttgttttaaatttccagtctgataatttcagcatccctaccacatctgtgtctggttctgatccttgctctgtctttcaaactgcattttttttttttttgccatagtctgtcttgtatttttttgaaaaccacacatgatgtactgtgtaaaagggacttgagtgagcaggcattcagtgacatggtggtgagtgtggggagggaagtgttctgtggttctggatgaggtctgtgtcctgggctgtgaatgtcacaagtgcctctcaggtttttctttccattaggtgggatatgatgacttgaggctggagttggatatttcccctccccctggccagttaagctcccatcaaaccccagctaattcggctgcagtaaaatagtttctcttaaatgtaggtcttaccaagaagaacataattcactgacaactttccaagtgtttttttcccttcttcctacaagaaggatgtggattctttttgaatattgactgtgagaacctggtagagctccaggagctaagagtcataaaactgtccccctactcccaggactaatccatccactgttgtgtttatctctgcgctgtgtccacactgagcctccagaatttcctcaattagagttcaggttttctgaccccagcactggttcccgctggggtttctgtgcctgtgtttctgctcaggtacggtgcgctgctctgtatttgcctgtgggtctctccaatatgtgggccagttagcactgagatcttgcttcctgagaaatctaaacgagttgttgatttttcagtttgttcagctttttacttgttgttagaactgcgtgaaaatttttaagctacttacatgcctgatggaaattcgaagtctctagggcatgacaggaggatatgagccccacagcaggttgaggagggagtcatgagtgaaatgggtgaaatgagcccgtgggctttggaaactgcagatctgtccttctgcctctgaccccctggtgagtccatgtagaaagtgaaaccaccattgcaaagcatatgatggagagaggaagctagcttggctgcccgcatctcacctctagcctcaaactggctctcttctctgattcctgggcataggccagggtaagcatgggaggaatttatagtttaactttgaagcaaggatgataatagtccctccctaaaattagctcctccttgtcgggggctaccttggtaaatctaagaaaagaccatgaattatgggaggggcccaaattctgctaaaatgcaggcatagtttctataatcccttactgctcaggagtcatgtgtccagaggtcacaagatttgtgactttcctagttgctcctatagatagcaagactactgtagaatctgagatttatcttttgagatgtttctcagacttttgcattctggcaaccagctgacctcatctagactcatgaccaatggctcaaccagtcatgtagtccccactcagaggcagattcaacaaatacataccattttcctacctgcatcatttcatctccagccagtcaacagtacttattccttagacctttgccccttcaaagtttttgaaaaaatctaacctctgagccattggggaagctgatttgagtcatgataaacttctgtcctcctgtttggcagccttgggctaagtaaaactattctttactacacatcaccttcacaataaattggctttgcctgtgcagagggcaagaacctgtcaggtgattgtaagaatggatggaggagtcactgatctctttcaggtggcctgtttcatgagtcagcctctcagagagaaagagccctggtctgggacacagtggaagctcattctcctgttggcccggggacattgcctcattatggatcctggcaggggtggctactctggctgattttggtgcatttttcatttcccagaaggcaggacaggcctcagtgtgagcaggaaggaaatggaaccatcagtcttgttagagaggatgtctggggaagtcctcagggtggaggaagctgtgcaggacagggttcatcaggtagaatgaaagggggatgcacttttttcactgaacacctttcagatgtctcactaactctggcctcactgggctctgcctttccttctgagccctgagccctgagctctgagccctgattcctgggagggagggagggaggaagggtgaagctgggatgtgtgctgtccaggtttcttccatctctggaatcttgaaagcgagggaccctaatgtgttaccacagaggagaccatgggaaaaagctgtttctcaggggtgcctggcttatgaattgaggggaattcagaccaggttggactcgtgaactgcagggaccctgttccatgtcagcaaccagctcctctagctcagtgtttctctctgtggctaattcttttgtgtgatttctgagcccatgctagagtcctcctcacgatgcctgatggtcagacctgtgtggggagacctaatgatggggtgggggtggtcttgtgtgtcacacagagtgtccagggaacacactttgtgactttctctaccccagccccacaacaagatctggatagtgggcttggtcagataaagtcagaatccatgggggagggtatgtgtcctggcagtgctgaggttcgtacctccagcttagttctcagtctctgcaaatacatttatgttgtgcatgtgctgttttctggactgtacttcttgaacctgtctgcagataatgtcatgagagatctgcatggaagtatatgagggctatcagattagggtgggtgtgttttacatagtgggtttttttttcaccaaacacttttcaaaaaattgtggttgagtgtgtatatagaaacacatacatacttatatttgttagatgtgtatatacgtatatgtgtatatatgtgtgtgtgtgtgtgtgtgtgtgtgtgtgtgtgtatatatatatatataaaatgtgccattttaaccgcttcacttaaggggagagagagagagagagaagagagtttctactaataccaaatctgggttaaataagggtggtcctatttcctggggttggccctcttccttaatgggctgtatcttgagcacagtgattcagttgaagaacagagaccaaattaaaagctacattgctaaagaaacaacaggtgctggagaagatgtggagaaataggaacacttttacactgttggtgggattgtaaactagttcaaccattgtggaagtcagtgtggcgattcctcagggatctagaactagaaataccatttgacccagccatcccattactgggtatatagccaaaggattataaatcaagctgctataaagacacttgcacacgtatgtttattgtggcagtattcacaataacaaagacttggaggcaacccaaatgtccaacaatgatagactggattaagaaaatgtggcatatatacaccatggaacacttatgcagccataaaaaatgatgagttcatgtcctttgtagggacatggatgaagctggaaaccattattctcagcaaactatcgcaaggacaaaaaatcaaacaccacatgttctcactcataggtgggagttgaacggtgagaacacatggacacaggaaggggaacattacacaccagggcctgttgtggggtgggaggaggggaaagggatagcattaggagatatacctaatgttaaatgacgggttaatgggtgcagcacaccaacatggcacatgtatacgtatgtaactaacctgcacattgcctgcatgtaccctaaaacttaaagtctaataaaaaataaataaataaaaccccatggtgaatttctattatttttgtgttaccttggcatctttttaatcttccttgaacataccaaattttttcttgaaaaagattaagttctctctctctctctttgctttgagatgtaaatgtgctatgtgttttctctaaaactcagtaaagccttcctcaggtaagcgttaacctttaccatttacaagaaagcaatttgaatccaactatcttttaaaatggtgggttttaccgatctcatgcctaaagccctaaaatcaaaattctaaaatctttttgtctctctctatctttatatgaacatacataagttatatgttttatcacatacatgtatatgtcacacatttatatactgttgacacatagtatcaaattaatgtaaaaataaatgagtactcagaaattaagtgaataagcccaaatgcttttctatacatgcgattttagtaaactttggtgaatatagttttaaaattgttggtaaaataaagtaagaatgtcttcataatttaatttatacgtttttgcctatgtctgttggcaggcaggtttatattgtctttactagatgttttaaggtcagcaaacacttgtttccatatatatacattttcttaatttgtctgtgagcttatgtctttatatttgaagctttaaattctgagttctagataagtgaccatagtaagaactggggacaaaacccatcccatcctccagctgtgccttttagccatgctgggagagatgagattatccaggcattttcttcatagctctgttctttgtcttgggctttgcatctggtacatagttagaacggtttactccctagttttttttctactgaaaataaggctgtttaagtctgtttttacattgctacagacaaatacatgaacccgaataatttataaagaaaaaaggttgaatggtctcatgattcagcaggttgtagagtaagcatgattctgacatctgctcagcttttgaggaggcctcagaaaacttacaatcacggagaaagccaatggtggaggaagacatcttatataatgggagctggaggaagagaacaagggttgcacactggtaaacaaccagataaaactcactgttgctataacagcaccaaggaaaatggtattaaaatatgagaaagcacctccatgatccaatcacatccaaccaggctccacctccaactttggagattacaatttgacatgagatttgggtggggataaaggtgcaaaaaaatattattctccccatcgtccctcccaaatctcatgtctttctcacattgaataatataagaatggcttcccaacagtctctagagtcttaactcattccagcattaactcaaaagtccgaaatagcaagtttcatctgagacaaggcaagttccctttacctatgagcctgtaaattcaaacacaagttagttactttcaagacacaatggaagtataggcattgggtaaatactcccattccaaagggaagaaataggccaaaggaaataggatacaggtcccatgaaagtctgaaaccttgcagcacagtctttaaaacttaaagctccaaaataatctcctttgaccccatatctcatattcagggcacactgatgtaaggcttaggcttccaaggttctgggcatcacaggaacattccaagagagtcacaaaagaatttgtagtgaggcttttgatgctaaagagcatattagaccgagtaagtcactgaagaaaaaaaagtcagaggagaagatgggtgagggtgacagaaatggaatggtgaaaggaaagttctgataaaaatgtttacctgctggacatggtggctcatgcctgtaatcccagcactttgggaggccgaggtgtgcagatcatgaggtcaggagtttgagaccagcctgaccaacatggtgaaaccccatctctactaaaaatacaaaaattagccaggcatggtggcatggacctgtaatcccagctactcaggaggctgaaggcaggagaatcacttgaacttgggatgcggaggttgcagtgagctgaaatcgcagcattgcactccagcctgggtgacacagtgagtctccatcacaaaaagaaaaaaaaactttacccaagggctcatctggtaccttgctctgtgactaatatcttacacattttgatttactcttccactttcattttctgatgcgcaaagggtcacccttctgctgaagatgagaaaagaggctgagggagctcaaatgagtggtctagagtcatccagctacttcatagagcttgtgtgtttcaccttgacatttgtgcacagacagaaaagtgagacaaagaaggaaggcaaagcaagtttttgttgtgggtgacatttatgaaagttacctgtgttggcagaataacggactcctaaaatgtttgcaacctagctctagaacctgtgcatttacttttctttgtaaaaacacggtgcaggggtgataaaattaaaatcgtaagatgtggacgttgttctagattatctgggtgggcccattgtaatcagaagtgtccttgtaagtgacaaagaaaagcaggggcatcagtctgagaatgatgagcctgtgaaactccactggccaatgctgggtgtgagcatgcatcaaaagacaaaattacaactaatgtagttatagattttattttttgtttattatttgaggcagctcttactctacaaatatagtgatagcacttcctgggctatacaataacaaaacagtgggttttgtcaagtgggaactggtaaacaaagccatataaataaataaatcagttaacattagggtacttcaggtcgcttttctgtaaaagttaaagcagaggaaacttttattatgctgtctcaggtagagtggaatctcctgttttcaacaaaaaacaaaggtctgttctggtatctctttgcttcattaaaatttcagttgtagactgtagcatttagcatgagtggttctattttggagtctctaggctctcacttaggtgggagtgtgaccaaaatttaaagcattggcattcatctcagtaaccatcatattgggcttccatcgtttataggtttatgatgtcttcctgatcacacatttctttgagtttttgtcatttcagccaaagagagaccctttggtatttgtagatggctgcacacaaaactttttaaaaacttttgtagaattcaccacaccaaaatgtagaattaaaaaacctgtagaatttatcacaccagagatgctactagtatgactattggaaggataacaccaaaagtttggagtatgcactttaggcaagatgcaaaccaactaaaatagaatagatcaaagaatgagccagaagagtctagcaattttaaccaagtagtatgtttggtaacttctgtgattgagtcattattatactcaatatatttgtttatgtgcaacagttggtgtcagaatctgcacaggctcctccctgttcagctggtagggaacaattttattatgtagcattcgacggctcattaaattaaaacagggaatgagaacaatgagtctgaaaatgtaactttaaaagcgccactgtacatttgaacaaacaattgtgttaaatatgctgctaatgtcagccgttgggtggactaaatgatatcttatgtaaaaatttgagggtgacatgatatatctgtcactctattacgctgctctcagaaactacttcatgtgaaattctgatgataccatcatcctgccaagtgaaagaggcaggcataagcatggacaaattaagaggggtaagagcctgattttgatgtggaaacgtgttctgacaacttgagaaaagcttttcacagtgtgaagttgtcaacttcttatcctggttttcaacttgagtgtctgtagttatggtgtcaaacatattggtgagctctgagtgactcatacttcagatacgagggttttcccgtgaaatttaccttgagctttccacctccagcttataaggcttcaggaacagagcagattttattcttactgattcaataagagaaaactggatgggaggaactagaagaattcagggtctagtccagactaccggtgaaaaataaaaactcaaaaacaataaacagagcagcaatttcatagcaggtatactacactttttattttcaacattattttgctctctataggcatatctatttttaccaaagataaacccagtaggacaaatttgtttacaaagtaggtttagtcttaccaagctttgccaggattctttacataagtgcatcaagagtagcaatggaccacagaggctcttcctaaagtttgcttcgctagaaatttttataagtagtctcagattaaatttttacaaacctctggagacgaggaagccaaatgtaggccatcttcagactttgcctgcagtacatatgtgtccattctatgtatattctcaaatataacttctcagtcaaaccttggtaatataaccaatgttttgaaacgtgtccttttataaagagagaagactcttactaaacttgtgcaaataactgtattagcataaacatatgaatactcatgaatagtttcccaatcctgggacagttaggtaaagagcaaaaataaatgggcttcaattattgcttccaaaagtatactttaccaaattgctttagatatagctagcttaaaagaaggaaaattccataaatctggaaaaaatcatttaaagaatcagcaaattttcaaataaaaattataaaaacattatccactttatcatttatttcaaggaaattatttttgttctgcttggtctaggttggcatatttcatgaaggcatcaacctgtttgttaaagttttggaagtctatagacagttcagtgatataatcttgaactgctcagaaacttgtatgcaagagtacttgtcagcatcttttccataaatcttttgaaatagaagcaattttgaactgtagctgattgcagatgctttcaggaagaatcaaaacaactatctgtgaatgaccatcatgtaaaatgactattgttaaaactctgataaagagcccgcatcgccaagtcaatcctaagccaaaagaacaaagctggaggtatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctgatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccactgtggaagtcagtgtggcgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatgtcacatgtatacatatgtaactaacctgcacatggtgcacatgtaccctaaaacttagagtataataaaaaaaataaaaataaaaaaaaaaagatgaaaaaaaaaaaaaaaaaaaaaaactctgataagagtttggtataataaagagagtaactccagccagtactccagtcatgatgctggcagtggccccaactgagagaccaaaagaactttcttgtcctgaagcagctgtcatggaaaaaaaaagaggagaaggaataaataataaagacagcaagggttttagccaattattttttgagatagggtctcactctgttgcctaggctggagtgcagtggtgcaatctcagctcactgcaacctgtgcctcccagtctcaagcagtcctcccacctcgctctcctgagtagttgggactataggcacacaccaccacacatgcttaatttttgtattttttgtagagatggggttttaccatgttgttgagggtggttttgaactcctggactcaagttatccacccgccttggcttcccaaagtgcagggattacaggtatgagccaccgctcctcccggtttcatgctttttataataagaatcaactctttatgtaataataaataaataaacagaaattatttgctttagatgtagcatatgtagatttagattgtccagagtcaggagctaagcctcatatttttttttttttgttttagctcagtgtagagtgcattgaaggtgttgtaaaaataattccatatagtaagccaactttaaaccctgctcacagccagatctgccaagtatgagccaggtaaaattaccaaaaacggtggttctgactgactccttaacaataacgtggcttacaaacaaagactgatatgaaatagttgatccaacccaaacactttgctcatttcccaaaattttctatacaaatatatacaacttaccacaacataaagatcataatgaaagatttgccttttattcctttaaatgaccatatgttcagatctgatgtactgacagcaataattctccattaagcagaaaactaataaaatttgaaaaatagtgattttatatttagatgatactcagatcttctgctacatatgtggaaaatggaattattgctagaaacattgtttaaagattagggtatgaaaggagtattaggaagtcaggtggttctttccttaggaagcagcttatctggattcattcaaagagctttaggtgagtttgaggtctttctgcaaaatgtaaattgctatctgagaaaccatatatagtccaatgatgaaagaatgcaaagccttagaagcaccggagacaattccagtatcttccctaaagttctgacaaaaaggaaaataactatcaaattattcaactcgaatgcttattatgtatgtataagtcagtcgtcagatgaagagaggctggaaatatgacttctacccctagggaactcacagtcttgtgggggccactaggggtggtggtgtgacctgcctggagcagggctaagtatggacttgtgagtcaagggctatcaaaacctaagtgaactgatggccgttcagagaaggtagagttccattccacagtttgcaagaaggacaatttcatggaggaggccacgttggactagacctttaaaagttggtagaatttaaaagcaaggatatggaagcaggaagagtgaaagtgagcagaggtacaggagtgaggcaagggtgagcagtgttaattttttaatggtggtattataaaacacacatcaaaatttgccatattattattattattattttggagacagtgtctggctctgttgcccaggctggagtgcagtagctcaatcatggctcactgtagcctccacctcctgggctcaagcaatcctcgtacctcagcctcctgagtagctgggaccacaaacatataccaccacgcccaactaatttttatatttttgggagtgacaagatcttcctatgttgcccaggctggtctcgaactcctggactcaaataatcctcctgccttaaccccaaagtgctgggactacaggtatgagccactgcacctgaccccatcttaaaaatttttaagtgcacagttgagaaatacatttgcattgtgcaaccatcagcgccacccatattcagagagtatttttcatcttgtaacagggaaaattcatatccatgaaacactaactcctcattcttcctcctccccaccccaggtaacaactatttcagtgtctctatgattttgactgctctagggacttacataaatgagatcatacactgtgtatctttttgtgactggcttatttcacttagcataatgtcctcaaggttcatccatgttgtaatatatgtgagaatttttttccttttgaaggctgaataatatttcattgtatggatagaccacattttgtttatccattcatctatccatggacacttgggttgccttcactttttggctactgtaaatagtgctgctataaacatggaggtaccaatatctgttggggtctctgttttcaattattttgagtttatgcccaggagtggaatggccaagtcatgcagtatctctaattttagttttctgaggaaccaccataatgtttttcacagtggctgcaccattttaattcttatgaatagggcacaagggttccaatttttccacagtctcattaacacttattattttctgggatttttgctttgcgtttgagagtagccatttaaattggcataaggtataatttcattgtggtttacattttcatttccttaatgattagtgatattgatcaatattttctatgcttgctggccatttgtatatcttctttggagaaatgtttatgcaggtcatctgcttatttttttaaattgggttgattttttttttttgctgttgtttaggtagagaaagcaatctttggataccagtgatgtttcactaattctgggccattgatttcacaagttgtatgaggtattagtatgtgagtttggtttcaatcatggctgaggttgaatgccttttccaaaattcagtgtgaatttcaccagaagccagaaagggtccaggagcaagaacatggtgtgactgctctgtgctaaagaatttcagcctgatgacagtgagcaggctacacatgagactgacacaagaacaggtggagagggagactttccactggaagaaggtgattctaacatgcagaatcaccttcaaggagcaagtaagcagaaaaatagacaatggcacagtggccaggcaagaagacactaggtccagaatctgaggttcaaatcctggctctgtgagataaaaacatgccttggtttccccatgctactgaaacaccaggggttgggtctaggtcccattgctcactgcacagaaagccaaccactgagacaatgagcattgccagggaagaaggctttatttgggtgctgcagccaaggaggtgggagatcagtcttaaattcatctctccagcccactcaaattggagggtttatatagctgggaagggaggtaactactagcagggaaaacagcaattaaggaggggtaaggaagcaatcatgataaatgaggagtctggtgtctcattgtctgatagtgatgtggtgagtttcagtctcttgcctgaaggtcggtttcctaactcagatgactgacaaatgttaagtttcaagttataagaccggatgggtcaatttctatgtttattcaaaaaccctgtaaatatcagttctatgtggaacttgagctggtttccccccagttatcacagttagggttaaatgatgcaatataagtaaaacaccagcagtttctgacacacacacacagagtgtgtgtcatttttttattacactttttattacacttttcattctgggatacatttgcagaacctgcaggtttgttacataggtatacaagtgccatggtgttttgctgcacccattaacccatcatgtacattaggtatttctcctaatgctgtccctcccctagtcccccacccctcaacaggccccagtgtgtgatgttcccctccctgtgcccatgtgttctcattgttcaactcccacttatgagtgagaacatgcagtgtttggttttctgttcctgtgttagtttgctgagaatgatggtttccagcttcattcatgtccctgcaaaggacatgaactcatccttttttatggctgcattgaattccatggtgtatatgtaccacattttctttattcagtctatcattgataggcatttgggttggttccaagtctttgctattgtgaatagtgctgcaataaacatatgtgtgtgtgtctttatagtagaatgatctataatctttgggtatatacccagtaatgggatcactgggtcaaatgatatttcttgttctagatccttgaggaatcgccacactgtctttcacaatggttgaattaatttacattcccaccaacagtgtaaaagcattcctatttctccacatcatctccagcatctgttgtttcctgaccttttaatgttcaccattctaactagcatgagacggtatgtcattgtggttttcatttgcatttctctaatgaccagtgatgatgagcttttttttgtatgtttgttggtcacaaaaatgtcctattttgagaagtgtctgttcatgtgcttcacccactttttgatgggcttttttttttcttgtaaatttgtttaagtttcttgtagattttggatattagccttttgtcagatggatagattaaaccttgcaagctgaaactcaatgacttatgtaaacttctggagaaatcatagcaacttatatataaacaacctttgtggctgctgatgtgtggactatacaaaaggtacacatgaacactggattcagactgcaattcagagaaatgtgtcagattgccattgcaattggaagatacttcacaaactctggaaaacctagtctatagggttagaacgatgtttgccaaacgaattgctctaattgaagcagcagttgtgtgactttaataaggttccaggattatactgtcccttttttgctgtgacttccctttgcccttttctgatttgtcttcatccccttttccatgcatgacttcttaagaatgagccttcctagtgatgtaggatcagatgaaacttacagtcacaaagtcatgtcttctacaatgctttctctgaaagcttttgaagaattggggggccaggtgtgctggcagaggcctgtaatcccagcactttgagactctaaggcaggaggatcacttgaaaccaggagtttaagaccagcctgagcaagaaagggagaccacgtctctacaaaacataaaataaatcaaattagccaggtgcagttgtgcatgcctatagtctcagatacttgggaggctaaggctggaggaccgcttcagcccaggagttcaaggctgtagtgagtacactccagtctgcgtgagtgagcaaggttgtgtctctaaaagaaaaaaaaaaaaaggaaaggaaaagaacggggtaaacaggaaagccaaagatctcgggcatctccagatgattgtctgaacaaattgttttttcttggcttcaaaacctttcaagatgtatatttctttgtaaaagaaagacatgccaattgtaactttaagtgagcaatcaaaatctaggtcctaaaactgaagtattttaactctcattctgataatatttattttctgaggcaaagaagaaagacaacgttagatcaattgtttctctgcccactccatctcttccaacctgccttctcccctttaatcaaatgtataaatactaagcctcctgaaacgtcttcagagaaaacacaagccacagaggttttttgcaactcatatattcccagggtgcactgtcaggctctggctcaataaaactcaattggtcaagacccttgcctcagtcaatcattctggataaccaccatgagtcctgcaaagcccttcagtaatctattgcctgcttaggtgatgtgtacctagatgagtcagatcttcatgagtccaacactcgtcttccttttctgtctttcccaaccctaccactcagtgctgtgtgctctgatctgaccccagctcccaggttgtttgtattggtctaagaaagcaagaccaggaggggcaggttgagaaggaagtaagaggccaactgccagggaaagtggcaggtagggctgtcattgctcaacgccacacacactgggtccattttgtgaaattttctggattcataatcttttccctgtgtgtctatcaagaatctcaccctcctccaactttcttctcattacactttctgtttctagtgcactcgtttatgtccagagaatggccatgcaaatagttgacaatagaataaaaaatgacgatttgtcagacttagaagctggcctttcttttttccaaaagagattgaggtttctaaaagctggcttttatgcagggctgtgcagttgtgagtgtagttttagggaacaggtgcataagtgaagggtgagacagaaaacaaaattctggctatttgtcaaatcctgaaagtgaatgggacaaaaatcatttttgaaggaggatgtcattcaggagaccttgtaaatcttagagtgtcctcttaccagatgaagtggaggatgaggttgaattatggagttaggtgacagtgggtacatacttctctgcctcagttttttttttaatctgtaaaaatggggattgtggtacttgggattttttggtgaggactgtagtttcctggaaagctctcaggatagtacctggtacatagtgagtgctgcatcagtgtgagctattataattatgggaatagacaaaggtgccaccctggccatccagagtggggaggtattttccagtcagggtccaggcaggccagctgtagatgaagctgattagtggggaagcttaacttccaggagtggaagaatttaggaggagtaaacagaatgcacaacattctgcaaacattcctttacccaacagtaggaatactcagagttggcgtggattccgtggcaatcattatctcctgggaatctaagaatgtgtcctagagtcaaatggctttgatgtaagccaaacccagaaatgggcttcagggctgccttgcacatagcattcattcatcttgaaaaaggaaagcattcatcttgctaaaggaatcccctcttctggcccaggccattatttttgtttttgtactctcctaatttttaaggtgtaaggagaaagaccgaagaataaaataatggagtacatgtatgaaatgacagggtagaattgagactgctacatgtaagttaagagaaattgtgtataaattttgtgtgagcataagaaggatttcttgttgcaaacagacctctccatataaataatacccattgcctttagtggatagcagaccgcatcagaagaacattccaacagagtcatgagacaatgggtagtgtggcttctttaattggcaggttagactgagtaagttactgaagagaaaggagttgaaggagaagatgggtgagggcaagaaaaatgggaaggtgaaaggaaaggactgaaaggaatgtttaccaagggctcatcaggtaccaggctctgtgactaatgtcttacacatgttaatttactcttccactgtcattttctgatgcagtaagagtcagccttatactgcagatgaggaaagaggctgagggaggtcaaatgagtggcccagggtcatccagccacttcatagcagagctagtgtgcttcactgtggtttgtgcagacagaaaagtgagacgtggaaggaaggcaaaacatttttgttgtgggtgatgtttatgaaagtgacccatatgaggcagaataatggcctcttaaaaatgtccacatccaggccgggtgcaggggcacatgcctgtaatcctagcactttgggaggctgatacgggtggatcacaaggtcaggagttcgagaccatcctggccaacatggtgaaaccacatttctactaaaaatgcaaaaattagctgggcgtggcggtgggcaactgtaatgccagctacttgggaggctgaggcaggagaatcatttgaacctgggaggcggagattgcagtgagcccagattgtgccactgcactccagctggggcaacatgagtgaaactgtctcaaaaaaaaaaaaaaaaatccacatcctaactcttggaacacatgcatttacttttcttggcaaaaacactgttcaaaggtgatgaagttgagtatcttgagaaggaaagcttattctgacttatctgggtggctcccagtgtcatcataagggtccttgtaagtgaaagagaaaggcaggagggtcagggtgagaatgatgcagcctgagagactccactggccattacttcctgtgaacatgtgtgataagacaaaattacaactaatttagttattgatgtaattggcttttatttttgatttatgatttggggcagctctccctctacagatgcttcagcatcccaagtagctgggactatattgcgggatctggccagcagcttgcaatgcaacagggctctttctttgttcccaggcagatcggcaggttgagaaataaaagacacacacaagatagtgaaaactgggtccagaggggtcactgccttctggtcctgcgatgctaccaatgcactggatataccagcatttattattaagtttagtgagagtgttggtaggttagtgagggatttaaggtcatttgtaagctgtccacaagggtcgcattccattcccagagctatggacatctgcttttctgggataggaatcttggttatgtgaaacctccctgactgcatgtccattcataggctctctgcaggcggaagcacatcacatgctgttggctcattctggcagcccaacctggcatttgtctttacacaatcctgtatgcaattttgtatttacaataatcaggagcatttcatcttttattccatagcaatagtttcagggggtctccctacatctcccccttttctctgatttcaatgaaccatagcaatcataggttggcactgatcacgattggattgaagaatattttttccaattttacacacgaacagtaaaccaatagcacaaattatacacagaacaaaattaacgatagtggatcctcccaaagattttacctattgaaaggggttgagattagataacccctcagagatactgtctaaaacttcagcactaggtaaagcagataagtgtgcttgagaggcttcaaaaatctgttctttcagcttgtttatgtctaaacttaaattatcttcacttccttgtaaatggcattttactgattcccaattgtgaaaagactctttatattggaacggagttatacaaaaatcagaagtattccaatcacgttgcatttgtaatctgtgttctaaactcataattctatctcccatccatataacagaagcacatcacgcgctgtaggctcattctggcagcccaacctggcattgtctttacacaatcctgcatgcaattttgtatttacaataatcaggagcatttcatcttttattctgtagcaatagtttcagggggtctccctacaggactacaggtgcgcgccaccatgccctgctaatttttgtatttttagtagagacagggtttcaccatattgaccaggctgatctcaaactcctgaccttgtgatctgcctgccttgtcctcccaaaatgctgggattacagatgtgagccacagcgcccagcccataaatcacacatttctttgagtttttgtaattccagcccaagagaaaccatttgatatttgaagaatggctgcacaccaataaaaacatctgtagattgcaccacacgagggagactaccagtatgactatcaggaggaaaatatcaagagtttggaatatgcaccttaggcaagatgcaaaccaactgcaataggatagatcaaggaagaagccagaagagtctagtcattttaaccaggcagcacatttcatgatttttacagctgagtctctataaaacccgatgtatttatccatgtgcaacaagaagggtgagaaactgcacaggctcccccctgttcagctgatagagagcaattctattatctagcattgcatgtgtatgttaaattaaaacagggagtgagaataggcaagtatagaagtggaagcctaaaaaaatctccatacatttgaggaaaaagttgtgttacaggtgcagctaacgtcagcctttgggtggattaaaggatctctcggtatgtaaaaatgggtgggctgggtgtggtggctcacgcctgtaatcgcagcactttgggaggctgaggcgtgcggataacctgaggtcggagttcaagaccagcctgaccaacatggagaaaccctgtctctactgaaaatacaaaattagctgggcgtggtggtgcatgcctgtaatcccagctacttgggaggctgaagcaggagaagcacttgaacccaggaggcagaggttgccgtgagccaggattgtgccgttgcactccagcatgggcaacaagagcgaaactccatcttataaaaaaaaaaaaaagtatggttgacatgatatacctgacactgttaacttactctcagaagctacttcttgtgaaatcctaagtacagcattattctgggaagcaaaggagacaggcataagcaaggacaaattaagagaggtaagagtctcatcatgattgatagtcttgttctgacatcttgagaaaagctgtccacagtgtaaagtcatcaacttgtcgtggtttgcagtttgagtgtctctaagttatggtgttgaacatgtggtgagctcttagtggcccccacctcagacacgagggttttcccatgaaatttacattgagttgtccacctccaccttatatggcttcaggaacagagccactcttgttcttaatgatttcattggagaaaattgaattggaagaactaaaagaattcagggtccagtccagtctaccagtggattataaatactcaaagataatgaacagtggttcaatctggtaacaggtgtactacagtttttcttttcaacatagtttttctctctataggagtctctatttttaccaaagataattccagtaggatgaatttgtttgcaaatttggttgagtctcaccgaacttgcccagattttttacctaagtgcggcaagagtagcaatggactgtagaggccatttttaaactttgctttgctagaagtttttaataagaatctcagattaaacttccaaaaacctcttgagactaggaagccaaaccaaggcccacttcagactttgcctgcattccctatgggtttattctatgtatattctcaaatataacatcccagtcaaagccttgataatataatcaatgttttcaaatgtgtcctgttataaagagagcagattcttactgaacttgtgcaaatagctttattaccataaacatatgaatactcatgaatagattcccaattctggggcactcagatagagagcaaaaggaaatgtttcaatttttgtttacaaaagtatactttaccaattgctcaagaaaaaatgttcataaatctggagaatgaaacattccaagaatcagcacattttcaaatagaaaattatgaaatcattatccttttgattatttagtccaataacattgagtatttttcttctttgtcttgaatttcatgaaggtatcagcctgttcattaaaattttgaaagttcttagtccagtggtatgatcttgaagttatcaggagcttgtattcaagagtccttgtaagagacctttccataaatctccttgaagaaaaagcaattttggactgtaggtgattgtaagtagtttgaggaagaatcaaagcaactgtctgggaatgacagagatttaaactgactatggttaaaaatctaatgagaatttattatggtaaagacacagctcacatagaaatctagttacttctgtggcatatgacactatgataacatatttgattttcagaaatttcatataatttttagaatactcattaaaaaaatttttttttcagatggagtctcactctgtcacccagactggagtgcagtggtgccatctgagttcactgcaagctccgcctccgcggttcatgccattctcctgcctcagcctcctgagtagctgggactacaggtgcctgccaccacacccggctaattttgtttttgcatttttagtagagatggggtttcaccgtgttaaccaggatggtctcgatctcctgacctcgtgatctacccacctcggcctcccaaactcctgggattgcaggcgtgagccatcgcgctcagcctagaatactcatattattaacattcccataaatattatttagagaaggtttagcatcacttatcccttatttgaaaatgctttctataaatttaatatataaaataaggtggcttttccgttcagcttctgtttctcaagaggattactgagttcttggtgtagcccattcataaatagggccaaaaatgtatagtcttatgtatgttgaaaaaggtccttaggtaattccagtacttttagctgaaaatcattgatttagttttaagttctacctattgcaacaggagttctccatccttgttacgtgttagtagtgtcagggaagacttaaaaattaccagtgcctgggtccctctccagacctttgaactggaactaatgggtggggcttgagcatccacttttagaaatgttttccagtgattccaatgtgtagctctatttcccatcagatttctctgatttcttgtggcattcaattttttctattttggtatcatgattattttcaggtctcatttcctgtcttaggctttatgtctcctggggtagggaccttgccttcttcatttctgtatgttttttgaacacatgaactgatcatcaggaaaagatctcaaccacacataggttgtgttctgagtctcaggttcacatgttaatcctaaagtctttgttctccacgaggtcacatgttgcttgtgatgaagggtgtggttaagtctgcagtgcagatggttgaagggatttcactctgtttttagacatagcattggaactaagaattttatgtctatatgggtgaaggggcagggatgtgtaggaagacagttctaattaggatggaggatttatactaggaagtagaggtaaaggaagtgagaagccttagtaaatagaagaaatgtgaacttatcaaataggctagagtagacccctgcagattcttgattaaatcaattaaccagattttagaaaggtaatgaggcaatcatatgcaaggaagatttcaaagtctggagacaagaagtcaagcaatactttgagaagtggttgagctttatgggaatggagagaattacactattgagagatgttaaaaataatgaagagggtttcaccatgtgaaattgtgtttctcatttgaatctgagaaacaaatgagcagaggctggagataattatgtctaaaagacagtggggtacagggagcataaaggccagggagaaagggaactgcaggaattagtgctgagaagcaggagtttagtggaggaaggaggagatgcagtcccagatacaggcaaataagtcttttccctctcccaagcatggcagtcagctctgcaggaaccaggataagagaaaaggccatcatacctgccagtcttcctgaaatacagaaatgacatcacagctgctatgttggattaaggagaggaagaagtcctattcttgtagaagctgtcatggaaagaaaagtaaagaaggaatgaaggtgatgttattttacatgggggagcatcaggaacaagcatgtaacatgaggtactctataattgtttcttcaaggaccacattatttctcttggaatattgatgggagatgattatattcttgcagttttttttccctctcaccatgtgtctcggttggtgatcagtcctctgtcaattctctactgcactcagatattttggaaggctttcagatgtgagaaaggctgattgctattttctatgtcattagaacttgccacattttcaccttttcatggttgcatctttttctcggtgtttctgttgtggcagtcatgaatgagactctgtcaggtctccatggcagggacctgattggcagaaggcccaggtcagtgcatttcaaattcaccacctcttgtgcacagaaagcttctttcctacaggctcccagcaagggtgtgaaagcaagcctagttctccgaggctctctttaactctaatgggtgactggttggaggattcctcatcagccttgcaaaaactcttagaactgcattggtacctaaaacttctttctctttgtttttcataggaatcagctctgcatagtggtctgtgggttctcccatactaccttcatgcctgccccacattccctcacagatgtcttccctgataaattatcttgtatgtctaatcccatcttggatgcatctcagttggtaaatactaacataccaggcttgattctttgcccttagctttttttctttctctcccacaagcagtcagtaaccatgtcctagtgttttatgtgttacctctttttccatatatatatatatggaaaaaggtagatactgttgaggggcacttgctatgtgccaggccctgtgctaaatacttccctgtatctcatttaatccacacaataaccctgtcaggtagacattatttccattttggcaatgaaaagacagaagcttagcgtggtgtaaaaactttcctggtgtcatatggctagtgacagggggatctgagatttcattctaggactatttgacctcaaggttgatgatgatgatagtaatatagtagctgacattggttcctctgtgtgtggcatcttgtttcattgactgcattaaatctttaaaagaatggtatgaagaaagcactgtcattgcaatattcaggtaaggaatcagaggttcagagaagttgagtcttgtgcaagaaatttataactgtaaactcttacattaaaaaagaagaaagatctcagatcaacaacctactttaatacttcaggatatgaaagaagaacaaactaaacccaagcacagtgaatgagggaaataataaggattagagtggacataaataaaatggagaacggaaacagaatagaggaaattactgaaaccaaaagttgattcttcaaaataaaatcaacaaaattgacaaccattaactagattgactaagaaaaaaagagaaaagtttaaaattcctaaaatcagaaatgaaaatggactctgagcatggtgggtcatgttttaatcctagcactttgggaggtcacagcagaaggatttcttgagaccaggtgtttggaccagcataggtaacctggggagacgctgtgtgtacaaaaaaataaaaaaccaattagctgggcatgttgacatgcacctgtagtcctagcatcttgagaggctgaagaaggagaattgcttgagcccaggaggttgaggctgcagtgagccataatcacacaactgtattccatcctgggctggcctacagagtgacagcctgtctctctcttttcaacaaaaaaaaaaaaaagaaagaaagaaagaaagaaagaaaaatgaagcgattactaccaattctaataaaataatgattatgaaagtactataaataattgtatgccaataaattggataacctagatgaaatagacaaactcctagaaacacacaaaaatatgaataaaactataatcactaataagattgaatcaataaaagcatttgatgaaattccatattttttcataagaaaaacattgtaagaatggaaggaaaccacttcaacataaaggcaatatgtgaaaaacccaatggtaacatcatacttaacggagaaagactgaaagctttccctgtatgagcaggaataagacaaggatgcccacttttgacacttttattcaacatagtgttgaaaggtctagtcagaaaaattaggcaagaatttaaaaaaagacattcaaattggaaggaaggagtaaaattatttctgtttatagataacttgaacttatatgtagaaaatcctaaaggtggaacaaacctattagaattaataaataaattcagtaacgttgcacaatagaaaatcagcattcaaacgtcagttgtatttcaatacactaaccatgaacagtctgaagggaaattaggaaaaaaatttcaatttatattaacatcaaaaagaataaaatatttaggaataagtttaaccaaagaggtgaaatgattatacctgaaatctacaaaatatggctgaaagaaatgaaagatgacatcaataaattgaaggacattttgttttcatgaattggaagactcaatattgttaggaggacagtgctacccaaagtgagctgcggattcaatacaattcctatcaatcagaatctcagtgacatttttgcagaaaaacaaaaatctgtcctaaaatttatattgcatctcatgactaaatagacacagagctttgaggaggaagaatgaagctggaggactcacactttctgatttcagcatttactacaaagccccagtaatcaatacagtgtggtactggcataaaggaggacatagaaattaatgaagtataatagcccagaaagaaattcttgcatatatggccaaatgattttcatcgagtgtgccaagatcattcaatggggaagggacagtgttctcaccaaatgatattgggaaagctggatattcaagggcaagaaaactagaacctttacataacaccatgtacaaaaatcaacccataatagatcaaagatctaaatgtaagagcaaaaactgtacaactcttagaagaaaagcttcatgatgctggatttcacaatgatttcctggttgtaacaacaaaagcataggcaacaaataaaacggataaatcggacttcataaaaatcaaaaccttttacatatcgaagaacattatcaagaaagtaaaaaggcaacccatgaaatgataaaaatatttgcaaattatatgtgtgataagaaattaatttccagaatacatgaaaagctacaagtcaacaacagcaaacatccgaaaacccaattaaaaaatgaacaaaagattaaaatggagttttctccaaggaggttacacaaatatccagtaagcccatgcaaagttcctcagcatcatgaatacttagagatgtgcaaatcaaaaccacaatgttacaccacctcacacactttaggatggctttgataaacaacaacaatgacagcaacacaaaacaacaggtgttttcaagcagatggaaaaattggagctctagtgcattgctgatgggaatgggaaatgttatagccactgtaaaaattggtgtgctgtttctcaaaaaattaaacaataaattaccgtttgatccagcaattccacttctggacatactccccatagaattgaaagaaatttgaacaaatatttgtgcactgatgttcagagaagcattactcacactagcgaaaaaatggaaacaaccaaaaagtccattgaaagataagtgggtaggcaaatgaggtgtgtctatacgttgaaatgttattcaaccttaacaaggaataaaattccaatacatcgtgcaaaatggatgaaccttgaagatattatgctaactgaaataagccagacacaaaaggataattattatataattccatttataaaagatagttagaatagccagttacatagagacagaaattagaatggtgggtgctaagggttcgagggagaaggagtgagagttactgtttattgggtacagaggtttaatatggtaagaggaaaaagttctggaaatggatagtgtgatggttacacaacactaaattgcacacttagaaatagctaatggtaagccttatattagatatatataaagtgtctggtagtcttaccctctctataattacacactttttggcactgcccttttcctgccatgcagagctccaggggtgaatctccctatttctctagctctgcatcagtcacagtcctccatgctgtgtcccacgtactgtgcccacagcttcatacaaccgctgacttcagagccaggaccaggcttaggagtctgccctgaggctccttctcttctcatttccctgcagcctggcccgggggaggcttggcttcaactggcagctccatttagcgaaattcaggacagtccacaaggggtctttctccacacatgctggtcccaccccaggtggagtcaaacagggccagtcaccagaggagcccagagcagagcaggaagcagagtctgagctgctcctccctcacccaaggggcttcctcctctcatttgggggaaaagtgtgagcttgtttcaaagcctcagatgttccttgtagctcatggaataggtacaagaaaaaaaagacgtggcagaaggggatgtgttagtgacatccagaagcaacttgatcttgaggacactccttcttgtccctctgtgaagcctcttctaccacatagggctcagggctgataatgacccctccctacctttctcaggcgagacacaaggtcagccatgagaaaacagaaaaacaaggagaagagagtttgtagagacaaattgggagggttcaggaggagaatttgggatttgcttttgcccatgggacacaggctgggaataaaaatgttttcctgactcttctctgaaagccagatagactccacctaaaaccctactgccaaggatgctgggatccacttaccagagactttgactgtcaacgatgtggagctttcctcgccagtggctgagttacgaacagagcaaacatagagcccgctatgctttgtagtaatttgggggataaacagattttgtcctgattgctgaaacttcccattaattgtccaagaatactgtgccggtgggttagagttcgcgaagcaagacaagtagaggttatctcctgaacggtaattggtgtatgaagggtgaattctggggaggtctggaccatctggagcaaagagaataaagccacaggtgatgccatctgagggaaggggatgctcctggtctcttaaagggacacagtgaccctctgagacaagacacatcctcaagtcccagcaaaaccccctctatgttcactgagccgaaccctgaagtattcacctgtttctcccaccacaagatgtgggccccaagtctcccacgacaagaccgtccactccccttatattcttggttaaggctgtgcctacccaggttttcccagggcagggagtcatggccagcttggatgtccagaagtaaagttgtctatacttggaccggagagagactgagaggcctggcccctggtcatttggatttaagctggtggcctggcccacagaggaacaaaagatacagaggacattcagggtgactgggtcactgtggatgccaccatatcggtcccgtatttcacattcatagggtcctgtttcatttctcgtgacactgggtagaatgaggatcctgttttcaatgggtcgctttaccctgggactgaccgggaggctctgaccatttagccaccaaatgtaggtgtagctctcactcttaggttcacaggtgaaggctaatacatccttattctccctggggtttaagttgttgatggtgatttagggcttgggcagcttcgctgtgtggataacagagagaagattgtcctgtgtggcacttttgattcctccacaggcatccttcaatcagagttaccatctcccacctctcagcccacctgagtccttgaaagccaataactggtgtgtgtgtcacaagacagatgcatgatgatctaagggctcaaagactgtgaggccgcctgctctgtcttaggaaagcacagactttctgaagtgtcaattgagcagcagtgttgggtcatggacagacatgtcagtgggagtcacagccccagtacccctcccagtctctccctaatcagttgactggctggctcaccttgggttccttacctggaatgtgcaactgctgggccccttccaaattccatcctactttgcccccctagatgtgatttctctgcagcttccatttccaaggacattctagagatcagtaataatgggacttcccattgtcctgaaaccctgaagatactgagcagcctggcctgggactggatgtttcagcagaaataacacaggggagaccagagtcaagcctggaggtcagttcagtcatcaggcagtggaggcacaaggtggggcagctttttgcaggtgtttcatgatgacttacttgaaccagtgacctctaaagatagaacagagtgcaaggaatgatctagaaagagtgaaggggataggcaagagctggtggctttggagcagaagcatgttccctgtcttgggttctttaagtttcctctccttctgcagagggcaggtgaggaccatgtggatctttccagaaatacatgcggacatttgcaaaagcagaactgactggtggaaagggtgggaatgaactgctggaaatctggtcgtcatggaccatgtgtgtttgatggatatgagacaaatttggagagaagtttttcaaatattttctttcattgaacaatctactctgtgattccctgggttcgactactctagggacctcatgtaagtggattccagagtgaatatgagaagagactgctggttgccaggagctgggagtggggagaatcagaagttgttcatgggtgtgcagtttcagttatgcaaggtagggagtttctagagatctgctgtagagcttgatgcctatagttcacacagattgagtatttcttatgcataagacttaagacaaaaagtgtttcggatttctgacattttttgattctgaaatatttgtcatatacttactggtttagcatcccaaatctgaaagattcaaaatctaaaatgctccagtgagcatttcttttcagcatcagattagtaggcaaaagtgggaggtgataagccaaagatattcttgcccttttttttctctcaccacgtttctggcttggtgattagttttcggtcaattccatactggccatgctgcactcgtttattttttaaggctttgggatgtgagaaaggctgattgctattttctgtgtcatcagaactttccaccttttcatggttgcatctttttcacagtgtttctgttgtggcagtcattaataagagcctgtcaggtcagatttaggacggagttttctaattctgccaaaaatgttactgtgattctgggaggggttgcattgaatctgcaactcactttgggtagtattgtctttctaacaatattgagtcttccaatccatgaaaatgaaatgtctttccatatattgatatcgtctttaatttctttcagcaatgttttgtagttttcaaggtataatcatttgacctttttggttaaacttattccaaaatattttattccttttgatgttaatgtgaattgaatttctttccttaatttcctttcagattgttcattgttagtgtatagtctaaagaatgatctagaaagagtgaggggacaggcaaaagctggtggttttggagcagaaacatattccctgtcctggggttttgattttccctctccctttgcagagggcaggtggctcttccctgatagctagatagacttcactggaaaacatattgccaatgtttcagggatccacttaccagggactatggtcctcttgattatgagatttgttccagcagtggctgagttatggatgaaacagacatagagccctctatatgttttagtgatttgagggataaagaacacttgtgctgattgctggaacttcccatcaatcagccaagaatgctctgccagtgggtgagtgtctgtgaggcaggagagcttggggacttcccttgtatggtaataggtgtgaggaagaaatggtgggggcatccaggccatctggagcaaagagcataaagtcacaggcactattgtcagagggaagggaaaatcctggtctgtggaagggccacagtgaccctgtgagccaagccgcaacactgaactcccagccaaatccccgctgtgttcactgatctggagcctgagacattcacctgtttctcccatcacaagctgtggaccctgagtctcctatgacaggaggagcctcttttctcctattgtggatcaagcctaggcctattctggtttgcctggggcagaaagtcatggccagctttgatgcctaggggtaaaggtctctgtacttggacctgagagggactgagaggcctggcctctggccatgtgtatttgggatggcagtctggcccacagaggaacagaagatactcacggaggagattcagggtgactgggtcactgcggctggcactccctgagttccgtatttcacattcatagggtcctgcagtatactttgtgacaccaaatagaaagagggtcctgttggtttcggacagctgaaacctatgagtcatagggaggctctgaccattcatccaccactggtagcttgtgtccggagtctcaggatcacaggttaagatcacagtttccatggcctccctggggtttaagttgctgctggagatggagggcttgggagtctccactgtgcagaaaacagagagaagattgccctgtgtggcacctttgattcctccaaaggcatttttcaatcagagttggcatttcccacctctcagcccacccaagtccttaaaagcccatggcaggtgtgtgtgttacaagacagatgcatggcaatctgagggctcagtgattgtgaggctgcctgctttatgtgggagaagcacagactttctcaggtgtgtattgagcagcagcattgggtcatggaaagacacaggaccagcagtcacagcccctggtgcctctctgagtccctccatctcgaagtgcctgcctggcccaccttgtggtcctcacttggagcatgcagtgctggaatcttcttagtttcagtcttactttgccccctgaggtatgttttctctgcagcttcccttgccaaggacatccaagagatgaatgatggaacttcccattgtctttaaaccctttgggtactggaaagcctggcctgggactgggtacttcagcataaataacacaggggagaccagagtcaagcctggaggtcagttcagtcatcaggcagtggagccacaaggtggggcagttttcccaggtgtctcatagtgagtgacttgagccagtgacctctaaagatagagcagagtccaaggaatgacctacaaagagtgaaggggacaggcaagagctgatagcttctgaacaagaccatgtgccctgttctgggtccacaatgctcccttccccctgtagagggcaggtgaggacgatgtggacctttctagaaatacatgtggatgtttgcaaatgcgaaactgactggtggaaagggtgaacatgaactgatgatggaagtctggccctcatggaccatatgtgtttggtggatattagaccaatatttgggaagaagtcttgcagatactttcattagatattctactctgtttctgagtttaactaccctatgtacctcatatcagtggattccagagtgaatcagagagtagaatagtagtttccaggagctgggatcaggggaatagggcgttgttctgtgggtgtgcggttccagttatgcaggataaggaggttctagagatctcctgtacagcctcgtgcctatagttcattcagataaagtgctccttatgcagaaagcttaaaacaaagtgttttggatttctaatttttttattttggaatatttgccgtatatgtactggtttagcatcccaaatctgaaaaatttaaaatccacaatgcgccagtgagcacttctttttagcatcacatcagtggtcagaagggttgagttttgagcatttcagattgtggatttctggatttgggatgctcaattcgtaatactgtaattttcccataaaaagttgtcaggagtttagacctcatgttatgttctgactctagtaacaaaaaaaatttggaggaaatattaaaatgttttcataagtggaaatttttactgatgatccaaacatctaagatcaattgctggtagtagtatttctcctgagaccaaaataaggtttaggtgtgccgtgaattccagcaggatcacattatgctcaaagaaagatgccaaaggtgattggaaattagcagctccttaagtagagagagtcccgttaaaaggacagaactggtcagtgcatcaattacataaagggaggaaggatgccaaattaaaagaagtgatgtgtgttatgttagtaaatatagaaagaactccctgcttctaatttctgtgcagagttaggaaaaatggggaggaccccaaaacaggtatgtgaaatgctttcttcattttctcttaagctcaggaaacaccactagagtttaagtttgtgtgaaataggaagattctaagtgagatgccaatggctcatgtgtctccccacaagaagaactccaacttatgaaaacggcatcatcatgaggaaacacttgtgtgtggcacaggcagtaaaaccatcagatagcacccacctggtcacctccaactggtcctcaaaaccaccagtattcctattacgtgtacgttacagcatttgtatttgtcccacaactacataatttaaaaattgctactgtcaaaacaaaatattaaatatgaagttgaatcagttgttccactttttcttccccactcttcttgaactttcctgtttcagttttggaaatttctattgacacgtcctcaagctagggattccttagcttttttacttagtgttggaaccgagtgacaaattccaagcttgttatatgcctgaccggaagccagaagtctctaggaagtgactggagaatgtgagctctatagcaggttgaggatggagtcacgagtgaaatgggtgatatgagcccatgggcttgggggactgcaggcctgtccagcctctgacaccctggtgagtcattgcagagattacaacagtgacagcaaactagcatggctgactccatctggcatctagtctcaggctggctgtcctcacttattcctgggcataggccaggctaaccttgggaggaatttagtttatggtttaattttgaagcaagaatgataatagttcctccataaaactaacacccttactttgcccagggacggcctttgtcaaactagtgaaagaccatgagattaagattataggagggaaccgaattctgctaaattgttgtcacagtttctataatccctgactgctccaatgtcatttggctggagttgacaaaatttgtaactaattgatcctatagataacatcactattatagaagttgagattggtcttttgagatgtttctcattcttttgcattctggcaactggctgacctcatccatacctatgattaatggctcagccagtcatgtggtccctacctagaggcggattccagcacaaactgatcatttccctccgcccgcatgattccatcaccaaacaatcagcagtactcatttttcagtcctgtgcccctgaaactatccttgaaaatctctaagccctgatccactggggaggctgatttgagtaataataaacctctgtcctcctgtttggcagacttggagtcattaaaatctttctttactacaaatcaccatttcaataatttttttgtgtgtgtgtgcaggaggccagaagaacttgtctgacaatgataagagtggttggagggacttcctatccctgtcccatggtcttgtccacaggtcagcctcacaaaggggaagagcccttgatgggaatacagtggaagctcattctcttagtgacctggggacattggctcgagatgaagcctggcaggagtggcaactccaggtgatttctgcacctttcctatttcctgggaggttggctaggccacagtgttagaaggaagggaacagaacagccagcctagttagagggagtgtctggggaaggcctaggtgtgagggaagaagctgtgcaggacagggcttgccagtcagaatgaagtgggaggaagatgagggacacagagaagcagagagaggcagagacaccatggcagtgagcagtgagggctacactgacgtcagagaccccagggaccagctgcccccagttccacagtccagaaccaaggagccctgagaaccctctggtggccaaagagcttcagagttacatgaggtggggttgctttaggggcaagaggtagtggggggatgaaacatgggtgtcagcttctgaaggacaagggacaggtgtggctaggacctcctaggattctgcatccaacatccagtctctaaagaggttttggatcattcatttcttcattccattccttcatttgttatgtgagagctcctgagtgtgtgtgtctctcactgggcctgtgctgatgcagggtgtgagtggggaaagaaaacaaggtcctctccttgatcctctcatgacagtgacatggacactttgggaaacacagggtttcaggttcagtgatgggggttaagatctgagagggaggcctgctcatgttttttgcactgattctgacagttgaggcaggtgatttagttctggagtacagattaatcagctgaccatttgctctcactcctctgaggtttggatgcctaagaagagaggatttgagccaataaatgacatggggtccttgggacccagtaagccctcacttctggtggaggagaggaagggcctgtggctgcaggcagacctcatgtgaccctgatctcccctttgtgttggtgtgactctggttcagtgactgtgccttcctgtgcctcagttttctctcaatcaaataagctaaatggcaaatggactgtggcttttcatgctatctgtgaataaatgttaaagtattcacagtcacttgatctaatgcttggcacagtggaggtttcacacaaacagcatttattattaatttgcttccatgagaaagcaccgttacatcagatccctgtggacaagctgctaccaggtacatcttctgtcttctgtttctgcttctggggacattagacttcctatggactctcctaagcctcctaaggcagttggctgatggtcttcaaagattgtctttctgtcctctccactctgcc

SEQ ID NO: 610 - DNA, 384424 bp, Homo sapiens
ctgattcagacacttgaatcaggcactcaatttggttaacattttgccaaccatgaagggggtcctcttaatggagtttagaacctttgacctgcagtgcttcttttgttcatgctcagtaccaactatagagctttagttgtgaccagtcatgtgactttctgagaattggatcctactttctcttgaggtccctgctctctccgatttttttgtttgagatctgagttttgtttcttcatggaactcctctcctcatggagctttgctcacttcctaaaaggaacatgagtttcctgctcctgtgacaatggagagccgactacagcttggtccctgctcaactaaggagctggtttggggtttttagaatttggtagctgcaggataaggcttattactacttcattctaacctctccttatgcttagagtgttcaacagtatgtaaatagtgcagtcgctatttgtgtttttggtttttatcattcttcctttggatttgaccaactcttcaccttgtctaatgtccagaacacctttcacttggtcaaatccaaatctaacaggagctctaaattatggtgaagcaggcctttaaactggctaaaattctgtaatggcagaacatccaactccacctctagaaacacctgtttgttgaagaaaataacaatattttaacccgcaatatatttctttgacaaattttgacatgtctgtcagagggccagcaaatagaagtggccctgcacagttgccttttgtggaaaaaatctacatcatagagaatcattattaatgcaggcatgtcttcccttatctggatctgggaaaaatggactgaatctgataccttaaagataaacaagtttagcattgatttttctctgagggctgctacctgcaaggttttactgacacaagaccagctttgctaactgaacttcctttctttctcccattacctgtattaccactaaaacctgatttacctccataacctcgttttggacatgcagaaatgcagaaaagtaatcagccagctaaagggtaaaaatgtattagtctcaagtttcctggcttccctctgtgcattctttccaattggatggtaaaaatcactgtttcctccaccaaattttgattaatgggagatttgtgttggactagtcttggtgtagtaattctggtgtactttttagtaatgttggggtatgagtattttgattgtttaatccatttcctcccagaagtagtcttttcctttatctctttcattctgtgttgctcataaagggaggtactggataaagttttctctcatcttgtgatatgtccttgagggcttgatttgtgaccaagtcagagcactcactcttggtctccaccatcagggggaggagtcatttttgagtcacattaggtgaccagctgtaacatggctgagaccctgaggttttttatttgttttgttttccaaatgtgttaagctcccaggagggcttgtcataagaagtcccatccaggctgggtgcggtggctcacacctgtaatcccagcactttgggaggccgaggtgggcggatcacgaggtcaggagattgagaccatcctggctaacacggtgaaaccccgtctctactaaaaatacaaaaaaattagccgggcatggtagagggtgcctgtagtcccagctactcgggaggctgaggcaggagaatggcgtggacctgagaggcggagcttacagtgagccgagattgcatcactgcactacagcctgggcgacagagtgagactccctctcaaaaaaaaaataaaataaaaaaaaaaaaaataaaaaagtcccatccatcagggacttttgtcattcccaagtcttgttgcttggatagggctgtggcaacaagagtcttttgctttcctaagcctattcctgagagtacatattttattttgtggtgggggaaaagatcattgggattggcttttcactgaagaggctgttggattgagtcacttagaatcaatacaccactggaaattctaattgtccatggccagaagatggattctttaaattgggacatctaagttaaaaaatattttagagatctcttattccaaacagttgatcagaggattgaatttcaaagaaagacacctgatagtgttatggctagccttaaaatttcttttgactaaattacagagcaaaaaatctcacctaaaacaaagttatttttttgtaagctcaaactgcttgacttagatcatctgagaaaataagaatagaagccactttaccttgtcattgaatagttaaaatcttatgcttttactgctgcagcctggatttaattttgggtcagggaaccagccttacttgttctgatatttgtgtgatttttgagtttttgaggtgctccttgacctctttggagatgcctcatacatccttggctaagccataatcttggttaaggcttattagtttcatttgggaggatacttttggttaaaaaaaaaaatcaaaagccagaaatatcagctgtttgtcctacctaaaatctgatatgaagaagtctgaggctgggcacggtggctcacacctgtaatcccagcactttaggaggctgagacaggcggatcaggaggttaggagatcgagaccatcctgtctaacacggtgaaatcccgtctctactaaaaatacaaaaaattagcctggcatggtggcgggcacctgtaatcccaacggctcaggaggctgaggcaggagaatggcataaacccaggaggcagaggttgcagtgagccgagatcgtgccactgcactccagcctgggtgacagagcgagactccatctcaaaaaaaaaaaaaaaaaaaaaaaagaaaatctgaaagtgtcacagtaggtagctggttagacatgagcagggcaggagagagctttccacccccacacactagaaatgtcaagtgatcatcaccaggtgatggtcaagtcaggtggttgttaactgtctctaaagtaataattggttgcaggtagtgccagggagatatagtctcacaatagatagaaaacacctgaaacaggtgatcagcagcttcccaataagttctcagaagttgagcaagtgggctcaaatatacacattaagaggcaacataatagagtttctggtatatgaccttctagggacttttttttttttttttttacattttagaagcatcattttttaggaactatgtttttaaattttttattattttattttatttttaaatctgtaaatcttttatttccataggtttttagggatttggtatttaattacataagttctctaggggtgatttgtgagattttggtgcacccatcacctgagcagtatacactgaattcaatttgtagtcttttatccctcacccccttcccaccattttccccaagtccatcgtatcattcttagatgatacagagcttagctcccacttacgagtgagaacatagtgtttggttttccattcctgagttacttagaataatagtctccagtttcttccaggttgctgcgaatgccattaattaattccttttatggctgagtagtattcaatcatatatatatactacaatttctttatccactcatttatagtttacattcgcaccagcagtgtagatgtgttcccttttcactgcttccacaccaacatctattatttttatttatttatttttgagatggatggagtcttgctctgtcgcccaggctggagtgcagtggcatgatcttggctcgctgtaacttctgcctcccaggttcaagccattcttctgcctcagcctctggagtagctgggattacaggcatgtgccacctcacccgggtaatttttttgtatttttagtagagacagggttttaccatgttgtacacactggtgtcaaacccctgaccttaggtgatccacccacctcggcctcccaaagtgttgggattacaggtgtgagctaccgcgcctggccaacaactattattttttcattttttgattatgaacattcttgcaggagtaaggtggtatcacattgtggttttgatttgcatttccctgatcattagtgatattgagcattttttcttatgtttgttagccatttctatgtcttcttttgagaattgtttattcacattcttagctcactttttgatgggattgtttgtttgtttgctaatctgagtttcttgtagattctggatattggttatctttcagatatatagattgcaaagattttctttcattctgtgggttatatgtttagtctgctgactgttgctttgctgtgcagaagctctttagtttaagtctcacctatttatttttgcttttgttgcatttgcttttgggttcttggtcatgaacttttcgcctaagccaatgtctagaagggtttttccaatgttatcttctagaatttttatagtttcaggtcttagatttaagtcctagattcattttgagttgatttttgtataaggtgagagatggggatccagttttattctcctacattcggcttgccaattatttcagcaccatttgttgaatagggtgtcccttacccattttatgtttttgtgtgctttgtcaaagataagttggctgtaagtatttaggtttatttctgggatctgtattctgttccgttggtctatgtgtctatttttataccagcaccatgctgttttggtgactatggacttagagtattgtttgaagtcaggtgatatgacaccaccgcatttgttctttttgcttagtcttgctttggctatgtgggctcttgtttggttccatatgaattttagaattgttttttctagttctgtgaagaatggtggtggcattttaataggacttgcattgaatttgtagattgcttttgtcagcatggtcattttcacaataatgattctattcatctatgagcatggggtgcattttcattttttgcgtcatctgtgatttctttcagcagtgttttgtagtttttcttgtagaggtctttcacctccttgtttagatacattcctagttattatttttttataactgctgtcataaaaggggttcagttcttgatttgattctctgcttggttgctgttggtgtgtagcagagctactgatttgtgcgcattaattttgtatacagaaactttgctgaattcatttgtcagttctaggagctttttggaggagtctttagggtattctaggtatacgattatatcgtcagcaaacagagacagttttacttcgtctttaccgatttggatgccctttatttatttcccttgtttgattgatttggctagggctttcagtactctgttgaataaaagtggtgagagcaggcatccttttcttgttcccctgctcagagtgaatgctttcaactttttctcattcagtatcgtgttggctgtgggtttgtgtgccaattttgctgagagttttaatcataaaatgatgctggatgttgtcaagtgcgttttcagtgtctattgagaggatcatgtgatttttaaattatgtttatgtggtgtaccacattattgacttgtgtatgtggaaccattcctgcatccctagtatgaaacctacttgatcatggtggattatgtttttgatgtactattggattcagttagctagtattttgttaagaatttctgcatctgtgtgcaccagggatattggtctgaagttttctttgttatgtcctttcctggttttggtattagggtgatactggattcatagtatgatttagagagaattctctctctttctagcttgtggaatagtgtcaattaaattggtaccacctcttctttgaatgtctggtagaattcagctgtgaatctgtctggtcctggaatttgttttgttgttaattttttaattatcttttcaatcttgctgctttttgttggtctgctcagggtttctaattctttctgatttaatctaggagagttttacatttccaggaacttattcatcccctctaggttttctagtttatgcacataaacgtgttcatagtacctttgaatgatcttttgtatttctgtggcattcgttgtaatagctcccatttcatttctgattgagcttatttggctcttctctcttcttttcttggttaatcttgccaatggtctatcaattttatttatttttccaagaaaccagctttacattttatttatattttgtattattttgtttcagtttcatttagttctgctctgatcttggttattttctttcttctactgggtttgggtttggtgtgttcttgtttcttgagtttctagaaatgtaaccttagattgtctatttgtgctctttcagtctttttgatgtaggcattaaaggctatgaacttttagcatggtctttgctgtattctagatgttttgataggatgcatcactattgttcagttcaaagaatttttaaattttcattttgatttcatatttgacccaatgatcattcaggagcaagttatttaatttccatgtggttggttttgaaggttccttttggagttgatttccagttttattctactgttgtctgagagagtacttcatataatttcaattttcttaaatttattgagacttgttttgtggcctatagtatggcctatcttaaagaaagttccatgtgctgatgaatagaatgtatattctgtggttgttgggtagaatattctgtaaatatctcttaagtctatttgctcgagggcatagtttaaatctattgtttctttcttgactttctgtcttgatgacctgtctagtgctgtcagtggactaatgaagtccctcactattattgtgttactgtctatctcatttcttaggtctagtagtaatagctatataaatttgggagctctggtgttaggtgtatatatgtttaggattgtgatattttcctgttggacaagtcctgttattattgtataatgtccctctttgtcttttttaactgctgttgctttaaagttagtttttttgatataggaatggttactcctgctcactttgtggccatttgcatggggtgtctttttctacccttttaccttaagtttacatgacactttgtggttaggggagtctcttgagggctgcagatacttgcttggtgaattattatcaattctgcaattctgtatcttttaagtgaagcatttagaccacttacattcaatgttagtattgagacatgaagtactgttccattcatcctgctatttgttgcctgaataccttggttttatatatttatttattgtatttttgttttataggtcctgtgagattcatgcttaaagaggttctgttctgatgtgtttccaggatttgtttcaagatttggagctccttttagcagttattgtagtgcaggcttggtagtggcaaattctctgagcatttgtttgtctgaaaaagactgttatctttcctttatttatgaactttagttttgctggatacaaaattcttggctgataattttttttaaggaggctgcagataggtatgcatgctcatttgaggtgttcttcccttattaaagattgctaaaatcacatgtgttgaaaagcatttgggattatttacttaattgatgagtactcatttatttttgcattaatttgataccatgtataaacaatatataaacataggtatggacatatacatatatgtgatacaacatagaacatatacatgtgcacataaagatagaaggagacagaaatactttagatttttgattttaaaactatgcatagaacccataaaactcactattaaaaaaaagttggatttaaattgtgcttttgtaaatagaaaaagttaacatttatctgaggaagcccttgctgagttttagagaaagtaggtagtaaatttacatctcaaagcacagagagagagagagagagaaggaatttgggtgtgttcaaggaagattaaaaatagatggcaaggtaacacaaaaatgatagaaatttataacaggattttataaggagaccaattttatttccatacatagcttttattttggtctctattttccaactgtactccagggaacacactacacaggctcccttaagtgctggtgggccactgcacatgcagacagcccactttaagggaagaatcgggggagaagagatgcagaccccagaattatgccaacatacgaaagcctaagtcaaaggtcaaaccacacacttgaaatctcatcgcctgtttggccctgttttaagtgtactttactttctttaatttctgctctaaagcttttaaataaactttcactcttgctctaaaacttgtctcagtcttttcttctgctttatgactcttggttgaattctttcttctgaagaagcaagaattgaggctgctgcagacttctacagatttgctgccactaatatactttagtgccattctacatgatagaatatatatatattcttatatttatacatagatatataatatatgtattcatagaggccttgaatctacattcttgctccactttatgtaaacaatccaggtataagactaaaacttattttggaaatacattggtcccatatgatttctatttcataaaaatgggagacaggagggggaaaattatttttcagaagaaaacaacagaacaatggttattgaattttagatctgttctttttttcttgaactttgttatttacctacaatttggactgaatcctaaattttttcctggctacaaatttcaaaactaatggtttcagaattttcttccatttttcttccattttggtatattgtaaattaaaactgtgatttttaaatttttatctttttttattacacttttaagttctgggatacatgtgcagaacctgcaggtctgttacataggtatacacgtgccatggtgttttgctgcacccattaacccatcatctaccttaggtatttctcctactgctatccctcccctagtcccccacccctcaacaggccccagtgtgtgatgttcccctccctgtgtccatgtgttctcattgttcaactcccacttatgagtgagaacatgtggtgtttggttttccgttcctgtgttagattgctgagaatggtggtttccagcttcatccatgtccctgcaaaggatatgaactcatcgttttttatggctgcatcgaattctgtggtgtacatgtaccacattatctttatccagtctatcattgataggcatttgagttgattccaagtctttgctattgtgaatagtgctgcaataaacatatgtgtgcatgtgtctttatagtagaatgatctataatcctttgggtatatacccagtaatgggattactgggtcaaatgatatttcttgttctagatccttgaggaatcgccacactgtcttccacaatggttgaactaatttacactcccaccaacagtgtaaaagcattcctatttctccacatcctctccagcatctgttgtttcctgaccttttaatgatcaccattctaactggcatgagatgatatctcattgtggttttgatttgcatttctctaatgaccagtgatgatgggctttttttcatatgtttgttggtcacataaatgtcttattttgagaagtgtctgttcctgtgctttgcacactttttgatggagttgtttgtttttttcttgtaaatttgtttaagtttcttgtagattctggatattagtcttttgtaagatggatagattaaaccttgcaagctgaaactagacgacttatgtaaacttctggagaaatcatagcaacttatatataaacaacttttgtgcctgctgatgtggactacacaaaaggttcacatgaacactggattcagactgcaattcagaaatgtgtcagattgccgttgtaattggaagatgcttcagaaactctagaaaacctagtctatagactgctccagacattacaggtgagccaacatacaactgaaagggttcaagcggtgtttgccaaacgaattgctctaattgaagcagcagttgtgtgactttaataaggttccaggattatactgtcccttttttgctgtgacttccctttgcccttttctgatttgtcttcatccccttttccatggggcatgacttcttaagaatgagccttcctagtgatgtaggatgagatgaaacatacagtcacaaagtcatgtcttctacaatgctttctctgaaagcttttgaagaatcggggggccaggtgtgctggcacaggcctgtaatcccagcactttgagggtctaaggcaggaggatcacttgaaaccaggagtttaagaccagcctgagcaacaaagggagaccacgtctctacaaaacataaaataaatcaaattagccaggtgcagtggtgcatgcctatagtctcagatacttgggaggctaaggtgggaggaccgcttcagcccaggagttcaaggctgtagtgagtgcactccagtctgggtgacagagcaaggttgtgtctctaaaagaaaaaaaaaaaaaaaaaaaaaaaaaaagaaaagaaaaagaaaggggtaaacaggaaagccaaagatctcgagcatctccagatgattgcctgaacaaattgttttttcttggcttccaaacctttcaagatgtatattactttgtaaaagaaagacatgccaattgtaactttaagtgagcaatcaaaatctagctcctaaaactgaagtattttaactctcattctgataatttattttctgaggcacagaagaaagacaagattaggtcaattgtttttatgcccactccatctcttccaacctgccttctcccctttaatcaaatgtataaacactaagcctcctgaaacctcttcagagaaaacacaagccacagaggttttttgcaactcatgttttcccagggtgcaccatcaagctctggctcgataaaactcaattggtcaagacccttgcctcagtcagtcattctggataaccaccatgagtcctgcaaagcccttcagtaatctattgcctgcctaggtgatgtgtacccaggtgagtcaggtcttcatgagtcaaacactcgtcttccttttctgtctttcccaaccctaccactcagtgctgtgtgctctgatctgaccccagctcccaggttgtttgtattggtctaagaaagcaagaccaggaggggcaggttgagaaggaagtaagaggccaacagccatggaaagtggcaggtggggctgtcattgctcaaagccacacaccctgggtgcattttgtgaatttttctggattcggaatctttttcctgtgtgtctgtctagaaactcaccttcttcctactttcttctcagtacactttctgtttctagtgcactcatttatgtccagagaatggccatgcaaatagttgacaatagaataaaaaatgactttttatgagacttggaagctggcctttcttttttccaaaagagattgaggtttccataaaaactagcttttatgcagggctgtgtagttgtgagtgtagttttagggaacaggtgcataagtgaagggtgagacagaaaacaaaatgctggctgtttgtcaaatcctgaaagtaggggggctgaaatcatttttgaaggaggatgtcattcaggagaccttgtacatcttagagtgtcctcttaccagatgaagtggaggatgaggttgaattagggagttaggtgacagtgggcacatacttctctgcctcagttttttttttaaatctgtaaaaatggggatgataacactcaggattttttggtgaggactgtagttacctggaaagcccttaggatagtgcccggtgcatagtgagtgctgcatcagtgtgagctattataattatgggaataggcaaaggtgccaccctggccatccagagtggagaggtattttctggtcagggtccaggcaggccagctggagatgaagctgattagtggggaagcttaacttccaggagcggaagaatttaggaggagtaaacagaatgcacaacattctgtaaacatgcctttacccaacagtaggaatactcagagtgggtgtggcttccatggcaatcattatctcctgggaatctaagaatgtgtcctagagtcaagtggctttgatgtaagccaaacctggaaatgggcttcagggctgccttgcacatagcattcattcatcttgaaaaaggaaagcattcatcttgctaaaggaatcccctcttctggtccaggccattatttttgcttttgtactatcctaatttttaaggtgtaaggagaaagaccaaagaataaaataatgaagtacctgtatgaaataacagggtagaattgagactggtacgtgtaagttaagagaaattgtgtataaatttttgtgaacagaaaaaggatttcttgttgcaaactgacctctctatataaataatacccattgccttgaatggatggcagaccgcatcacaagaacattccagcagagtcatgagagaatgggtagtgtggcttctttaattggcaggttagactgagtaagttactgaagagaaaggagttgaaggagaagatgggtgagggcaagaaaaatgggaaggtgaaaggaaaggactgaaaggaatgtttaccaagggctcatcaggtaccaggctctgtgactaatgtcttacacatgttaatttactcttccactgtcattttctgatgcagtaagagtcagtcttacactacaggtgaggaaagaggctgagggaggtcaaatgagtggcccagggtcatccagccacttcatagcagagctagtgtgtttcactgtggtttgtgcagacagaaaagtgagacatagaaggaaggcaaaacatttttgttgtgggtgatgtttatgaaagtgacccgtatgaggcagaataatggcctcttaaaaatgtccacatccgggccgggcgcaggggctcacacctgtaatcccagcactttgggaggctgagacggtggatcacgaggtcaggagttcgagaccagcttggccaacatggtgaaaccccgtttctactaaaaatgcaaaaattagctgggcgtggtggcgggcgcctgtaatgccagctacttgggaggccgaggcaggagaatcatttgaacctgggaggcggagattgcagtgagctgagattgtgccactgcactccagccagggcaacatgagtgaaactctgtctcaaaaaaaaaaaaaaaaaatccacatcctaactcttggaacacatgcatttacttttcttggcaaaaacactgttcaaagttaatgaagttgagtatcttgagatggaaagcttattctggcttatctgggtggctcccagtttcatcataagtgtccttgtaagtgaaagagaaaggcaggagggtcagggtgagaaagatgcagcctgagagactccactggccattgcttcctgtgaacatgtgtgataagacaaaattacaactaatttagttacagatgtaattggcttttatttgtgatttatgatttggggcagctctccctctacagatgcctcagcatcccaagtagctgggactatattgcgggatctggccagcagcctgcaatgcaacggggctctttctttgttcccaggcagatcagcaggttgagaaataaaagacacacacaagatagtgaaagctgggtccagaggggtcaccgccttcttgtcctgcaatgctgccaatgcactggatataccagcatttattattaagtttagtgagagcggggttaggttagtgagggatttagggtcatttataggctctccacaagcgttgcattccattcccagagctatggacatctgcttttctgggataggaatcttggtaatgtgaaacctccctgactgcacgtctgttcataggctctctgccgggggaagcacatcacgtgctgttggctcattctggcagtccaacctggcatttgtctttacacaatcctgcatgcaattttgtatttacaataatcaggagcatttcatcttttattccatagcaatagtttcagggggtctccctacatctcccccttttctctgatttaaatgaaccatagcaatcatagcttggcactgatcacgattggattgaagaatatttttttccaattttacatatgaacaataaaccaatagcacaaattatacacagaacaaaattaacgatagtggatcctcccaaagatattacctattgaatggggttgagattagataacccctcagagatactgtctaaaacttcagcactgggtaaagcagttaagtgtgcttgagaggcttcaaaaatctgttcttttagcttgcttatgtctaaacttaaattatcttcacttccttgtaaatgggattttactgattcccaattatgaacagactcattatattggaactgagttatacaaaaatcagaagtattcctatcacactaaatttgtaatctatgttctaaactcataattctatctcccatccatataacagaagcacatcaagcgctgtaggctcattctggcagccaatctggcattgtctttacacaatcctgcattcaactttgtattgacaataatcaggagcatttcatcttttattctgtaacaatagtttcaggggttctccctacaggactacaggtgtgcaccaccatgcctggctaatttttgtatttttagtagagacagggtttcaccatattgaacgggctgatctcgaactcctgacctggtgatctgcctgccttggcctcccaaagtgctgggattacagatgtgagccactgcgcccagcccataaatcacacatttctttgagtttttgtaattccagcccaagagaaaccatttgatatttcaagaatggctgcacacaaatattttcacacaaataaaaacatctgtagattgcaccacacgagggagactaccagtatgactatcaggaggaaaatatcaagagtttggaatatgcaccttaggaaagatgcaaaccaactacaataggatagatcaaagaagaagccagaagagtctagtcattttaaccagtcagcaaatttattgatttttacaaccaagtctttataatacccaatgtatttatccatgtgcaacaagaagtgtcagaaactgcacaggctccccactgttcagctggtagagagcaattctattatctattattgcatgtctatgttaaattaaaaaaggggaggtgccaagatggccaaataggaacagctccggtctacagctcccagcgtgagtgacgcagaagacgggtgatttctgcatttccatctgaggtaccgggttcatcttgctagggagtgccagacagtgggcgcaggtcagtgggtgcgcacaccttgcacgagccgaagcagggcgaggcattgcctcactcgggaagcccaaggggtcaaggagttccctttcctagtcaaagaaaggggtgacagatgacacctggaaaatcgggtcactcccacccgaatactgcccttttccgacgggcttaaaaaacggtgcaccaggagattatatccgtcaccaggcttggagggtcctatgcccacggagtcttgcagattgctagcacagcagtctgagatcaaactgcaaggcggcaggaacccaccacagctcaaggaggcctgcctgcctctgtaggctccacgtctgggggcagggcacagacaaacaaaaagacagcagtaacctctgcagacttaaatgtccctgtctgacagcattgaagagagcagtggttctcccagcacgcagctggagatctgagaacaggcagactgcctcctcaagtgggtccctgacccctgatccccgagcagcctaactgggaggcacaccccagcaggggcagactgacacctcacacggcagggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcgcctctcctcctccaaaggaacgcagttcctcaccagcaacagaacaaaactggatggagagtgactttgacgagctgagagaagaaggcttcagacaatcaaataactccgagctacaggaggaaattcaaaccaaaggcaaagaagttgaaaactttgaaaaaagtttagaagaatgtataactagaataaccaatacagagaagtgcttaaaggagatgatggagctgaaaaccaaggctcgtgaactatgtgaagaatgcagaagcctcaggagccgatgtgatcaactggaagaaagagtatcagcgatggaagatgaaatgaatgaaatgaaacaagaagggaagtttagagaaaaaagaataaaaagaaatgagcaaagcctccaagaaatatgggactatgtgaaaagaccaaatctacgtctgattggtgtacctgaaagtgacgaggagaatggaaccaagttggaaaacactctgcaggatattatccaggagaacttccccaatctaacaaggcaggccaacattcagattcaggaaatacagagaacgccacaaagatactcctcgagaagagcaactccaagacacataattgtcagattcaccaaagttgaaatgaaggaaaaaatgttaagggcagccagagagaaagtttgggctacccacaaagggaagcccatcagactaacagcggatctctcggcagaaactgtacaagccagaagagagtgggggccaatattcaacattcttaaagaaaagaattttcaacccagaatttcatatccagccaaactaagcttcataagtgaaggagaaataaaatacttcacagacaagcaaatgctgagagattttgtcaccaccagacctgccctaaaagacctcctgaaggaagcactaaacatggaaaggaacaactggtaccagccactgcaaaatcatgccaaaatgtaaagaccatcgagactaggaagcaactgcatgaactaaggagcaaaataaccagctaacatcataatgacaggatcaaattcacacataacaatattaactttaaatgtaaatggactaaatactccaattaaaagacacagactggcaaattggataaagagtcaagacccatcagtgtgctgtattcaagaaacgcatctcacgtgcagagacacacataggctcaaaataaaaggatggaggaagatctaccaagcaaatggaaaacaaaaaaaggcaggggttgcaatcctagtctccgaggaaacagactttaaaccaacaaagatcaaaagagacaaagaaggccattacataatggtaaagggatcaattcacaagaagagctaactatcctaaatatatatgcaccgaatacaggagcacccagattcataaagcaagccctgtgtgacctacaaagagacttagactcccacacattaataatgggagactttaacaccccactgtcaacattagacagatcaacaagacagaaagtcaacaaggatacctaggaattgaactcagctctgcaccaagcagacctaatagacatctacagaactctccaaccaaaatcaacagaatatacatttttttcagcaccacaccacacctattccaaaattgaccacatacttggaagtaaagcactcctcagcaaatgtaaaagaaaagaaattataacaaactatctctcagaccacagtgcaatcaaactagaactcaggattaagaatctcacttaaaacaggtcaactacatggaaactgaacaacctgctcctgaatgactactgggtacacaacaaatgaaggcagaaataaatatgttctttgaaaccaacgagaacaaagatacaacatactagaatctctgggatgcattcaaagcagtgtgtagagggaaatttatagcactaaatgcccacaagagaaagcaggaaagatccaaaattgacaccctaaaaacacaattaaaagaactagaaaagcaagagcaaacacattcaaaagctagcagaaggcaagaaataactaaaatcagagcagaactgaaggaaatacagacacaaaaaacccttcaaaaaattaatgaatccaggagctggttttttgaaaggatcaacaaaattgatagaccgctagcaagactaataaagaagaaaagagagaagaatcaaatagacgcaataaaaaatggcaaagaggatatcaccaccgatcccacagaaatacaaactaccatcagagaatactacaaacacctctacacaaataagctagaaaatctagaagaaatggataaattcctcgacacacacactctcccaagactaaaccaggaacaagttgaatctgtgaatagaccaataacaggatctgaaattgtggcaataatcaatagcttaccaaccaaaaagagtccaggaccagatggattcacagccgaattctaccagaggtacaaggaggagctggtaccattccttctgaaactattccaatcaatagaaaaagagggaatcctccctaactcattttatgaggccagcatcatcctgataccaaagccgggcagaaacacaaccaaaaaagagaattttagaccaatatccttgatcaacattgatgcaaaaatcctcaataaaatactggcaaaccaaatccagcagcacatcaaaaagcttatccaccatgatcaagtgtgcttcatcgctgggatgaatggctggttcaatatacacaaatcaataaatgtaatccagcatataaagagaaccaaagacaaaaaccacatgattatctcaatagatgcagaaaaggcctttgacagaattcatcaacgcttcatgctaaaaactcaataaattaggtattgatgggacatatctcaaaataataagagctatctatgacaaacccacagccaatatcatactgaatgggcaaaaactggaagcattccctttgaaaactggcacaagacagggttgccctctctcaccactcctattcaacatagtgttggaagttctggccatggcaattaggccggagaagaaaataaagggtattcaattaggaaaagaggaagtcaaattgcccctgtttgcagacgacacgattgtatatctagaaaaccgcattgtctcagcccaaaatctccttaagctgataagcaacttcagcaaagtctcaggattcaaagtcaatgtacaaaaaatgacaatcattcttatacagcaacaacagacaaacagagccaaatcatgagtgaattcccattcacaattgcttcaaagagaataaaatacctaggaatccatcttacaagggatgtgaaggacctcttcaaggagaactacaaaccactgctcgatgaaataaaagaggatacaatcaaatggaagaacattccatgctcacgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaacagcctgcatcaccaagtcaatcctcagccaaaagaacaaagctggaggcatcacactacctgacttcaaactatactacaaggctacagtaaccaaaacagcatggtacaggtaccaaaacggagatatagatcaatggaacagaccagagccctcagaaataacgctgcgtatctacaactatctgatctttgacaaacttgagaaaaacaagcaatggggaaaggattccctatttaataaatggtgcttggaaaactggctagccatatgtagaaagctgaaactggatcccttccttacaccttatacaaaaatcaattcaagatagattagagacttaaatgttagacctaaaaccacaaaaaccctaggagaaaacctaggcattaccattcaggacataggcatgggcaaggacttcatgtctaaaacaccaaaagcaatggcaaccaaagccaaaattgacaaatgggatctaattaaactaaagagcttctgcacagcaaaagaaactaccatcagagtgaacaggcaacctacaaaatgggagaaaattttcacaacctacttatctgacaaagggctgatatccagaatctacaatgaactcaaacaaatttacaaggaaaaaacaactgcatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccacttagaatggcaatcattaaaaaggcaggaaacaacaggtgctggagaggatgtggagaaataggaagacttttacacttggtgggactgtaaactggttcaaccattgtggaagtcagtgtggtgatgcctcagggatctagaactggaaataccatttgacccagccatcccattactgggtatataccaaaaggactataaatcatgctgctattaagacacatgcacatgtatgtttattgcggcattattcacaatagcaaagacttggaaccaacccaaatgtccaacaatgatagaatggattaagaaaatgtggtacatatacaccacggaatactatgcagccataaaaaatgatgagttcatgtcctttgtagggacatggatgaaattggaaatcatcattctgagtaaactatcacaagaacaaaaaatcaaacaccgcatattctcactcataggtgggaattgaacaatgggaacacatggacacaggaaagggaacatcacactttggggtctgttgtggggtggggggaggtgggagggatagcattgggagatatacctaatgctagatgatgagttggtgggtgcagcgcaccagcatggcacatgtatacatatgtaactaacctgcacactgtgcgcatgtaccctaaaacttaaagtataataataataattaaattaaaaaataaattaaaacagggagtgagaataggtaagtatagaagtggaagcctaaaaaaaactccatacatttgaggaaaaagttgtgttacagaggcagctaacatcagcctttgggtggactaaaggatctctttttatgtaaaaatgcgtgggctgggtgcggtggctcacgcctgtaatcccagcactttgggaggctgaggcgtgcagatcacctgaggtcgggagttcgagaccagcctgaccaacatggagaaaccctgtctctactgaaaatacaaaattaggtgggcgtggtggcgcatgcctgtaatcccagctactccggaggctgaagcaggagaatcaattgaacccaggacgcggaggttgcagtgagccaagattgtgccattgcagtctggcacgggcaacaagagcgaaactccatcttataaaaaaaaaaagtgtggttgacatgatatatcggacactgttaacttactctcagaagctacttcttgtgaaatcctaagtacagcattattctgggaagcaaaggagacaggcagaagcaaggacaaattaagagaggtaacagtctcatcatgactgatagtcttgttctaacatcttgagaaaagctgtccacagtgtaaagtcatcaacttgtcgtggtttgcagtttgagtgtctctaagttatggtgttgaacatttggtgagctcttagtggcccacacttcagacacgagggtttctccatgaaatttacattgagttgtccatctccatcttatatggcttcaggaacagagctgctcttgttcttaatgatttcactggagaaaattaaattggaagaactaaaagaattcagggtccagtccagtctaccagtggattataagtactcaaagataatgaacagtggttcaatctggtaacaggtgtactacagtttttcttttcaacatagtttttctctttataggagtctctatttttaccaaagataattccagtaggatgaactcttttgcaaaataggttgagtctcaccgaacttgcccagattttttacctaagtgcggcaagagtagcgatggaccatagaggctctttttaaactcccctttgctggaagtttttagtaagaatctcagattaaacttccaaaaacctcttgagactaagaagccaaaccaaggccaacttcagactttgcctgcattccctatgggtttattctatgtatattctcaaatataacatcccagtcaaagccttggtaatataaccaatgttttcaaatgtgtcctgttataaagagagcagatccttactgaacttgtgcagataactttattaccataaacatatgaatactcctgaatagtttcccaattctggggcacttagggagcaaaagcaaatgtttcaatttttgtttacaaaagtatactttaccaattgctgaagaaaaaaagtgcataaatctggagaataaaacattcaaagaatcagcacattttcaaatagaaaattatgaaaacattgttttgactatttagtccaataaaattgggtttttttctttgtcttgaatttcatgaagtatcagcctgttcattaaaattttgaaagttcttagtccagtggtatgatcttgaagttatcaggaacttgtattcaagagtccttgtcagagtcttttcataaatctccttgaacaaaaagcaattttggactgtagctgatggtaaatactttgaggaagaatgaaagcaactgtctgggaatgacaaagatttaaaatgactatggttaaaaatctaatgagaatttattatggtaaagacacagctcacaaaatctagttacttctgtggcatatgacactatgataacatatttgatttccagaaatttcatataatttttagaatactcattaaaaaaattttttttttgagacggagtctcactctgtcacccaggctggagtgcagtggtgcgatcccagttcactgcaagctccgcctcccgggttcctgccattctcctgcctcagcctcctgagtagctgggactacaggtgcctgccaccaagcccggctaattttgtttttgcatttttagtagagatggggtttcaccgtgttagccaggatggtctcgatctcctgaccttgtgatccgcccacctcggcctcccaaagtgctgggatgacaggcgtgagccatcgcacccagcctagaatactcatattattaacattcccataaatattatttagaggaggtttagcatcacttatcacttatttgaaaatgctttctatataatttaacttatcaaataaagtggcttttccattcagcttctgtttgttaactggattactgagttcttggtgtagcccattcataaatagggccaaaaaagtatagtcttatgtatgttgaaaaaggtccttaggtaattccagtacttccagctgaacatcattgatttagttttaagttctacctattacaacaagagttctccatccttgttacatgttagtagtgtcagggaagacttaaaaattaccaatgcctgggtccctctccagacctttaaactggaactaatgggtggggcttgagcatccacttttaaaaatgttttccagtgattccaatgtgtagctctatttcccatcagatttctctgatttcttgtggcattcaattttttctattttggtatcatgattattttcaggtctcatttcctgtcttaggctttatgtctcctggcgtagggaccttgccttcatcatttctgtatcttttttaaacacatgaactggtcatcaggaaaagatctcaaccacacataggttgtgttctgagtctcaggttcacatgttaatcctaaagtcttagttctccacgaggtcagatgttgcttgtgatgaagggtgtggttaagtctgcagtgcagatggtagaggggatttcactctgttttcagacatagcattggaactaagaattttatatctatatgggtgaagggacaggggtgtgtaggaagacagttctaattaggatggaggaattatactaggaagtagcggtaaaggaagtgagaaggcttagtaaatagaagaaatgtgaacttatcaaagtggctagagtagacccctggagattcttgattaagtgaattaactagattttagaaaggtaatgaggcagtcatatgcaaggaagatttcaaagtctggagacaagaagtcaagcaatactttgagaagtggttgagctttatgggaatggagagaattacactattgagagatgttaaaaataatgaagagggtttcaccatgtgaaattgtgtttttcatttgaatctgagaaacaaatgagcagagagagaggctggagataattatgtctaaaagacagtggggtacagggagcataaaggccagggagaaagggaactgcaggaattagtgctgagaagcaggagttagtggaggaaggaggagatccagtcccagatacaggcaaataagtcttttccctctcccaagcatggcagttagccctgcaggaaccaggataagaggaaaggtcatcatacctgccagtcttcctgaaatacagaaatgacatcacggctgctataatggattaaggccaggaagatgtcctgttcctgaaggagctgtcatggaaaaaaaagaaaagaaggaatgaagatgatgttattttacatgggggagcctcaggaacaagcatgtaacatgaggtactctataattgtttcttcaaggactacgttatttctgttggaaaattgataggagatgattatattcttgcagtttttttttccctctcaccctgtttctcagttggtgatcagtcctctgtcaattctctactgtgctcagatatttggaaggctttcagatgtgagaaaggctgattgctattttctatgtcattagaacttgccacctttgcaccttttcatggttgcatctttttctcagtgtctctgttgtggcagtcatgaatgagaccctgccaggtctccatggcagagacttgattgacagaaggcccaggtcagtgcatttcaaattcaccacctcctttgcacagaaagcttctttcctacaggctcccagcaagggcgtgaaagcaagtctagttctctgaggctctctttaactctaatgggtgactggttggaggattccccatcagccttgcaaaaactcttataattgaattggtacctaaaacttctttctctttctttttcacaggaatcagctctgcatagtggtctgtgggttctcccgtactaccttcatgcctgccccacattccctcacaggtgtcttccctgataagttatcttgtatgtctaatcccatcttggatgcatctcagtcagtaaaaactaacataccaggcttgattctttgcacttagctttttttctttctctcccacaagtagtcagtaaccatgtcctagtgttttatgtgttacctctttttccatatatatatatatggaaaaaggaaggtactgttgaggggcacttcctatgtgccaggccctgtgctaaatactttccctgtatctcatttaatccacacaataaccctgtgaggtagacattatttccattttgccgatgaaaagacagaagcttagagtggtgtaaaactttcctggtgtcatatggctagtgacaggtggatctgagatttgattctaggactatttgacctctaggctaatgatgatggtagtcatatagcagctgacattggttccactgtgtgtggcatctcgttttattgactgcattaaacctttaaaagaaaggtatgaagaaagcactcttattgcagttttcaggtgaggtatcagaggttcagagaaattgagtcttgtgcaagaaatttataactgtaaactcttacattaaaaaagaagaaagatctcaggtcaacaacctactttaatacttcaggatatgaaagaagaacaaactaaacccaagcacagtgaatgagggaaaaataaggattagagtggatataaataaaatggagaatggaaaaagaatagaggaaattaatgaaaccaaaagttgattcttcaaaataaaatcaacaaaattgacaaccattaactagattgactaagaaaaaaagagaaaagtttaaaattcctaaaatcagaaatgaaaatggactctgagcatggtgggtcatgttttaatcctagcactttgggaagtcacagcagaaggatttcttgagaccaggtgtttggaccagcataggtaacctggggagaccctgtctctacaaaaaaataaaaaagccaattagctgcgcatggtgacatgcacctgtagtcctagcatcttgggaggctgaagaaggagaattacttgagcccaggaggttgaggctgcagtgagccataatcacaccactgtattccatcctgggctggcctacagagtgagagcctgtctctctctcttcaacaacaacaaccaaaaaaaaaaaaaaaaaaagaaaaaagaaaaatgaagcgattactaccaattctaataaactaatgattatgaaagtactataaataattgtatgccaataaattggataacctagatgaagtagacaaacccctagaaacacacaaaaatatgaatggaactataatcagtaataagattgaatcaataaaacatttgatgaaattcaatattttttcataataaaaactttctaagaagggaaggaaaccacctcaacgtaaaggcaatatgtgaaaaacccaatgctaacatcatactcaacggagaaagactgaaagctttccctgtatgagcaggaacaagacaagggtgcctgcttttgacacttttattcaacatagtattgaaaggtctagtcagaaaaattaggcaagaatttaaaaaaagacgttaaaattggaaggaaggagtaaaattatttctgtttacagataacttgaacttatatgtagaaaatcctaaagatggaacaaacctattagaattaataaataaattcagtaatgttgcacaatacaaaatcaacattcaaacatcagttgtatttcaatacactaaccatgaacaatctgaagggaaattaagaaaaaaaatttcaatttatattaacatcaaaaagaataaaatatttaggaatgagtttaaccaaagaggtaaaatgattatacctgaaatctacaaaatatggctgaaagaaatgaaagatgacatcaataaattgaaagacattttgttttcatgaattggaagactcaatattgttaggaggacagtgctacctgacgtgagctgcagattcaataaaattcctatcagaatctcagtgacatttttgcagtaaaaaaaaatctgtcctaaaatttatattgcatctcatgactctaaatagacacacagctttgaagaggaagaatgaagctggaggactcacacttcctgatttcagcatttactacaaagccccagtaatcaatacactgtggtactggcataaaggaggacatagaaattaatgaaatataataacccagaaagaaatgcttgcatatatggccaaatgattttcatcgagtgtgccaagatcgttcaatggggaagggaccgttttctcaccaaatgatattgggaaaggtggatatccaagggcaagaacagtggaacctttacctaacaccatgtacaaaaagtaacccacaatagatcaaagatctaaatgtaagggcaaaaactattcaactcttagaagaaaagcttcatgatactggatttcacaatgatttcctggttgtaacaacaaaagcataggcaacaaataaaatggataaatcggacttcataaaaatcaaaaccttttatatatcaaagaacactatcaagaaagtaaaaagcaacccacgaaatgataaaaatatttgcaaattatatgtgtgataagaaattaatttccagaatacatgaaaagctacaagtcaacaacagcaaacatccaaaaacccaattaaaaaatgaacaaaggattaaaatggagttttctccaaggaagatatacaaatatcaaataagcccatgcaaagttcctcagcatcaggaatacttggagatatgcaaatcaaaaccacattgttacaccacctcacacactttaggatggttttgataaacaacaacaatgacagcaacacaaaacaacaggtgttttcaagtagatggaaaaattggagctctagtgcattgctgatgggaatgggaaatgttatagccactgtaagaagtggtgtggctctctctcaaaaaattaaacaataaattaccatttgatccagcaattccacttctggacataatccccatagaattgaaagaaatttgaacaaatatttgtaaactgatgttcagagaagcattactcacactagccaaaaaatggaaacaactgaaaagtccattgaaagataagtgggtaggcaaatgaggtgtatctatacattgaaatgttgttcaaccttaacaaggaataaaattccaatacatagtgcaaagtggatgaaccttgaagatattatgctaactgaaataagccagacacaaaaggataattattatataattccatttataaaagatagttagaatagccagttacatagagacagaaagtagaatggtgggtgctaaggtttagggggagaaggagtgagagttactgtttattggctacagaggtttaatatggtaagaggaaaaagttctggaaatggatagtgtgatggttacacaacactaaattgcacacttagaaatagttaatggtaagtcttatattagatatatataaagtgtccagtagtcttaccctctctataattacacactttttggcactgcccctttcctgccatgcagagccctaggggtgaatctccctatttctccagctctgcatcagtcactgtcctccgtgctgtgtcccaggtgctgtgcccacagcctcatacagccggtgacttcagagccaggacacagctcaggagtctgccctgaggctccctctctttttgtttccctgcagcctggcccgggggaggcttggcttcaactggcaactcgatttagccaaattcaggacaggccaccagggctctttctccacagatgctggtcccacccaggtggagtcaggcagggccagtcaccagaggagcctggagcagagcaggaagcagagtctgagctgctcctccctcacccaaggggcttcctcctctcatctgggggaaaagtgtcagcttgtttcaaagcctcggatgttccttgtagctcatagaataggtacaagaaaacaaagacgtggcagaaggggatgtgttggtgacagcaagaagcaacttgatcttgaggactctccttcttgtccctctctgaatcctcttctaccacatagggctcagggctgataaagcccgctccgtacctttctcaggccagacacaaggtcagccatgagaaaacagaaaaacaaggagaagagagtctgtagagacaaattgggagggttcaggaggagaatttgggatttgcttgtgcccatgggacacaggctgggaataaaaatgttttcctgactcttctctgaaagccagagagactccacctaaaactctattgccaagcatgctgggatccacttaccagagactttgactgtcatggatttggagctttccatgccagtggctgagttacgaacagagcaagcatagagcccgctatgctttgtagtaatctgggggataaagagcttttgtcctgatagctgaaacttcccattaattgtccaagaatattctgctggtgggttagagtccgcgaagcaggacaagtagaggttttctcctgaatggtaataggtgaatgaagggtaaattctggggaggtctggaccatctggagcaaagagaataaagccacaggtgatgtcatccgagggaaggggatgctcctggtctcttaaagggacacagtgaccctctgagccaagacacaccctcaagtgccagccaaaccccctctatgttcactgagctgaagcctgaggtattcccctgtttctcccatcacaagctgtgggccccaagtctcccatgacaagagcgtcccctccccttatattcttggttaaggctgtgcctacccagatcttcccagggcaggaagttatggccagctcggatgtccagaagtaatggtatctatacttggaccagagagagagtgagaggcctggcctctggtcgttttgatttaagctggtgtcctggcccacagaggaacaaaagatactcacagaggacattcagggtgactgggtaactgcggatgccaccatatcggtcctgtatttcacattgatagggtcctgtttcatttctcgtgacactgggtagaatgaggatcctgttttcaatgggtcgctttaccctgggactgaccgggaggctctgaccatttagccaccaaatgtaggtgtagttctcactcttaggttcacaggtgaaggctaagacatccttattctccctggggtttaagttgttgatggtgatgtagggcttgggcagcttcgctgtgtggataacagagagaagattgtcctgtgtggcacctttgattcctccactggcatccttcaatcagagttggcatctcccacctctcagcccacccgagtccttgaaagccaatagctggtgcgtgtgtcacaagacagatgcatgatgatctaagggctcaaagactgtgaggccagctgctctgtcttagggaagcacagactttctcaagtgtcaattgagcagcagtgttgggtcatggacagacacgtcaatgggagtcacagcccctggtacccctcccagtccctccataatcagttgactggctggctcaccctgggttccttacctggaatgtgcaactggtgggccccttccaaattccatcctactttgcccccatagatgtgatttctctgcaacttccatttccaaggacattctagagatgagtaataatgggacttcccatggccctgaaaccctgaagatactgagcagcctggcctgggactggatgtttcagcagaaataacacaggggagaccagaatcaagcctggaggtcagttcagtcatcaggcagtggaggctcaaggtggggcagttttttgcaggtgtttcatgatgacttacttgaaccagtgacctctaaagatagagcagagtgcaaggaatgatctagaaagagtgaaggtgacaggcaagagctggtggctttggagcagaagcatgttccctgtcttgggttctttaagtttcctctccttctgcagagggcaggtgaggaccatgtggatctttccagaaatacatgtggacatttgcaaatgcagcactgactggtggaaagggtgggaatgaactgctggaaatctggtcctcatggaccatatgtgtttgatggatatgagacaaatttggagagaagttttgcaaatattttctttcattggacattctactcaatgattccatgggttcgactactctagggacctcatgtaagtggattccagagtgaatatgagaagagactgctggttgccaggagctgggagtggggagaatcagaagttgttcatgggtgggcagtttcagttattcaaggtggggaggttctagagatctgctgtagagcttgatgcctatagttcacacagattgagtatttcttatgcataagacttaggacaaaaagtgttttggatttctgacattttttgattctgaaatatttgtcatatacttactggtttagcatcccaaatctgaaagactcaaaatctaaaatgcttcagtgagcatttcttttcagcatcagattagtaggcaaaagtgggaggtgataagccaaagatattcttgccctttttttttctctcaccacttttctagcttggtgattagttttcggtgaattccatactggccatgctgcacttgtatatttttgaaggccttgggatgtgagaaaggctgattgctattttctatgtcatcagaactttccaccttttcatggttgcctctttttctcagtgtatctgttgtggcagtcattaataagagcctgtcaggtgagatttaggacagtgttttctaattctgcaaaaaatgttactgggattctgttaggtgttacattgaatccgcaactcactttgggaatattatctttctaacaatattgattcctccaatccatgaaaatgaaatgtgtttccatatattgatatcgtctttaacttgtttcagcaatcttttgtagttttcagggtataatcatttgactttttggttaaacttatttcaaaatattttattccttttgatgttaatgtgaactgaaattctttccttaatttcctttcagattgttcattgttagtgtatagtctaaagaatgatctagaaagagtgaaggggacaggcaaaagctggtggttttggagcagaaacatattccctgtcctgggtttttgattttccctctccctttgcagagggcaggtggctcttccctgatagctagatagacttcactggaaaacatagtgccaatgctccagggatccacttaccagggactatgatcctcttgattatgagatttgttccagcagtggctgagttatggatgaaacagacatagacccctctatatgttttagtgatttgggggataaagaacacttgtgctgattgctggaacttcccatcaatcagccaagaatgctctgccagtgggtgagagtctgtgaggcaggagagcttgggggcttcccctgtatggtaataggtgtatgaggaggaaatggtgggggcatccaggccatgtggagcaaagagaataatgtcataggtggtattgtcagagggaagggaaaatcctggtctgtggaagggccacagtgaccctgtgagccaagttgcaacactgaagtcccagccaaatccctgctgtgttcactgatctggagcctgagacagtcacctgttttgcccatcacaagctgtggacgctgagtctcccatgacaggagcagcctcttttctcctattgttgatcaagcctaggcctactctggtttgcctggggcagaaagtcatggccaggtttgatgtccaggggtaaaggtctctgtacttggacctgagagggactgagaggcctggcctctggccacgtgtatttgggatggcagactggctcacagaggaacaggagatactcacggaggagattcagggtgactgggtcactgcggctggcactcactgggttccgtatttcacattcatagggtcctgcagtgtactttgtgacaccaaatagaaagagggtccttttgtttttggacaactgcaagctgtgagtcatagggaggctctgaccattcatccaccacaggtagcttgcgtccggagtctcaggatcacaggttaagctcacagcctccatgtcctccctggggtataagttgctgctggagatggagggcttgggagtctccactgtgcagaaaacagagagaagattgccctgtgtggcacctttgattcctccaaaggcatttttcaatcagagttggcatttcccacctctcagcccacccaagtccttaaaagcccatggcaggtgtgtgtgttacaagacagatgcatggcaatctgagggctcagagattgtgaggctgcctgcttcgtgtgggagaagcacagactttcttaactgtgaattgagcagcagcattgggtcacggaaagacacaggaccagcagtcacagcccctggtgcctctctgagtccctccatctcgaagtgcctgcctggcccaccttgtggtcctcacttggagcatgcagtgctggaatcttcttagtttcagtcttactttgccgcccgaggtatgttttctctgcagcttcccttgccaaggacatcctagagatgggtgatggaacttccaattgtctttaaaccctttggatactggaaagcctgacctgggactgggtacttcagcagaaataacacaggggagaacagagtcaagtccggagttcagttcagtcatcaggcagtggagccacaaggtggggcagttttcccaggtgtctcatagtggctgacttgagccagtgacctctaaagatagagcagagtccaaggaatgacctacaaagagtgaaggggacaggcaagagctgatagctttggaccaagaccacgttccctgttctgggtccatgatgctcccttccccctgtagagggcaggtgaggaccatgtggatctttttggaaatacatgtggatgtttgcaaatgcagaaccgactggtggaaagggcgaacatgaacagatgatggaagtctggccctcatggaccatatgtgtttggtggatattagaccaatatttgggaagaagccttgcagatactttctctcattagacattctactctctgattctgaatttgactactctatgtacctgatatcagtggattccagagtgaatcagagtgtagaatagtagtttccaggagctgggatcaggggaatagggcgttgttctgtgggtgtgcggtttcagttatgcaggatgaggaggttctagagatctcctgtacagcttcatgcctatagttcatacagataaagtgctccttattcagaaagcttaaaaccaagtgttttggatttctaattttttttattttggaatatttacagtacatgtactggtttagcatcccaaatctgaaaaatttaaaatccacaatgcgccagtgagcacttctttttagcatcacatcagtggtcagaagggttgagttttggagcatttcagattgtggatttctggatttccgatgctcaatttgtaatactgtaattttcccataaaaatttgtcaggagtttagaccttatgttctgactctagtaacaacaacagcaaaaaatttggaggaaacattgaaatgttttcataagtggaaatttttactgatgatccaaacatctaagatcaattgctggtagtagtatttctcttgagaccaaaataaggtttaggtgtgccgtgaattccagcaggatcacattatgctcaaagaaagatgccaaaggtgatttgaaattagcaactccttaagtagagagagtcccgttaaaaggacagaactggttagtgtgtcaattgcataaagggaggaaggatgccaaactaaaagaagtgatgtgtgttatgttagtaaatatagaaagaacctgcttctaatttctgtgcagagttaggaaaaatggggaggaccccaaaacaggtatgtgaaatgctttcttcattttctcttaagctcaggaaacaccactagtgtttaagtttgtgtgaattagaaagagtctaagtgagatgccaatggtttgtgtgtctccccacacgcagaactccaacttatgaaaacggcatcatcatgaggaaacagttgtatgtggcacaggcagtaaagccatcagatagcacccacctggccacctccacctggtccccaaaaccaccagtattcccattacgtgtatcttatagcctttgtagttgtcccacagctacaaaatttaaaaattgctattgtcaaatcaaaatattaaatatgaagttgaaatgttgttccactttttttccccactcttgttgaactttcctgtttcagttttggaagtttctattgacatatcctcaagctagggattctttcctcagctatgttcagtctaccagtaagtatcaaaagcattcttcatgtctctaaaaacatttttttttttctgagacagagtctcgctctgtcacctaggctggagtgcagtggcatgatctcatctcactgcaagctccacctcctgggttcatgccattctcctggcttggcctcccaaatagctgggactacaagcgcctgccaccacgtccagctaattttttgtatttttagtagagacggggtttcaccatgttagccaggatggtctccatctcctgaccttgtgcctgcctcggcctcccaaagtcctgggattataggcatgagccactgtgcccagccatctctgagggattttaatgagttgttgacttttgagtttgttcagctttttacttagtgttagaaccgaggaacaaatttcaagcttgttatatgcctgacaggaagccagaagtctctaggaagtgaccggagaatgtgagctttatagcaggttgaggatggagtcacaagtgaaatgggtgaaatgagcccatggggtttggggactgcaggcctgtccagcctctgacactctggtgagtcagtgctaagattacaacagtgacagcaaactagcatggctgagtccatctggtatctagtctcaggctggctgtcctcactcattcctgggcataggccaggctaaccttgggaggaatttagtttattgtttaactttgaagcaagaatgataattgttcctctgtaaaagtaacacccttactttgcccagggactgcctttgtaaaactagtgaaagaccatgagattaagattataggagggaactgaattctgctaaaatgttggcagagtttttataatccttgactgctcaaatgtcgttgggccagagtttacaaaatttgtaactaattgctcctatagataacatcactattgtagaacgtgagattggtcttttgagatgtttctcattcttttgcattctggcaaccggctgacctcatccatacctatgactaatggctcagcccgtcatgtggtccctacctagaggtggattcaagcacaaacagatcatttccctccgcccgcatgattccatcaccaatcagcagtactcattttttagtcctgtgcccctgaaactatccttgaaaatctctaagccctgatccactggggaggctgatttgagtaataataaacctccatcctcctgtttggcagacttggagtcattaaaatctttctttactacaaaccaccatttcaatacatttgtgtgtgtgtgtgtgtgtgtgtgtgtgtgtgtgtgtgtgtgtgtgtgcaggaggccagaagaacttgtctggcaattataagagtggatggagaaactgcctatccctgtcccatggtcttgtccacaggtcagcctcacaaagggaaagagccctggatgggaatacagtggaaactcattctcttagtgacctggggacattggctctagaggaagcctggcaggagtggcaactccaggtgatttctgcacctttcctatttcctgggaggtgggccaggccacagtgttagcgggaagggaactgaacagtcagcctagttagagggagtgtctggggaagacctaggggtgggggaagaagctgtgcaggacagggcttgccagtcagaatgaagtgggaggaagatgagggacacagagaagcagagagaggcagagacaccatggcagtgagcagtgagggctacactgacttcagagaccccagggaccaggtgcccccagttccacagtccaggaccaaggagccctgagaaccctccggtggccaaagagcttcagagttacatgaggtggggttgctttagggtcaagaggtagtggggggatgaaacgtgggtgtcagcctctgaaggacaagggacaggtgtggctagaacctcctaggattctgcatgcaaattcagtctctaaagaggttttggatcattcatttcttcattccatttcttcatttgttatgtaagagctcctgagtgtgtctgtctcgctgggcctatggtggtgtagggtgtgagtggggaaagaaaacaaggtcctctccttgatcctcttgtgacagtgacatggacactttgggaaacacaggatttcaggttcagtgatggtggttaagatctgagggggaggcctggacatgttttttccactgactctgacggttgaggtaggtgatttagttctggaatacagactaatcagttgaccgtttgctctcactcctctgaggtttggatgcctaagaagagaggatttgagccaataaatgactatagggtgattggaacccagtaagccctcacttctggtggaggagagggtgggcctttggctccagacacacctcatgtgaccctgatctcccctttgtgtttgtgtgactctggttcagtgactgtggcttcctgtgcctcagttttctctcaaacaaataagctaaatggcaaatggactgtggcttttcatgctatctgtgaataaatgttaaatgattcacagtcacgtgacctaattcttggcacagtggaggtttcacacaaacagcatttattattaatttgcttccatgagaaagcacctttatgtcagatgcctgtggacaagctgctacctggtatatcttctctcctctgtttctgcttctggggacattagactttctatggactggcctaagcctcctaaggcagttgtctgatggcctacaaagcttgtctttctgtcctctccactctgagtgtcaggtgaagaaagctctgtccttgcccagatgaggctctgagggctgagccctggctggtgaacagctccaggagacacagtcctctgacagctggtaaatccttggtcccagtaagccctgcccaagaagcgacaacccagccccagtacaggctcctcagatttatctggagcaaggatttagggacatggttctgggggtgaggcttctagggctgagcttctctgagagtatttcatggggcccctgaggccaagccctactcagtttgccagggtctttctcagggtcaaatttatgaagagagcatgaggtgcttggctgagactgatctcctcctgctgagtccccccatcagactgtccttcctctgcagcgagtgtctgcagggtctggatgcgggaaaggaattctgatctgttgaaatttgtctcttctgtgtgtgtcctgcactaaatgcccaaaccccagcatgggacataatgcagagagggacacaggcacaatccaggcctgacaatcctttgtgtgtgaagtaaagaccccatcccccaacacccagtgatcacgtggagtcactcacggtataaggtgaaggtgaaatgtccagtttctcctctagtcccatcacctcgctttacgatgtgtaaggtgtaggatcctgcgtcctcccgggtgacattctggatcagcagggatgcattggaatatactgtttctcgtccactgtatgcaggcccatatataattatttgaccatctactacgtatgatgtaatgtaatggtagaggtccttcatttgccctttgtaccagatgtagccagcaagattctggggcaaattgtggacaagtagaagaacgtccttccccttggaaactttggttggctcggcttcaatcgtgacttgggcagtggtaggcaagttccagaagtttaaaagtaatgctaggaggtggagagagcatcagtcaatattgagacctatgcattggggtgaaaagatgtggccctgggtcctgagaaggtctcttcaatcctcagctttgaagagacacacacacacacatacaaacacacacacacacacaaaaggggcatgtgtatatgtgtttgtgtcctactctcctactaggtgaaggtcagcaacatgacccccattccttcaacacttctgaccttggcatttttctgtttggaatcctcttccccaggggtccgcacggccccctccacactgccctcaggtcctgctcacatcagggcatccttagacttctttcctgacgcctccttcagagaccctgggtcttccctttctgacctttccctgctctgctccctccagggttcttctcaacacctgacctcacattctagaactctttgcatgtctgtcttcccccccatgacagcgtgagctccgtgaggacagggacttttgtgatcttctttgcaccccagtgcctggaacaggctgcagactcctgtagatgtgagagttctcagggccctccatgccctgggtgttttttcttcccccagttgttgaggtttttttgctgaggacagtgtttcatgccctgcttatatttttatttgaagtgtcatctgatatagttattattatcatttttcaaaatgtggtggcccctgatgattaatcaggaaaacagaacacttaagattttcctacctcttaccaattctggttcctgtgactttcctgttttgacccctgtccctcttgggtgtattttcccctatccaggctccaacagagacttctttcctttttttcttttttctttccattcttttttttttttgagacggagtcttgtactgtcgcccaggctggcgtgcagtggcactatctcggctcactgcaatttcttcctcccgggttcacgtgattctcctgcctcagcctcccgggtagctaggattactggagcacaccacaatatctggttaaatttttgtatttttagtagagacagggcttcactgtgttggccagactgatcttgaactcctgatctcgtgatccaccctcctcagcctccctaagtgctggcttcttttattttttagaaccccaggagtctctccaggagaccccatccagtcactctgcttcctcctcctgtcctctcccaggaagttctctcctcacctgtgagcaggagccccttccaggtgatgcgctgtgtgcagggaggggctgagaggggccccatggtctctgctgcctgcgtgttctcctctgtggagctgagcctaggatccagaaacttcctgagcatggctctcagctgtgctgtccttcctccttctgcgctgagcctcttcccggggcaggagcacttctcaggttcatgggcggggtcaggcccaggacacctctctgtcccctcctctctcagtcctgcctccttgtccctcctgtttttccttttgtctgtgtttcaggtccctgggaattgtggaggcctctgcctttttcagcagtgattctttcaccaagcctcatcacacactttgtgcagacacacacacacacagacacacacagaagagacacacacagacccacacagtcagaaacataccctgcaggttgggcaagcagagtcctgggcctcagcctcctgctgtccccatggctctgggtcggggtgcacattcatgccctttggcctctttcatccccatctggctctccccttcagtgcaggaggctggagctgaaccaggtccctgtcacagtgacaccccattgtgctgtgggtgagctgtgtgttgcctgatgagagggaaccttcctttttctaatcgtgtctagcttggctgcagcttccaaggatggacattcaggacctgggtgtcccagaggaaactgtccttcctggaggtgtgcaggatgaatctctcatgcctcttgtgaggagaggcctgtgctggttgctcagtggggggctgtgagtcccatagtcaaagggacagttctcggtcactctatggctccctggggtctggcggctgagctggagctcatggtttctcatgttcttcctgaccatctttgatgtcctctcttctctgcccagcttattgtcctgtggtcaccacaccttccccgtggtggtgcaggaggaagtggggagttacccaggaaccccgggggacatggctcattgagatgcaggagggggagcctgggacagagcaggggttcagagctggagagattcatcccaacttactctgtggccatgatgggctcagccatccatgtgccgacatacccaggggtctgtcctgaggtttttgacctggccaagctgctgtgtgtagaggaggaacaggtagtggccagagagcctgtctggagggacgttgctcacacctgagtgggcgtgtgggggtgagttgtgttctgggagcaaagagcaataacatcccccttctcccagcaagcacacaggagaggtctgtcttcccaagggacagctgggggtaggtggccacatcccggatggtgcctgtgtgtgagcatcacacgtgctctgagccccccggggtgcagggagcaggcaggacacagggtgcctggctgattcccggggaggctgtgggccctcaggcagccactgttctgtgtcagtgctaggcttggcctgggatgccccagagaacaggacagatggagcaggggcaggcatttagggagcagtgacagaacgagttgatgaggatggagggaggccacgaggggaaagcacccagtgtagtgtcgcgtgcaccagcactgccctgggagatgcctttagctgggcccagggaaggagcaggtgtgtggggaggagctccctgcagggggagtggtgttaggttggcggcccccaggtcagggaggagctgacagagtccgtgtggggagcatggagggcgctgaggacttgggccgaagtgaccctggtgagggtggaccctgctgggctgtgggttccgttgagggcggttggcatcccctgggaaggctccaggctgggagggactctgtccccctctggtggacagggagggaaatgtgaacggcagcaatcccaggccaggctgcatgttttattccacatggatctgcacacttcacacgaggtcacacatatgttatgttatagctccttcaccttccagccccgtgagtcccagtctgtgtggctctatgttcactgttctccctctttcacaatcagatgtcccaaatgcagatttttgtcaccttctgtgagtttgtgtttgtgtgcagtaggcagcactgtgtataccctgggggcagtgatgtctggggctgagcagtgcacatgggcttgggagaagaagagggagcagcagggtgggaagatcaatgtcaggggggcaaggacaagtcattttcattttctcactcccagggaccagaacccaggattctgactccagggcacagtaccacaccctgctggtgtccctggatgtcatgatgctcatagtgtcatgttgccttgtcattcatcttttatggtgtaagtttatttgcctcaaatcagaggcagggcttggtcaccaatgcagtttcaatactgtatctggttcaggtggctccagttggtgtgcagagataaaatcttagaggcatctctcctgcttggtgtgctgggtttccctctctccagctgctttctttaaactgataattctgacatttgccctcacatttaaagtgaccacctctcagtcacagcgtgagcccctggtcccagtgtttgctgcttgctttgaacacatccattaaagctccctgctggaaacctgtcagataacaccctggacttaataaagccattggcttaccggtctcttctctcctctctccatgggctcactgacctctgtgtctgtggtctccaggtgtgccaagtgctccccagtgtctgtaagtagtaaaaatacttacactttcacgttgtggttgtatcactgtggcctcacatgccatccagggtctgatattgaggctgccttatgggacctgtgctggttgagcccctgctggagctcttgttttggggcgtctggttctgctggggacaggagcttccagctaacttgattgaaaatctgatgcctttcattgaaacactgggtcagatgatgtattcatgggcttcagctgccataacagacaccttagcctgggtgaattaaataatagaaatctatttttcacagttctgtgaataatgtgctattttaaccactttaaaatgcataatcaagtgaaattaaccacttacacagtgttaaattaccatcaccagtatttttcctagaaaatttttatcattttaaactgaaactttgtatcttttaaacaataactccctgtatgttccaccttagaccttgatcttctctactctgtctctatgaatttgcctattcttgatgcttcatataaatggaattatacaattatgttattttgtttctgacatatttcacttagcataatgtttccaaagtccatgcatgttccagcgggtgtcagagcttccttcctctttatggcagattatcattctgttgtatgtgtcaccatatttgtttattcatgtgttgatgaacacttggattgttttcatattttatcttttgtgaataatgctgcaatgaacattcccatgcaagtacctgtttgagtccctggatttaattctttgggtatatacctaggaatagatgttgtttcaaatgagaattctatgattagcttttttttattattatactttaagttttagggtacatgtgcacaatgtgcaggtttgttacatatgtatgcatgtgccatgctgttgtgctgcacccattaactcgtcatttagcattaggtatatctcctaaagctatccctcccccctccccccaccacacaacagtccccagagtgtgatgttccccttcctgtgtccatgtgttctcattgttcaattcccacttgtgagtgagaatatgcggtgtttggttttttgttcttgcgatagtttatgagaatgatgatttccaatttcatccatgtccctacaaaggacatgaactcatcattttttatggctgcatagtattccatggtgtatatgtgccacattttcttaatccagtctatcattgtttgacattttggttggttccaagtctttgctattgtgaatagtgctgcaatatacatacgtgtgtatgtgtctttatagcagcgtgatttatagtcctttgggtatatacccagtaataggatggctgggtcaaatggtatttctagttccagaatcgccacattgacttccacaatggttgaactagtttacagtcccaccagcagtgtaaaagtcttcctatttctccacatcctctccagcacctgttgtttcctgcctttttaatgattgccattctaagtggtgtgagatggtatctcattgtggttttgatttgcatttctctgatggccagtgatggtgagcattttttcatgtgttttttggctgcataaatgtcttctgttgagaagtttctgttcatgtccttcacccactttttgatggggttgtttgtttttttcttgtaaatttgtttgagttcattgtagattttggatattaaccctttgtcagatgagtagatttcaaagatttctcccattttgtaggttgcctgttcactctgatggtagtttcttttgctgtgcagaagctctttagtttaattagatcccatttgtcaattttggcttttgttgccattgcttttggtgttttagacatgaagtccttgcgcatgcctatgtcctgaatggtaatgcctaggttttcttctagggtttttatggttttaggtctaacgtttaaggctttaatccatcttgaattaattttttagaaggtgtaaggaagggatccagtttcagctttctacatatggctagccagttttcccagcaccatttattaaatagggagtcctttccccattgcttgttttctcaagtttgtcaaagatcagatagttgtagatatgcagcagtatttctgagggctccgttctgttccattgatctatatttctgttttggtacctgtaccatgctgttttggttactgtagccttgtagtatagtttgaagtcaggtagcgtgatgcctgcagctttgttcttttggcttaagattgacttggcgatgtgggctctttcttggttctatatgaactttaaagtagatttttccaattttgtgaagaaagtcattggtagcttgatgggtatggcattgaatctgtaaattaccttgggtagtatggccattttcacaatattgattcttcctacccatgagcatggaatgttcttccatttctttgtatcctcttttatttcattgagcagtggtttgtagttcttgaagaggtccttcacatccctagtaagttggattcctaggtattttattctgtttgaagcaattgtgaatgggagttcactgatgatttggctctctgtttgtctgttgttggtgtataagaatgcttgtggtttttgtagattgattttgtatgctgagactttgctgaagttgcttatcagcttaaggagattttgggctgagacaatttggttttctagatatacaatcatgtcatctgcaaacagggacaatttgacttcctcttttcctaattgaataccctttattttcttctccggcctaattgccatggccagaacttccaacactatgttgaataggagtggtgagagagggcatccctgtcttgtgctagttttcaaagggaatgcttccagtttttgcccattcagtatgatattggctgtgggtttgtcatagatagctcttattattttgagatatgtcccatcaatacctaatttatggagagtttttagcatgaagcattgttgaattttgtcaaaggccttttctgcatctattgagataatcatgtggttcttgtctttggttctgtttatatgctggattacatttattgatttgcatatattgaaccagccttgtatcccagggatgaagcacacttgatcatggtggataagctttttgatgtgctgctggatttggtttgccagtattttattgaggatttttgcatcaatgttgatcaaggatattggtctaaaattctcttttttggttgtgtctctgcccggctttggtatcaggatgatgctggcctcatgaaatgagttagggaggattccctctttttctattgattggaatagttcagaaggaatggtaccagttcctgcttgtacgtgtggtaaaattcggctgtgaatccatctggtcctggactctttttgtttggtaagcgattgattattgccacaatttcagatcctgttattggtctattcagagattcaacttcttcctggttcagtcttcggagggtgtatgtgtcgaggaatttatccatttcttctagattttctagtttatttgcgtagatgtgcttgtagtattctctgatggtagtctttatttctatggaatcgctggtgataacccctttatcatttttttattacatctatttgattcttctctcttttcttctttattagtcttgctaggagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgaagttagggtgtcaattttggatctttcctgctttctcttgtgggcatttcgtgctataaatttccctctacacactgctttgaatgtgtcccagagattccggtatattgtgtctttgttctcgctggtttcaaggaacatctttatttctgccttcatttcattatgtacccagtagtcattcaggagcaggttgttcagtttccatgtagttgagcagtttaaagtgagtttcttaatcctgagttctagtttgattgcactgtggtctgagagatagtttgttataatttctgttcttttacatttgctgaggagagctttacttccaagtatgtggccaattttggaataggtgtggtgtggtgctgaaaaaaatgtatattctgttgatttgaggtagagagttctgtagatgtctattaggtccgcttggtgcggagctgagttcaattcctgggtatcctttttaactttctgcctcattgatctgtctaatgttgacagtggggtgttaaaacctcccattattattgtgtgggagtccaagtctccttgtaggtcactcaggacttgctttatgaatctgggcgctcctgtattcggtgcatatatgtttaggatagttagcccttcctgttgaattgatccctttaccattatgtaatggctgtctttgtctgttttcatctttgttggtttaaagtctgttttatcagagactaggattgcaacccctgccttttttgttttccatttgcttggtagatcttccgctatccttttattttgagcctatgtgtgtctctgcacgtgagatgggtttcctgaatatatcacagtgatgggtcttgactctttatccaatttgccagtccgtgtcttttaattggagcatttagtctatttacatttaaagttaatattgttatgtgtgaatttgatcctgtcattatgatgttagctggttcttttgctggttagttgatgcagtttcttcctagtctcgatggtctttacaatttggcatgatgttgcagtggctggtacaggttattcctttccatgtttagtgcttccttcaggaggtcttttagggcaggcctggtggtgacaaaatctctcagcatttgcttgtctgtaaagtattttatttctccttcacttatgaagcttagttgggctggatatgaaattctgggttgaaaattcttctctttaagaaagttgaatattggcccccactctcttctggcttgtagagtttctgccgagagatccgctgttagtctgatgggcttccctttgtgggtaacccaagctttctctctggctgcccttaagattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcacttcatttcattcatttcatcttccatcactgataccctttcttccagttgatcgcatcggctcctgaggcttctgcattcttcacatagttcttgagccttggttttcagctccatcagctcctttaagcacttctctgtattggttattctagttatatcttcgtctaaatttttttcaaagttttcaacttctttgcctttggtttgaatttcctcctgtagcttggagtagtttgaacgtctgaagccttcttctctcaactcatcaaagtaattctccatccagctttgttccattgctggtgaggaactgcgttcctttggaggaggagaggcactctgctttttagagttccatttttctgttctgttttttccccatctttgaggttttatctagttttggtaattggtgatggtgatgtacagatgggtttttggtgtggatgtgctttctatttgttagttctccttctaagagacaggaccctcagctgcaggtctgttggagtttgctagaggtccactccagaccgtgtttgtctgggtaccagcagctgtgtctgcagaacagcggattttcgtgaaccacaagtgctgctgtttgatcgttcctctggaagttttgtctcagaggagtacccggccgtgtgaggtgtcagtctgcccctagtggggggtgcctcccagttaggctgctcgggagtcaggggtcagggacacacttgaggaggcagtctgaccgttttcagatctccagctgcatgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggttccacccagttcgagattcccggctgctttgtttacctaagcaagcctgggcaatggtgggcgctcctcccccagctgcgctgctgccttgcagtttgatctcagactgctgtgctggcaatcagtgagactccatgggcataaggccctctgagccatgtgcgggatataatctcctggtgtgctatttttccagcccatcggaaaagcgcagtattagagtgggaatgacccaattttccaggtgctgtctgtcacgctgggagctgtagactggagctgttcctattcggccatcttggctccaggaccctataattagctttttgaggaacagcaaaactgtttctcctagtggctgtacctttttatattctcaccagcaatgtatgaggattccaaattctacataatgctgccacttgttattttacaatttaaaagaatggtagccagttttgtaggtgtgatgtggtgtctcattgcagctttgactttgtattttcctaatgactaatgatgttgagtatcttttcatgtccttcttgactatttgtatatcttctttgaagaaatgtctatttgagtcttttgtccatttataaattggatggtttctcactttgttattgagttgtagctagttcttgatattatctggacatgaaaactgcctatatgtggtttgcaaatattttctctcattccttgtctattaattattttcttgatattttcctttgatgcacaaaatgctcacatctttataaagcccaatttatcttttttttgtttcttatgcttttgtgtcatatctaagaatccattgcacatttgaggtcattaatatttacctctatgtctattttaagatgtttttatggttataggtcttatatttaactcactgatcaattttttagagaattgtttgatatggtgggaggtagagttatctaaattcactgttttgcatgtggttatctagttgtttctgcactatcattagaaaggagaattgttcctccattaaattgtcttgacaccctcttcaaagagtaattgaccataagtgtgagggtttatttctaggctctcaattctatcccatttgtctttatgtccattcttttgccagcagcttatgtctattctttggcagcaacttctgttttaataattgtactgctttgtgagatttcaaataagaaaattcaagtcctacaatttattttggcaagattgttttggctattcaggggtccttttttgaaaggtggggaggccaatgtttcacaattgggaaagccatttctgtcttcttcatggggaaatttgggagaatcttttaagaaacttaatctaagtaggtaaactgtcaccactttatttgctgaagtgctgtgttaaagtgtgcattgactcttgtggaagaattgtgactctggaagcacttgcccacatggtgagagacagtgaattccatgatgaggggcagagatgatgttgttttgggatacaatgttgttgggggagttgtatacatctctacttctttatgtctctgtacagtgggtgtagggaccagccacacagggtcggtgggtttttctctccatatgcagagatgagagattgtagaaataaagacacaagacgaagggataaaagaaaagacagctgggcccgggggactactaccaccaagacgcagagaccagtagtggcaccgaatgccaggctgcactgatttttattggatacaagataaagtgtcaggataaggagtgtgagccatctccaatgataggtaaggccacaggggtcacatgtccactggacagggggcccttccctgcctgtcagctgaggcagagagagagaggagaaagagagagagagcttacagcattatttctgcttattagagacttttagtactttcactaatttgctactgctaactaaacagcagagccaggtgaacagtatggaacatgaaggcagactaggagtgtgaccactgaagcacagcatcatagggagacggtcaggcctccagataactgcgggtggacctgactaatgtcaggccctccacaagaggtggaggagtagagtcctctctaaactcccacggggaaagggagactctaagtagctttcccagtctgctaagtagctggtgtttttccttgacactgaggctactgctagaccagggcccgcttggcaatgggcatcttcccagacgctgtcgttaccgctagaccaagaagccctctagttgccctgtctgggcataacagaaggctcgccctcttgtcttctggtcacttctcactatgtctcctcagctcctatctctgtatggcctggcttttcctaggttatgattatagaaatgaggattattttaatactggaataaagagtaattgctaccaagtagtgattaataatattcatatataatcgtatctaagatctatatctggtataactattcttcttttatatcttattatactggaacagctcatgccctcggtctcttgcctcggcacctgggtgacttgctgcccacaagtgggcatctccattggacacagtaggttttgaaatccttgtttatcctctggggtctgggtcttggcttacctgttagctgcagctgaaagaggtgtctgctaaggcaatgccacctgtggtgagaagaagggttcagcagagtgaaagcagctggggctcagagaaaccaggaaagtctgactcttagaaactgtgggtcagcagatgggtgtcctcaggggtaaatggaccatgccagtagccactgcagtggactggaagaaggtaagggatgccagttatcgcatgttctctctcagctctgcagctgaagatttgggccctgggttggtaaggccctgcagcaggggaagggtatacaggaatagctgcatatcaggaccaagtccatgtcatcttcttaggcattgttactgcagatggaggattcttttcagagacctggcctggacacatgggagggcccaccccattcttttgaaattattttaagagaacagtattagcaaatgtggtacatgttttattctgctagaatcagtattactgtcacattttacaatgtatctcttaggaaatggcgagagccatccacagaatgtgcatttaaaggggactctattataatttcagctttcctacctcttcatagaaaccatcttatctgcaaacacacgggcaatatctctgtgttcatttctattgggagtcctgtatgcaaggtggagagagccacatttccccctgagatgttatgtaaaagtttgggttgagatgacatatctgacactctattgttaccctcagaagctactacatgtgaaattctaatgactgcattatcctgccaagtgaaagaggcaggcatgagcaaggacagttaagaggggtgagagcctcatcatgatggggagtcttgttctgacatcttgggaaaaactgtccacagtgtgaagtcatccacttgttgtcctggtttacagtttgagcatctgttgttatggtgtcgaacattttagtgagttctgagtggctcacccttcaggtacaagggttttcccatgaaatttacattgagttgtccacctccagcttatagggcttctggaacagagtgggtctttttcttagcgattccatggaagaaaatggaattggaggaactagtagaattcagggtaatgtccagtctacaggtggataataaaaacacagaaacaatgaacagagatgcaatctcataacaggtgtactacagtttttattttccacataatttttctctctatgggcatctctagttttaccaatgataatttcagtagaataagtttgtttgcaaaataggttgagtttcttcaaacgtggtctgattgtttacataagtgcagcaagagtagcaatggaccgtgtaggctctcttttaaaattttcttttctctaagtttttataaggaatctgagattaaacttttacaaaactcttgagaataggaagccaaaccaaggctgacttcagactttgcctgcagttcatactggttcattctatctatatccttaaatataacatcccagtcaaagccttggtaatataaccaatgatttgaaatgtgtcctgttacaaagagagcagattgttgctgtacttgtgcaaatatgtgtattaccataaacatatcaattctcatgaatagttgcccaattctggggcagtcaggtagaaagcaaaagtaaatatttcaattacagttcaataaactgcggtatagtttattgaactgctataagctacagataggttaaaagagaaaaattccgtcaatgtagaaaacaaaccatttaaagaatcagcaaattttcaaatgaaaatcataaaaacattatcctcattattatcaattatttcattgaaatcaatgtttttcctgcttggtctaggctgggaattttatgaagatatcagcctgtttgttaaagttttcaaagttcttagacaaatttggagggtttaggaggagaatttgggatttgcttgtgcccatgggacgcaggctgggaataaaaatgttttcctgactcttccctgaaggccagatagactccacctaaatccctattgccaaggatactgggatccgcttaccagagacttttactgtcatggatttggagctttccttgccagtggctgagttacgaacagagcaagcatagagcccgctatgctttgtagtaatttgggggataaagagcttttgtcctgatagctgaaacttcccattaattgtccaagaatactgtgccggtgggttagagtccgcagaacaggacaagtagaggacttctcctgaacggtaataggtgaatgaagggtaaattctggggaggtctggaccatctggagcaaagagaataaagccacaggtgatgtcatctgagggaaggggatgttcctggtctcttaaagggacacagtgaccctctgagccaagacacaccctcaagtcccagcccaaccccctctatgttcactgagccgaatcctcaggtattcacctgtttctcccatcacaagctgtgggccccaagtctcccatgacaagagcgtccactccccttatactcttggttaaggctgtgcctacccaggttttcccagggcagggagtcatggccagctcggatgtccagaagtgaaggtgtctatacttggaccagagagagagtgagaggcctggcctctggtcgttttgatttaagctggtgtcctggcccacagaggaacaaaagatactcacagaggacattcagggtgactgggtaactgcggatgccaccatattggtcccttatttcacattgatagggtcctgtttcatttctcgtgacactgggtagaatgaggatcctgttttcaatgggtcgctttaccctgggactgaccgggaggctctgaccatttagccaccaaatgtaggtgtagttctcactcttaggttcacaggtgaagtttaagacatccttattctccctgggttttaagttgttgatggtgatgtagggcttgggcagcttcgctgtgtggataacagagagaagattgtcctgtgtggcacctttgattcctccacaggcatccttcaatcagagttggcatctcccacttctcagcccacccgagtccttgaaagccaatagctggtgcgtgtgtcacaagacagatgcatgatgatctaagggctcaaagactatgaggccagctgctctgtcttagggaagcacagactttctcaagtgtcaattgagcagcagtgttgggtcatggacagacacgtcagtggaagtcacagcccctggtatccctcccagtccctccctaatcagttgactggctggctcaccctgggttccttacctggaatgtgcaactggtgggccccttccaaattccatcctacattgtccccctagatgtgatttctctgcagcttccatttccaaggacattctagagatgagtaatgatgggactacccatggtcctgaaaccctgaagatactgagcagcctggcctgggactggatgtttcagcagaaataacacaggggagaccagaatcaagcctggaggtcagttcagtcatcaggcagtggaggctcaaggtggggcagttttttgcaggtgtttcatgatgacttacttgaaccagtgacctctaaagatagagcagagtgcaaggaatgatctagaaagagtgaaggcgacaggcaagagctggtggctttggagcagaactatgttgcctgtcctgcgttcaagtttcctctccttctgcagagggcaggtgaggaccatgtggatctttccagaaatatatgtggacatttgcaaatgcagcactgactggtagaaagggtgggaaggatctgctggaaatctggtcctcatggaccatgtgtgtttgatggatatgagacaaatttgaagagaagttttgggaatattttctttcactggacattctactctctgattccctggattcgactactctagggacctcatgtaagtggattccagagtgaatatgagaagagactgctggttgccaggagctgggagtggggagaatcagaagttgttcatgggtgtgcagtttcatttatgcaaggtggggaggttctagagatctgctgtagagcttgatgcctatagttcacacaaattgagtatttcttatgcataagacttaggacaaaaagtgttttggatttctgacattttttgattctgaaatatttgtcatatacttactggtttagcatcccaaatctgaaagattcaaaatctaaaatgctccagtgagcatttcttttcagcatcagattagtaggcaaaagtgggaggtgataagccaaagatattcttgccctttttttttctctcaccacttttctagcttggtgattagttttcggtgaattccatactggccatgcctcactcgtatatttttgaaggctttgggatgtgaagcctttgaaggctgattgctattttctatgtcatcagaactttccaccttttcatggttgcctctttttctcagtgtatctgttgtggcagtcattaataagagcctgtcaggtgagatttaggacagtgttttctaattctgcaaaaaatgttactgggattctgttaggtgttacattgaatccgcaactcactttgggaatattatctttctaacaatattgattcctccaatccatgaaaatgaaatgtgtttccatatattgatatcgtctttaacttgtttcagcaatcttttgtagttttcagggtataatcatttgactttttggttaaacttattccaaaatattttattccttttgatgttaatgtgaactgaaattctttccttaatttcctttcggattgttcattgttagtgtatagtctaaagaatgatctagaaagagtgaaggggacaggcaaaagctggtggttttggagcagaaacatattccctgtcctgggtttttgattttccctctccctttgcagagggcaggtggctcttccctgataactagatagacttcactggaaaacatagtgccaatgctccagggatccacttaccagggactatgatcctcttgattatgagatttgttccagcagtggctgagttatggatgaaacagacatagacccctctatatgttttagtgatttgggggataaagaacacttgtgctgattgctggaacttcccatcaatcagccaagaatgctctgccagtgggtgagagtctgtgaggcaggagagcttggggacttcccctgtatggtaataggtgtatgaggaggaaatggtgggggcatccaggccatgtggagcaaagagaataatgtcacaggcgatattttcagagggaagggaaaatctcgtctgtggaagcaccacaatcacagtgaccctgtgagccaagtcacaacattgaagtcccagccaaatcccagctgtgttcactgatctggagcctgagacattcacctgtttctcccatcacaagctgtggacgctgagtctcccatgacaggagcagcctcttttctcctattgttgatcaagcctaggcctactctggtttgcctggggcagaaagtcatggccaggtttgatgtccaggggtaaaggtctctgtacttggacctgagagggactgagaggcctggtctctggccacgtgtatttgggatggcagcctggctcacagaggaacagaaaatactcacggaggagattcagggtgaatgggtcactgcggctggcactcactgggttccgtatttcacattcatagggtcctgcagtgtactttgtgacacccaatagaaagagggtcctgttggtttcagacaactgcaacctgtgagacatagggaggctctgaccattcatccaccacaggtagcttgcgtccggagtctcaggatcacaggttaagctcacagcctccatggcctccctggggtttaatttgctgctggagatggagggcttgggagtctccactgtgcagaaaacagagagaagattgccctgtgtggcacctttgattcctccaaaggcatttttcaatcagagttggcatttcccacctctcagcccacccaagtccttaaaagcccatggcaggtgtgtgtgttgcaagacagatgcagggcaatctgagggctcagaggttgtgaggctgcctgcttcatgtagaaacacagactttctcaagtgtgaattgagcagcagcattgggtcatggaaagacacaggaccagcagtcacagcccctgttgcctctctgagtccctccgtctccaactgcctgcctggcccaccttgtggtcctcacttggagcatgcagtgctggaatcttcttagtttcagtcttactttgccgcccaaggtatgttttctctgcagcttcccttgccaaggacatcctagagatgggtgatggaacttccaattgtctttaaaccctttgggtactggaaagcctggcctgggactgggtacttcagcagaaataacacaggggagaacagagtcaagtccggaggtcagttcagtcatcaggcagtggagccacaaggtggcgcagttttcccaggtgtctcatagtggctgacttgagccagtgacctctaaagatagagcagagtccaaggaatgacctacagagagtgaaggggacaggcaagaactgatagctttggaccaagaccacgttccctgttctggatccatgatgctcccttccccctgtagagggcaggtgaggaccatgtggatctttttggaaatacatgtggatgtttgcaaatgcagaaccgactggtggaaagggcgaacatgaacagatgatggaagtctggccctcatggaccatatgtgtttggtggatattagaccaatatttgggaagaagccttgcagatactttctctcattagacattctactctctgattctgaatttgactactctatgtacctgatatcagtggattccagagtgaatcagagagtagaataggagtttctacgagctgggatcagggcaatagggcgttgttccatggttgtgcagtttcagttatgcaggatgaggaggttctagagatctcctgtacagcctcatgtctatagttcatacagataaagtgctccttatgcagaaggcttaaaacaaagtgttttggatttctaatttttttttgttttggaatatttgcagtacatgtactggtttagcatcccaaatctgaaaaatttaaaatgcacaatgcgccagtgagcacttctttttagcatcacatcagtggtcagaagtgttgagttttggagcatttcagattgtggatttctggatttgggatgctcaatttgtaatactgtaattttcccataaaaagttgtcaggagtttagacctcatgttatgttctgactctagtaacaaaaaatatttggaggaaacattaaaatgttttcatgagtggaaatttttactgatggtccaaacatctaagatcaattgctggtagtagtatttctcttgagaccaacataaggtttaggtgtgccatgaattccagcaggatcacattatgctcaaagaaagatgccaatggtgatttgaaattagcaactccttaagtagagagagtcccgttaaaaggaccgaactgggtagtgtgtcaattacataaagggaggaatgatgccaaattaaaagaagtgatgtgtgttatgttagtaaatatagaaagaactccctgcttctaaattctgtgcagagttaggaaaaatggggaggaccccaaaacaggtatgtgaaatgctttcttcattttctcttaagctcaggaaacaccactagagtttaagtttgtgtgaattaggaagagtctaagtgagatggcaatggctcatgtgtctccccacacgcagaactccaacttatgaaaatggcatcaacatgaggaaacagttgtatgtggcaaaggcagtaaaaccatcagatagcacccacctggccacctccaactggtccccaaaaccaccagtattcccattacatgtatgttacagcctttgtagttgtcccacagctacaaaatttaaaaattgctattgtcaaaacaaaatattaaatatgaagttgaaatgttgttccacttttttaccccactctttttgaactttcctgtttcagttttggaagtttctattgacgtatcctcaagctagggattctttcctcagctgtgtgcagtctaccagtaagcatcaaaagcattcttcatttctctaacagcattttttttttctgagacagagtctcactctgtcaccctggctggagtgcagtggcatgatctcatctcactgcaagctctgcctcctaggttcacgccattctcctgcctcagcctcccaagtagctgggactacaggggcccgccaccatggctggctaattttttgtatttttagtagagacgaggtttcaccatgttagccaggatggtctctatctcctgaccttgtgcccgcctcggcctccgaaagtgctggtattgtaggtgtgagccactgtgcccagccatctctgagggagtttaacgagttgttgacttttgagtttgttcagctttttacttagtgttagaaccgaatgacaaatttcaagcttgttatatgcctgacaggaagccagaagtctctaggaagtgaccagagaatgtgagctccatagcaggttgaggatggagtcatgggcgaaatgagcccatgggctttggggactgcaggcctgtccagcctctgacaccctggtgagtccgtgcaaagattacaacagtgacaggaaactagcatgcctgactccatctggcatctagtctcaggctggctgtcctcactcattgctgggcataggccaggctaaccttgggaggaatttagtttatggtttaaatttgaagcaagaatgataatagttcctccataaaactaacacccttactttgcccagggactgcctttgtaaaactagtgaaagaccatgagattaaggttataggagggaactgaattctgctaaaatgttggcacagtttctataatccctgactgctccgatgtcatttggcaagagtttacaaaagttgtaactaattgctcctatagataacatcactattgtagaacgtgagattggtcttttgagatgtttctcattcttttgcattctggcaaccggctgacctcatccatacctatgactaatggctcagccagtcatgtggtccctacctagagtcagatttaagggcaaacagatcatttccctccgcccacatgattccatcaccaaacaatcagcagtacttattttttagtcctgtgctcctgaaactacccttgaatatctctaacccctgatccactggggaggctgatttgagtaataataaacctctgtcctcctgtttggcagacttggagtcgttaaaatctttcttgactagaaaccaacatttcaataattttttttttttttttttttttttttttttttgtgcaggaggccagaagaacttgcctggcaattatgagtggatggaggaactgcctatccctgtcccattgtcttgtccacaggtcagcctcacaaagggaaagagccctggatgggaatacagtggaagctcattctcttagtgacctggggacattggctcgagatgaagcctggcaggagtggcaactccaggtgatttctgcacctttcctatttcctgggaggtgggccaggccacagtgttagtgggaagggaacagaacagccagcctagtcagagggagtgtctggggaaggcctaggggtgggggaagaagctgtgcaggacagggcttgccagtcagaatgaagtgggaggaagatgagggacacagagaagcagagagaggcagagacaccatggcagtgagcagtgagggagacactgacttcaaaaaccccagggaccaggtgcccccagctccacagtccaggaccaaagagccctgagaaccctccagtggccaaagagcttcagaattacatgagctggggtggctttaggggcaagaggtagtggggggatgaaacatgggtgtcagcctctgaaggacaagggacaggtgtggctagaaactcctaggattctgcatgcaaattcagtctctaaagaggttttggatcattcatttcattccattccttcatttgttatgtgagagctcctgagtgtgtgtctgtctcgctgggcctgtgctggtgtagggtgtgagtggggaaagaaaaggtcctctccttgatcctctcatgacagtgacatggacactttgggaaacacaggatttcaggttcagtgatgggggctaagatctgagggggaggcctggacatgttttttccactgactctgatggttgaggcaggtgatttagttctggagtacagactaatcagttgaccattttctctcactcctctgaggtttggatgcctaagaagagaggttttgagccaataaatgactatggggtgcttggaagccagtgagccctcacttctggtggaggagaggatgagcctgtggctgcggacacacctcatgtgaccctgatctcccctttgtgattgtgtgactctggctcagggactgtgtcttcctgtacctcagttttctgtcaatcagataagctaaatggcaaatggacagtggcttttcatgctatctgtgaataaatgttaaatgattcacagtcacctgacctaatgcttggcacagtggaggtttcacacaaatagcatttattattaatttgcttccatgagaaagcccctttgcgtcagatccctgtgggcaagctgctaccaggtacatcttctctcttgtgtttctgcttctggggacattagactttctatggactggcctaagcctcctaaggcagttgtctgatggcctacaaagcttgtctttctgtcctctccactctgagtgtcaggtgaagaaaactctgtccttgcccagatgaggctctgagggctgagccctggctggtgaacagctccaggagacacagtcctctgacagctggtaaatcctcggtcccagtaagccctgcccaagaagccacaacccagccccagcacaggctcctcagatttatctggagcaaggatttagggacactgttctgggggtgaggcttctagggctgagcttctctgagagtatctcaggggctcctcaggccaagccctactcagttctccagggtctttctcagggtcaaatttatgaagagggcatgaggtgcttgtctgagactgatctcctcctgctgagtccccccatcagactgtccttcctctgcagcgagtgtctgcagggtctggatgcgggaaaggaattctgatctgttgaaatttgtctcctctgtgtgtgtcctgcactaaatgcccaaaccccagcatgggacataatgcagagagggacacaggcaatgtccaggcctgacaatcctgtgtgtgtgaagtagaagtgacccctgtcccccaacacccagggatcatgtggaatcactcacgatataaggtgaaggtgaaatgtccagttactcctctattctcatcacctcccattatgatgtgtaaggtgtaggatcctgcgtcttcctgggtgacattctggatcagcagggatgcattggaatatattgtttctcgtccactgtatgcaggcccatatataattatttgaccgtctactacatatgatgtaatgtaatggtagaggtccctgatttgccctttgtaccagatgtagccagtaagattctggggcaaattgtggacaagtagaagaacatccttcccctcagaaactttggttggctgggcttcaatcgtgacttgggcagtcgtgggtgggttccagaagtttaaaagtgatgctaggaggtggagagagcatcagtcaatattgagagctatgtattggtgtgaaaacatggggccctgggtcctgagaagttctcttcagtcctcagccttgaagacacagacacacacacatacaaacacacgcacacacacacacaaaagcggcatgtgtgtctgtgtgtgtgtatgtgtgtgtgtcctactatcctactaggtcaaggtcagccccatgacccccattccttcaacacttctgaccttggcatttttctgtttgcaatcctcttccccaggggtccgcatggccccctccacactgccctcaggtcctgctcacatcagggcatccttagatttctttcctgacacctccttcagataccctgggtcttccctttctgacctttccctgctctgctccctccagggttcttctcaacacctgaccttacattctagatctctttgcatgtctgtcttcccctccatgacagcgtgagctccatgaggacagggatttttgtgatcttggttgcaccccagtgcccagaacaggctgcagactcctgtagatgtgagagttctcagggccctccacgcccttggtgtttttttttccccccaattgttgaggtttcttgctgaggacagtgtttcatgccctgtgtatatttttatgtgaagtgtcatctgatacagttattattatcatatttcaaaatgtggtggcccctgatgattaatcaggaaaacagaacacaagattttcctacctcttaccaattctggttcctgtgactttcctgttttgacccctgtccctctctggtgtatttccccctatccaggctccaatagagccttctttcctttttctcttttttctctttttttttttttgagatggagtctcatactgtctcccaggctggcgtgcgatggcactatctcagctagctgcaacttctgcctcctgggttcacgtgattcttctgcctcagcctcccgagtagctaggattagaggagcacaccacaatatctggttaaatttttgtatttttagtagagacagggcttcactgtgttggccagactgatcttgaactcctgatctcatgatccacctgcctcagcctcccaaagtgctggcttctttcattttttagtaccccatactctcaaggagaccccatccagtcactctgcttcctcctcctgtcctctcccaggaggttctctcctcacctgtgagcaggagccccttccaggtgatgcgctgtgtgcagggaggggctgagaggagccccatggtctctgctgtctgtgtgttctcctctgtggagatgagcctaggatccagaagcttcctgagcacagctctcagcagtgctgtcctgcctccttctgcgctgagcttcttcccggggcaggagcacctctcaggttcatgggcggggtcaggcccaggacacctctctgtcccctcctctctcagtcctgcctccttgtccctcctgtttttccttttgtctgtgtttcaggtccctgggaattgtggaggcctctgcctttttcagcagtgattctttcaccaaacctcaacacacactttgtgcagacacacacacacacacacacacacacacacacacacacacacacacacacacacacagaaggacacacacagacctacacagtcagaaacataccctgcaggttgggcaagcagagtcctgggcctcagcctcctgctgtccccatggctctgggtcggggtgcacattcatgccctttggcctctttcatccccatctggctctccccttcagtgcaggaggctggagctgcaccaggtccctgtcacagtgacaccccattgtgctgtgggtgagctgtgtgttgcctggtgagagggacccttcctttctctaatcgtgtctagcttggctgcagcttccaaggatggacactcaggacctgggtgtcccagaggaaactgtccttcctggaggtgtgcagggtgaatctctcatgtctcttgggaggagaggcctgtgctggttgctcagtgggggctgtgagtcccatagtcaaagggacagttctcggtcactctgtgactccgtggggtctggccactgagctggagctcagggtttctcatgttcttcctgaccatctttgatgtcctctcttctctgcccagctgattgtcctgtggtcaccacaccttccccgtggtggtgcaggaggaagtggggagtcacccaggaaccccaagggagatggctcgttgagacgcaagagggtgtgcctgggacagagcaggggttcagagctggagagattcatcttgacttactccgtggccatgatgggctcagccctccatgtgccgacatacccaggggtctgtcctgagggttttgacctggccaagctgctgtgtgtagaggaggaacaggcagtggccagagagcctgtctggagggaccttgctcacacctgagggggcgtgtgggggtgagttgtgttctgggagcaaagagcaataacatcccgcttctccctgcaagcgcacaggagaggtctgccttcccaagggacagctggggcaggtggccacatcccggatggtgcctgtgtgtgaccatcacacgcactctgagcaccccgtggtgcagcgggcaggcaggtcatagggtgcctggctgattcccggggaggctgtgggcccttaggcagctgctgttctgtgtcagtgctaggcttggcctgggatgccccagagaacaggatagatggggcaggggcgggcatttagggagcagtgacagaaagagttgatgaggatggagggaggccacgaggggaaagcgcctagtgtggcgtcgcgtgcaccagcgctgccctgggagatgcctttagctgggcccagggaaggagcaggtgtgtggggaggagctccctgcagagggagtggtgttaggttggcggccaccaggtcagggtggagctggcagagtccgtgtggggagcatggagggcgctgaggacttgggccgaagtgaccctggtgagggtggaccctgctgggctgtgggttccgctgagtgaggttggcatcccctgggaaggctccaggctgggagggactctgtccccctctggtggacagggagggaagtgtgaacggcagcaatcccaggccaggctgcatgttttattccacatggatctgcacacttcacacgaggtcacacatatgttatgttacagctccttcaccttccagccccgtgagtcccagtctgtgtggctctatgttcactgttctccctctttcacaatcagatgtcccaaacgcagatttttgtcaccttctgtgagtttgtgtttgtgtgcagtaggcggcactgtgtataccctgggggcagtgatgtctggggctgagcactgcaattgggcttggaagcagaagagggagcagcagggtgggaagatcaatgtcagggggcagggacaagtcattttcattttcttactcccagggaccagaaccctggattctgactccagggcacagtaccacaccctgctggtgtccctggatgtcatgatgctcatagtgtcatgttgtcttggcattcatttttataaggtgtaagtttatttgcctcaaatcagaggcagggcttggtcaccatggcagttttcaatactgtgtctggttcaagtggctccagttggtgtccagagataaaatcttagaggcatctctgctgcttggtgtgctgggtttccctctctccagctgctttctttaaactgataattctgacatttgccctcacatttaaagtgaccacctctcagtcacagcgtgagctcctggtcccagtgtttgctgcttgctttgaacacatccattaaagctccctgctggaaacctgtcagataacaccctggacttaataaagccattggctcaccggtctcttctctcctccctgtctgggctcactgacctctgtgtctgtggtctccaggtttgccgagtgcttcctagtgtctgtaagtagtaaaaatacttacattttcacgttgtggttgtattattgtagcctcacatgccatccagggcctgacattgaggctgccttatgggacctgtgctggttgagcccctgctggagctcttgttttggggcgtctggttctcctggggacaggagcttccagctaacttgattgaaaatctgatgcctttcattgaaacactgggtcagatgatgtattcatgggcttcggctgccataacaaacaccttagcctgggtgaattaaataatagaaatctatttttcacagttctgtgaataatgtgctattgtaaccactttaaaatgctgaatcaaatgaaattaaccacatacacagtgttaaattaccatcaccactatttttcctagaaaatttttatcattttaaactgaaactttgtatcttttaaacaataactccctgtatgttccaccctagaccttgatcttctctactctgtctctatgaatttgcctgttcttgatgtttcatataaatggaattatacaattatgttattttgtttctgacatatttcacttagcataatgtttccaaagtccatgcatgttccagcgggtgtcagagcttcattcctctgtatggcagattaacattctgttgtatgtgtcaccatatttatttatttatgtgttgatgagcacttgaattattttcatttttttcttttttctttttctgtttaatagtgttttttttatcattattattcttatactttaagttttagagtacatgtgcacaatgtgcaggttagttacatatgtatacatgtgccatgctggtgcgctgcacccactaactcatcatctagcattaggtatatctctcaatgctacccctcccccctgcccccaccccacaactgtccccagagtgtgatgttccccttcctgtgtccatgtgttctcattgttcaattcccacttgtgagtgagaatatgcggtgtttggttttttgttcttgcgatagtttactgagaatgatgatttccaatttcatccatgtccctacaaaggacatgaactcatcattttttatggcttcatagtattccatggtgtatgtgccacattttcttaatccattctatcattgttggacatttgggttggttccaagtctttgctattgtgaatagtgctgcagtatacatacgtgtgtatgtgtctttatagcagcgtgatttatagtcctttgggtatatacccagtaatgggatggctgggtcaaatggtatttctagttgcagaatcgccacgttgacttccacaatggttgaactagtttacagtcccaccaacagtgtaaaagtcttcctatttctccacatcctctccagcacctgttgtttcctgactttttaatgattgccattctaagtggcatgagatgatatctcattatggttttgatttgcatttctctgatggccagtgatggtgagcattttttcatgtgttttttggctgcataaatgtcttctgttgagaagtgtctgttcatgtccttcacccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgaggtgttatttctgaggggtctgttctattccattgatctatatctctgttttggtaccagtaccatgctgttttggttactgtagccttgtagtatagtttgaagtcaggtagtgtgatgcctccagctttgttcttttggcttaggattgacttggcgatgcaggctcttttttggttccatatgaactttaaagtagttctttccaattctgtgaagaaagtcattggtagcttgatgggtatggcattgaatctgtaaattaccttgggcagtatggccattttcacgatattgattcttcctacccgtgagcatggaatattcttccatttgtttgtatcctcttttatttcatcgagcagtggtttgcagttctccttgaagaggtccttcacatcccttgtaagatggattcctaggtattttattctgtttgaagcaattgtgaatgggagttcactgatgatttggctctctgtttgtctgttgttggtgtataagaatgcttgtggtttttgtagattgattttgtatcctgagactgctgaagttgcttatcagcttaaggagattttgggctgagacaatggggttttctagatatacaatcccatcgtctgcaaacagggacaatttgacttcctcttttcctaattggataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaatttatggagagtttttagcatgaagcattgttgaattttgtcaaaggccttttctgcatctattgagataatcatgtggttcttgtctttggttctgtttatatgctggattgcatttattgatttgcgtgtattgaaccagccttgcatcccagggatgaagcccacttgatcatggtggataagctttttgatgtgctgctggatttggtttgccagtattttattgaggatttttgcaccaaagttgatcaaggatattggtctgaaattctcttttttggttgtgtctctgcctggctttggtatcaggatgatgctggcctcatgaaatgagttagggaggattccctctttttctattgattggaatagtttcagaaagaatggtaccagttcctgcttgtacgtgtggtaaaattcggctgtgaatccatctggtcctggactctttttgtttggtaagcaattgattattgccacaatttcagatcctgttattggtctattcagagattcaacttcttcctggttcagtcttcggagggtgtatgtgtcgaggaatttatccatttcttctagattttctagtttatttgcatagatgtgcttgtagtattctctgatggtagtctttatttctatggaatcgctggtgataacccctttatcattttttattgcgtctatttgattcttctctcttttcttctttattagtcttgctagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgaagttagggtgtcaattttggatctttcctgctttctcttgtggggatttcgtgctataaatttccctgtacacactgctttgaatgcatcccagagattctggtatggtgtgtttttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttacaatttctcttcttttacatttgctgaggagagctttacttccaagtatgtggtcaattttggaataggtgtggtgtggtgctgaaaaaaatgtatatcctgttgatttggggtagagagttctgtagatgtctattaggtccacttggtgcagagctgagttcaattcctgggtatccttgttgactttctgtcttgttgatctgtctaatgttgacagtggggtgtaaagtctcccattattaatgtgtgggagtctaagtctctttgtaagtcacacaggacttgctttatgaatctgggtgctcctgtatttggtccatatatatttaggatagttaggtcttcttgtgaattgatccctttaccattatgtaatggccttctttgtctcttttgatctttgttggtttaaagtctgtttcctcagagactaggattgcaacccctgcctttttttgttttccatttgcttggtagatcttcctccatccctttattttgaacctatgtgtgtctctgcatgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttcttttgcttgttagttgatgcagtttcttcctagtctcgatggtccttacattttggcatgattttgcagtgtctggtaccagttgttcctttccatgtttagtgcttccttcaggaggtcttttagggcaggcctggtggtgacaaaatctctcagcatttgcttgtctgtgaagtattttatttctccttcacttatgaagcttagtttggctggatatgaaattctgggttgaaaattcttttctttaagaatgttgaatattggcccccactctcttctggcttgtagagtttctgccaagagatcagctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaactttggcctgccttgctagattggggaagttctcctggataatatcctgcagagtgttttccaacttggttccattctccccgtcactttcatgtacaccaatcagatgtagatttggtcttttcacatagtctcatatttcttggaggctttgttcatttctttttattcttttttctctaaacttccattctcgcttcatttcattcatttcatcttccatcactgatactctttcttccagttgatcgcatcggctcctgaggcttctgcattcttcacgtagttctcgagccttggttttcagttccattagctcctttaagcacttctctgtattggttattctaattatacattcttctaaatttttttcaaagttttcaacttctttgcctttggtttgaatgtcctcccatagcttggagtaatttgattgtctgaagccttcttctctcagctcgtcaaagtcgttctccgtccagctttgttccgtttctggtgaggaactgcgttcctttggaggaggagaggcactctgctttttagagtttgcattttttctgctgtgttttttccccatctttgtggttttatctacttttggtctttgatgatggtgatgtacagatgggtttttggtttggatgtcctttctgtttgttagttttccttctaacagacaggaccctcagctgcaggtctgttggagtacccggccgtgtgaagtgtcagtcttcccctgctggggtgtgcctcccaattaggctgctcgggggtcaggggtcagggacccacttgaggaggcagtctggcagttctcagatctccagctgtgtgctgggagaaccactgctctcttcaaagctgtcagacagagacatttaagtctgcagaggttactgctgtctttttgtttgtctgtgccctacccccagaggtggagcctacagaggcaggcaggcctccttgtgctgtggtgggctccacccagttcgagcttcccagctgctttgtttacctaagtaagcctgggcaatggcgggcgcccctcccccagctgtgctggtgccttgcagtttgatctcagactgctgtgctggcaatcagccagactccgtgggcgtaggaccctctgagagaggtgcgggatataatctggtgtgtcgttttttaagcccattggaaaagcgcagtgttcaggtgggagtgacctgattttccacgtgccatctgtcacccctttctttgactaggaaagggaactccctgaccccttgcacttcccgagtgaggcaatgcctcgccctgcttcggtttgcgcacgttgcgcccacccactgacctgcgcccactgtctggcactccctagtgagatgaacccggttcctcagatggaaatgcagaaatcacccgtcttctgcatcactcacgctgggagctgtagactggagctgttcctgttcggccatcttggctcctactccttattttcgtattttatcttttgtgaataatgctgcaatcaacatttccatgtaagtacctgtttgagtccctggattaaattctttgggcctatacccaggaatggatgttgtttcaaatgagaattctgtgattagctttttgaggaacagcaaaactgtttctcctagtggctgtacctttttatattctcaccagcaatgtatgaggattccaaattctacataatgctgctacttgttatttaacattttaaaagaattgtagccagttttgtaggtgtggtgtggtgtcccattgcagctttgactttgtattttcctaatgactaatgatgttgagtatcttttcatgtccttcttgactatttctataccttctttgaagaaatgtctatttgagtcttttgcccatttataaactggatggtttgtccttttgttattgagttgtagctagttcttgatattatttggacatgaaaactgcgtatatgtggtttgcaaatattttctctcattctatgtctattaattattgtcttaataatttcctttgatgcacaaaatgctcacatcttgataaagccctatttatcttgtttttcttgtttctcatgcttttgtatcatatctaagaatccattgcacatttgaggtcatcaatatttacctctatgtctattttgagatgtttttattgttataggtcttatatttaactcactgatgaattttttagagaatggtttgatatggtgggaggtagagttatctaaattcactgttttgcatgtggttatctagttgtttctgcactatcattggaaaggagaattgttcctccattaaattgtcttgacaccctcttcaaagagtaattcaccataagtgtgagggtttatttctagactctcaattctatcccatttgtctttatgtctattcttttgccagcagcttacgtctattctttggcagcagcttctgttttaataagtgtactcctttgtgagatttcaaataagaaagttcaagtcctacaatttattttggcaagattgttttggctattcaggggtccttttgtgaaaggtggggaggccaatgtttcacaattgggaaagccttttctgtcttcttcatggggaagtttgggagaatcttttaagaaacttaatctaagcaggtaaactgtcaccattttatttgctgaagtgctatgttaaagtgtgcattgcctcttgtggaagaattgtgagaccctggaagctcttgctcacatggtgagagatagtgaattccatgatgaggggcagagaggacagtgttttgggatacaatgttgttgggggagttgtatacatctcaacttctttatgtctctgtacagtgggtgtagggaccagccacacagggtcggtgggtttttctccccgtgtgcagagatgagagattgtagaaataaagacacaagacaaagagacaaaagaaaagacaaatgggcctgggggaccactaccaccaagatgcggagaccggtagtggccccgaatgctaggctgcactgatatttattggatacaagacaaagtgtcaggataaggagtgtgagccatctccaatgataggtaaggccacatgtgtcacatgtccactggacaggggacccttccctgcctggcaggcaaggcagagagagagaggagaaagagagagagcttacagcattatttctgcttattagagacttttagtactttcactaatttgctattgctaagtaaagggcagagcctggtgtactggatggaacatgaagggggagtaggagcgtgtccactgaagcacaacatcacagggaggcagtcaggcctttggataactgtgggtggacctgactaatgtcaggccctccacaagaagtggaggagtagagtcttctctaaactcccccggggaaagggcgactccctttcctggtctgctaagtagtgggtgtttttccttgacaccgaggctaccactagaccacggtccgcttggcaatgggcatcttcccagacgctggcattaccgctagacgaaggagccctctagtggccctgtctgggcataacagaaggcttgcactcttgtcttctggtcacttctgactatgtctccccagctcctatctctgtatcgtctggcttttcctagggtatgattatagaccaaggatttttataatattggaataaagagtaattgctaccaactaatgattaatgatattcacatataatcatatctaagatctatatctggtataactattcttcttttatattttattatactggaatggctcgtgccctcagtcttttgcctcagcacctgggtggcttgccgcccacaagtgggcatctccattggacacagtaggttttgaaatccttgtttatcctctggggtctaggtcttggcttgcctgttagctgcagctgaaagaggtgtctgctaaggcaatgacacctgtggggagaagaaaggttcagcagagtgaaagtagctgaggctcagagaggccaggaaagtctgactcttagaaaccgtgggtcagcagatgggtgtcctcacgggtacatgggcgatgccggtagccactgcagtggactggaagaaggtaagtgatgctgggtatcccatgttctctctcagctctgcagctgaagatttgggccttgggctggtacggccctgcagcaggggaagggtacacaggaatggctgcatatcgggacgaagtccatgtcatcttcttaggcattgttactgcagatggaggattctgttcagagacctggcctggacacatgggagggcccaccccattcttttaaaattattttaagagaacagtattagcaaatgtggtacatgtcttattctgctagaatcagtcttattgtcacgttttacaaagtatcttttaggaaatggtgagagccatccacactatgtggatttaaaggggactctagtataatttcagctttcctactctttatagaaaccatcttctctgcaaacacacaggcaatatctctgtgttcatttctattgggagccctgtatgcaaggtggagagtgccacatttccctctgagatgttatgtaaaagtttgaggtggagatgacatatctgacactctgttgttacactcagaagctactacatgtgaaattctaatgactgcattatcctgccaaataaaaggcaggcatgagcaaggacagtaaagaggggtgagagcctcatcatgatggggagtcttgttctgacatcttgggaaaaactgtccacagtgtgaagtcatcaacttcttgtcctggtttacaatttgagtggctgttgttatggtgtcaaacattttagtgagttctgagtggctcacgcttcaggtacaagggttttcccatgaaatttacattgagttgtccacctccagcttatagggcttctggaacagaatgggtcttgctcttagtgattccatgggagaaaatggaattggaggaactagtagaattcagggtaatgttcagtttacaggtggataataaaaacacagaaacaatgaacagagctgcaatctcataaccggtgtactacagtttttattttccacgtaatttttgtctctacgggcatctctagttttaccaatgataatttcagtagaataagtttgtttgcaaaataggttgagtttcttcaaacgtggtctgattctttacataagtgcagcaagagtagcaatggaccatgtagggtctcttttaaaattttctttcctctaagtttttataaggaatctgagattaaacttttacaaacctcttgagaataggaagccaaaccaaggctgacttcagactttgcctgcagttcatattggttcattctatgtatattcttaaatataacatcccagtcaaagccttggtaatataaccaatgatttgaaatgtgtcctgttacaaagagagcagattgttactgtacttgtgcaaatatgtgtattaccataaacatatcaattctcatgaatagttgcccaattctggggcagtcaggtagagagcaaaagtaaatatttcaataattgttcccagaagtatagtttattgaactgctataagctatagatagattaaaagaaaaaaattccataaatgtagaatacaaaccatttaaagaatcagcaaattttcaaataaaaatcataaaaacattatcctcattattatcaatatttcaatgaagtcaatgtttttcctgcttggtaggctgagagttttatgaagatatcagcctgttagttaaagtttttggaagttcttagacagtcctgtgggataatgtgaaagttatcggaaacttgtattaaagagtacttgtcagcatcttttctacaaatctccttgaaaaggaagcaattttggactgtagctgattggaaatgctttgaagaagaataaaaacaatgtctgttagtgggaaagattttaaatgactatggttaaaactctgatgagaattcattgataacacagctcacataaaaagttagttacttctgtagtatatgacattgtggctgataacatacttaatttctaggaatctcatacaatttctggaacaatcatatcagtaacatatccataaatataacatagagaaggtttagcatcctttaccatttatgatttgaaaatgcttttcatataattttacatatcaaataaagtggcttttccatgtagcttgtgtttctcaacaggattactgagttcttggtggaggctgttaatgaattgggccaagaaagtataggcttatgtatgctgaaaaatttccctagataattccaatactcccagctaataatcatgaatttaggtctaaattttacctattagaacagctgttatttatcctggttacacattagtagcatctgggaagacttaaaaattaccaatgcctgagtctcactttagaccattaaattggatcctatgggtggggcttgggcatccatttaaaaaaatgttttctggtgattccaatgtgtagctgtatttcccctcagatttctctgatttcttttggcattcacttttttctattttggtattataattattttttgggtcttatcatctatcttaggctttatgttccttggggtagaaaccttgccttcttcatttttgtatctttcacgaacatatgagttggtcatcaggaaaatgttctcaatcacaagtaggttgtgttctgagtctcaggtttacacattaatgcttgagtcattgttctctgggaggtgagaggttgcttgtgatgaagggtatgggtaagcccatactgcagatggtagatgggagatcaccctgttttcagccatagcattggaactaagcattctatgtgtatatcaggtggaggggaagggatgtgtagaaagacagatttaattagaatggaggaattatactagggaatagaagtatttaaagcaacaaaaattagtaaagagaagaaatgtgaacttatcaaataggcaagagtagatccctgaagatttttgaataggtgagttaactagaatttaggaagctaataagacagtcatacacaaggaagatttcaaagactggagataagtcaagcagtacctctagcagttgttgaggttgtgggaatggagagaatgacaaaagtgagaaatgttataaaaaaggatcaagagggttttataaggtattgaatctgggaaacaaatgagcagagactgaggataatcacttgtaggagacagtggggtacagggagcatgaagaacaggggagaagagacctgcaggaataaatgctgagaagcaggagtttagtgggaggaggaggagatccagtcccaaataccggcaaagaagtcctttccctctcccaagcaaggcagtcagccctgcaggaaacaggacaaaaggaaaagccatcatacctgccagtcttcctgaaataaactacaacagggctgctagatcagcgccacactggccagtacttcaatcatgatgctgccagtggctctacctgaaaggccaggagaacttcctttcactgaagtatctgtcatggaaagaaaagaagagaaggaataaaggtgatgttattttacagcgtggtaccttaggaaccatcactaagtatttagtagtttctactttttccttcggggattacattaattttgtgggacggttgctggtagatgattagccaactatattcttgcagtttttttctctctcaacgtgtttctaggttagtgatcagtcttctgtcaatttcatcctgaccatgctgcactcagatattttcgaaagctttatgatgtgagaaaggctgactgctattttctgtcactagaactttgtaccctttcatggttgcatctttttctcagtgtgtcagttgtggtaggcatgaataagactctgtcaggtctccatggcagcttgtgtttctcaagaggattactgagtccttggtggagcccattaatgaatagggccgagaaagtataggcttatgtatgttgaaaaatttccctaggtaattctagcactctcagctaataattgattaattaataatcaactgacttgattgacagaaggcccagatcagtgcattccaaactgacaacctactttgcatagagtcctcactttcctgaagctctcagcagggatatgaaagcaagcccagttctatgagactctgttttattctcctgggtgacttgtgggaagaccccctatcagtcttcccatgctctctttgaactgtagctaaatctttgtctttctccttcacaggaatgagatttgcatagtggtcccaaagttccccagacttttttcatgcctgccccactttccctcccaggcatttttcctaatacattatcctgcatgtctaatctcatctcggatgcatctcagtgggcataaactaacataccaggcttgatttttttgcacttagcttttttctgtctctcccacatgtagccagtaaccatgtcctagtgtttcatgtgttacccttttttcatgtgtataggaaaaaaatatatatttccatatacttatttatatgtaatatatataataaaatgtgtaatataaaatgtataataatgtaaaacatatacatattttccatatatgtatatggaaaaagaggtaacacataaaacaccaggacatttacatataataaaattgacatatgttatatatgtatgtagtgtctggtagtcttaccctctttataaatacacactttttgtcactgccccttccttccttcccatgcagagctcctatggccaaatctccctacttctccaagtttgtgtcactcactgtcctctgtgttgtgtcccatgtgctgtgtccacagcctcctagtgttttatgtgttctctttttctatatatatgtggaaaaagcatatacatatttctctgtatatatttatatacaatatataattatctaaaaatatagaatatataacaatttaaaatatatgcatatttccatatctatgaaaaaaggtaacacataaacactaggccatttatatataaaattcacatatgtaatataaatgccaattttatcatatataaataagtatatccatatagacttatcatatataaggtgaatttggaatgccctgacctgggccctctgtcagtcaagtccctgccatggaggccattcatggctgccacaactgagacactgggagaaagatgcaactatgaaaaggtgaaaagttctaaagtcatagaaaatagcaatcagcctttctcacatcccaaaaccttcaaaaatatctgagtgcagcatgtccaagatggaattaaaaacttcaatcttgaaaaggaaaaaggaagctggaggattcacactttcagatttcagcatctactgcaaagctacagtaatcaatacagtgtggtactggcataaaggaggacatagaaatgaatgacatagaatagagaacccagaaagaaagcttgcatatatggccaaatgatttgtgtcaagagtgtcaagcccattccttggggaaaggacagtctttttaacaagtgatactgggaaagctggctatccatggacaagtatgagttgaacctttacctcacaccatatacaaaaaaatgaacccacaatggatcaaagacctaaatggaagagtgaagactaccagactcttagaagaaaacataaggaaaaagcttcatgatattgaatttcagaatgatttatttgttataactacaaaagcataggcaacaaaaaagggataaattggacttcatgaaaattaaaaacttttatatatcaaaggccattatcaagaatgtaaaaaggcaagctatgacatagggaaaatatctgcaaatcatatatctaataagggattaatttccagaatacatgaagaacactacaaatcaaaaacagcaaaaacagaaaagcccaattaaaaaatggacaaaagactgaaagagggattttattaaagaagatatacaaatggccaatgaggacatgcaaggattctcaatataactaatatttagagatttgcaaagcaaaaccacggtgatacatgacctcgcacacattaggatggctttgataaaaacaacatgaacaacaacatcacaaaacaagtgttttcaagtacgtggaaaaattgaagctctttgtgtgttgccgatgggaatgggaagtgttatagccactgtggaaaaaatggcatggcacggccggctcatgcctgtaatcccagcactttaggagccgagatgggtggatctcttgaggtcaggagtttgagaacagcccggcaagtgtggtgaaaccccatctctactaaaaatacaaaaattagctgggtatggtggcatgcgcctgtaatcccagctactcaggacgctgaggcatgagaatcacttgaaccttggaggtggaggttgcagtgagccaagattgcaccattgcactccagtctgggtgacagagcaagaccctgtctcaacatcaacaacagaaaagaaaatggtatgtcagtttcttaaaaaaaattaaagcattaccacttgaaccagcaattctacttctggacatacagccaaaagtattgaaaaatatttgaacagatatttgtacactgatgtttacagcagcatcactcacaatagccaatgggtggaaacaactgaaaagtctattgaaagataagtggatgaacaaaaaggtatatccatactttggaatgttcttcaatcttagcaagggataaaattttgacacatggtgcaaaatggatgaaccttgaagacattatgcgaagtgaaataagccagacacaaaaggataattattatatacttccatttatgtaagatagttagaatagtcagttacttagagacagaaattagaatggtgattaccaggggttaaggggagaaggaatgagagttatcatttattgggttcagaggtttagtatagtaggataaaaaaagctctggaaatagatagtgttgatagtaacacaacactaaattgcacgcttagaaacagttaatagtaagtcttagatgtatagtgtctggtactcttaccctctctgtaaatgcacactttttgtcgctgttcctcccctgccatagagagcttctgtgagttaatctccctatttctccaagtgtccatcactcactgtcctctgtgttgtgttccaggagctctgtccacagactcagacaggcagtgacttcagagccaggacacagccctattcccattttttaaagccttacccatgggaggcttggcttctactggcagctcgatttagccagattcagaaccggccacccaggcaccttatccacatgccctggccccagcccaggtggagtcagggcagggtcagtcactgggcgagcccacagcaatgcagggagcagagtctgagctgcttctccctcaccaaggggcttcctcctctcattggagaaaagtgtgggcttgttttgaagcctctgatgttcatcgcagctcatggagtacacacacacacagacacacacacaaaggagacagaagggatgttttggtgacagaaacagcttgaccatgaggaccctcctctttctccctctgtgaaggcccttacactgcatagtgcttggggctgataaagccatttccctacatttctcaggctggacccaaggtcatccaccagaaatctggcaaacaaagggaagagaatctgtagatatgaattgggagtgttcaggagaaaaatttgggatttacttttgtgcatgggacacaggctgagaataaaaatgttttcctggctctttcttggaaagccagataggcttcacctgaaagcatattgccaatgctccagcgatccacttaccagggactctgattttcttggttgcgaagtttttgccattagtgactgggttatggacataacacagatagtccccactattctcagtagtgacttgggggataaagagctcttgtcctatttgctggttattcccattcagcagccaagaatactctgctgatgggttagagcccatgaggcaggagaggttgaggtttgaccctggatagtaataggtgtctgaagaataagttgtgggttcatctgggccatctggagcaaagagaataatgccacaggtaatgttatcagagggaatgggaagctcctggtctgtgaaaggggcacagtgttcctttttgccaagtcacaaccccgaagtcccagccaaacttcctctgtgttcactgaactggagtagtctaagaaattcacgtgttctcccatcacaagctgtggaaccagagtctcctaagaccagagaagcccctcccctcctgggcctacccaggtttttctggggcaggaagtcatggccagcttgggggtccaggggtaagtgtcttcatacttgaacctgagagggactgagaggcctggcctcatgttatgtggatttgggccggcagccttgtccatgaaggaaaagaggatactcacagagaacatccaggtgactgggtcaatttggctggtactcactacattcttcctttgacattcatagagtcctgtgtcactccttgtgatactgagtagagcaaggatcctgttgtcattggacatctttagcctgggactgagtgtgagtctatgaccatttacccaccacatgtagattgtgccatgaatgtcaggttcacaggttaagaccacagcctcctcatcctctgtggggttgctggtgacatagggcttgggaacattcgctgtgcagataacagagaagattcccctgtgtggcaccactgatttctccatgagcattttccaatcagagttgacatctcccacctctcagcaaatctaagtccttaaaagcccacagcaggtctgtgtgtcaaaagacagatggatgcatgatgatctgagggctcagaggccatggggccacctgctctgtgtgggagatgcacagacttctgaagtgtggattgagcagcaatattggtgaagtgtgaattgagcagggtcaaacaattagagtttgattaactttgtttaaattgagcagagcccaagtgaggcagcagtggctcatgcatctccccaaccgaagcaccccaccttatgacaatgtggttattatgaatacacaggtgtgaatgaaacaggcagtaaatcagacagcacccacctggccagctccacctggtcctaggaaccaccattattcccattatgtgtatgttacagctttttaggctacaaaatataaaatacaatcacagaatataaaatatgctattgtcaatacaaaatattgaatatgaagctgaatatgttgttccactttttctcactcttgttaagctttgctgattcagttttggaagtttctattgacacacacttaagctagagattctttcctcagctgtgtgcagcctaccagtaagcccatggagggcattctttatttctcttaaagtatttttaatctctagcatttcttttgcttctttcttagaatagccatctctgtttaaatcacccatctattcctgaaaggtgtctcctttttccatcataatccttaaccagagttgttttaaatttccagtctgataatttcaacatccctaccacatctgtgtctggttccaatccttgctctgtctttcaaactgcattttttttttttttttgccatagtctgtcttgtatttttttgaaaaccacacatgatgtactgggtaaaagggacttgagtgggtgggcattcagtgacacggtggtgagtgttgggagggaagggttctgtggttctggatgagatctgtgtcctgggctgtgaatgtcacaagtgcctctcaggtttttctttccattaggtgggatatgatgacttgaggaggctggagttggatacttcccctccccctggccagttaagctcccatcaaaccccagctaattaggctgcagtaaaatagtttctcttaaatttaggtcttaccaagaagaatataattcactgacaactttccaagtgtttttttcccttcttcctagaagaaggatgtggattctttttggatattgactgtgagaaactggtagagctccaggagctaagagtcataaatctgtccccctactcccaagactaatccatccactggtgtgtttatctctgcactgtgtccacactgagcctccagaatttcctcaattagagttcaggttttctgaccccagcacttgttcccgctgaggtttctgtgcctgtgtttctgctcaggtacggtgcgctgctctgtatttgcctgtgggtctctccaatatgtgggccagttagcactgagaccttgcttccagagaaatctaaatgagttgttgatttttcagtttgttcagctttttacttgttgttagaactgagtgaaaatttttaagctacttacatgcctgacggaaattcgaagtgtctagggcatgactggaggatatgagccccacagcaggttgaggatggagtcatgagtgaaatgggtgaaatgagcccatgggctttggaaactgcagatctgtccttctgcctctgaccccctggtgagtccatgaagaaagtgaaaccacctttgcgaagcataagatggtgagaggaagctagcttggctgaccgcatctcacctctagtctcaaactggccctcttctctgattcctggacataggccagggtaagcatgggaggaatttatagtttaactttgaagcaaggatgataatagtccctccctaaaattagctcctccttgtcgggggctaccttggtaaatctaagaaaagaccacgaattatgggaggggcccaaattctgctaaaatgcaggcatagtttctataatcccttacttctcaggagtcatgtatccagaggtcacaagatttgtgactttcctagttgctcctatagatagcaagactactgtagaatctgagatttatcttttgagatgtttcagacttttgcattctggcaaccagctgacctcatctagactcatgaccaatggctaaaccagtcatgtggcccccactcagaggcagattcaacaaatacataccattttgcctacgtgcatcatttcatctccagccggtcaacagtacttattccttagacctttgccccttcaaagtttttgaaaaactctaacctcagagccattggggaaggtgatttgagtcataataaatttctgtcctcctttttggcagccttgggctaagcaaaaccattctttactacacatcaccttcacaataaattggctttgcctgtgcagagggcaagaacctgtcaggtgattgtaagaatggatggaggagtcactgatctctttcaggtggcctgtttcatgagtcagcctctcagagggaaagagccctggactgggacacagtggaagctcattctcctggtgacccggggacattgcctcattatggatcctggcaggggtggctactctggctgattttggtgcatttttcatttcccagaaggcaggacaggcctcagtgtgagcaggaaggaaatggaaccgtcaatcttgttagagagggtgtctgggtaagtcctcagggtggaggaagctgtgcaggacagggctcatcaggtagaatgaaagggggatgcacttttttcactgaacacctttcagatgtctcaccaactctggcctcactgggctctgcctttccttctgagcccagagccccgagccctgattcctgggagggaggaagagagagaggaagggtgaagctgggatgtgtgctgtccaggtttcttccatctctggaatcttgaaagcgagggaccctagtgtgttaccacagaggagaccatgggaaaaagctgtttctcaggggtgcctggcttatgaattgaggggaattcagaccaggttggactcgtgaactgcagggactctgttccatgtcagcaaccagctcctctagctcagtgtttctctctgtggctaattcttttgtgtgatttctgagcccatgctagagtcctcctcacgatgcctgatggtcagacctgtgtggggagacctaatgatggggtgggggtggtcttgagtgtcacacagagtgtccagggaacaggctttgtgactttctctaccccagccccacaacaagatctggatagtgggcttggtcagataaagtcagaatccatggagggagggtatgtgtcctggcagtactgaggttcctgcctccaggttagttctcagtctctgcaaatacatttatgttgtgcatgtgctgtttcctggactgtttcatgtccctaacttcttgaacctgtctgcagataatgtcatgagaggtctgcatggaagtatatgagggctctctgattaggatgggtgtgttttacatagtgggtttttttttttcaccaaattgtggttgagtgtgtatatagaaacacatacatacttatattcattagatttgactatttatataaatttaatatacagatacatttctataaatatacacatatatgtatatgtgtatatatgtatatgtatatatgtatatgtatatatatgtatatgggtatatatatgtgtgtgtgtgtgtgtgtgtgtatatataaaatgtgccattttaaccacttaaggggagagagagagagaagagagtttctgctaataccaaatctgggttaaataagggtggtcctatttcctggggttgggcttttgctagatgtgtcagttcctgttggaagtgaggtagagaggttacatgcttaaccaatgtagagattttctatatgaaaataatctgtgagcacactgataagttttatccttttctaggtgaaaagcttggtgaaagattttaaggacttcccattggctgaaggctggcaaatggagtttgctatcctctgactgcagccattctgaggactggaaagaataccctgagaaggggcctattttatttctgcaggaaggtactgaggtttaatttatcttatggagtcttcctagattagaaggctttgaggtgtgttgatgccttgccagtgacttagctgcctgatcagtgaacctatttcctttggctacatcatctgttccccttttgatgttccctataatgtatcactgctatttctcatggaagaaaactgaggataataacctgttaattttttggtgatattttacaggaaatccattagtggtaagaaaatgccttttattttaaatggcagcatgagcatgaagaactcaaaaagcatacttggaatcagtgtaaatgttagctacctttcccttgcttaatttaagtgctcttgtaagaaccatttgtttagctgattgagcacctgcacctgaagggagatgttatttagagtgactactgcttatcctgccatatatatttcttgctttaccagctgtttgttagctaagagctccctctagaggaaagtaattttgccacattaagtggggatgtaaaccgttctttcctagggttaatttggaggcttttctgactagtagagctattgtgacagtggtttggaagcagatgtaaacaataggtcctcctaatggcaaataagaggttgagaaaaatattggattagaatttttcctgagacaccccttatggttgtgctatgggaagaggggaggcctggataagaaaggagaaaagagagagactagatctagtgtttagaaggaggtctactttcctccctataatttccagaatgacctgtgtctcctgtgctgtaatggcagtttgagctgctggagccaggggtttgagccccaggacccatcagtcttgctggaccactgtgagactggtactgaacccagtgacctccaactctgggagcagttgcatctccagtggtctccaccacaggctggtcattgtcaaggtggcttcctcttgctgtttggacactccttcctaaaaatgccctggcttgccacaccgagagcaactagtggatacacctctgggatcctggactttgcaactctgcaaagtagctattagaggctttgtccttctcttgagctttctctctttcttctgggccttctcctggtccctattataaaagactgaagtggctaccctcagaaggttttccaaggtgctatgtgctactatagcttgccttttgtaggttccttctaatattgggagcattctgtataataaacttatctttttgaatgggctgtcacttgagtgaatcaggagataaaaaggtgtgtgctaatagtgcccctcttaacctatccataaaggctgcaggattctcctctggctttgagtctatcatagacagtttagaggaattaagaggtctggccttagtttttcttttccattcatctgctgagctattggggcttcaatcagggttgccaagaggtactgcttcacttcttatttggaatggtgtttctgctatttcttcactttctgtatctccttccttcccttttggtgtattataggagatatgttgctcatcttcaaaattctctggtgcttgtagagctggctgtttttcagttacagttagggtttggtttaggagcagcataacatccttccatgtgaggtgaaacacctgacttaaattctggaaagcttctatatacctatcaggattgtctgaaaatcagcctaagtcttactttatttgcctaaggtcctgtaatgagaagggaacttggagggaccccaaattatggggattcttctcagatggttccctgggaagttgcttttctaattctaggggattattctttataggccttcctgatatggctgttaaaaaaatctgggttgctgttacaatgcttctaaagttttagtaaaaatgccctgtcattgtgcaaaatagaatgagttgcttttctcttcaaagtcctgaggttaaaagagttctagtgcctcagagtgcactccagaggggtgcaaactgaagatgctctgttagccatcgagaaaaagaagtgagaataaaagtgtccttatagtcccccttctttcattgttacccagagtcatgtggaagacagtgggagcatccccccaactgttttctctccttggttcctgagtcctggcactgtgttaaatttgccacccatggttgtaggtgtggccctctaagccatggaactggataaatgaagtgatgacattagccacactttacccatgcagccttagcttatctgcctgtgatctgcctggcctcctgaaaaatggatctctggtgaaattgtaatagttgcctttgagcaagctttctttaagagagggaatgtgccagttgccagttatggcccatgctaaaacacttaccctcagaaaagtggtcctggttgactctgttcttaaaatgtccttactaattaaatactgttctaattggagatagaataagtaccttaaatgaacgtagggacctaatggcagtttttcctgctgatgggacagtatcggaactaaaatttggctatggaagacattttactcctaactgttgaaagcagagctttcccattcacagaaagggcttttctatcagtgcaaaaagagagaattggaaaagtgcagtgttatggcaaaggaccaacaatgtgcctcataaggaggatttatgtttccactaggtgacactgttggcttagaaataccaagtgcttaccaaaggaaggagagagagagagaaagagagagggagggacctattgggttagttattataccatgtaccgatctttcctaacagaactgtttccctgaaccgtaaaaatttccacatattgcaaacacaaaaagaacaggagacatagagaccatggatagaaaggaagaacaaatttgcaacaggatagcaaattaggagacccattaccaacatctggatgagctgccggaagctgtgttcagtccagaagcctttgaataacatcagggtgtttcctggccagaaattctcagctgctccatgacatcccccagcgtcatgtgatggtgaggttctccatgaaaggaaactagtttgaagagaaccttgaaattaaaggacagatttgaggtttgctccatactcaccattctgatgtttctatcttctgttctgatcacaatcccagatgagaactcccaaataaaatggctctgtttgggaatctattcatggttctttgtcacacactgagaaagaattcgggacatggaaacacgtgaggagtgggtttaggagtgaaaaatttaacagacaataaagaagagagagagaaaaagctttctcatactgagaaagcagtcacccgagagagggtctccaatttgtggtggaatgcaattgattttgtacagagacttgaggaggcagtgattgatttacatagggtccagggtattgttttgaccaggtgtgctgtttacgtagcccgagaaaagactggccctcccaccttaatcttttattatgccattgtggcttctacctggtggtcatcatgacacctgcacatatggtgacaaggaaaaaagtgcaggaactgccatattgggagtacctggctcttagttgcctgcatctgtatatgcttatctatgcttgcagcctgatcattcagtctgttttctgttagaaatggtttgggggctgcgttttattaaaggaaaattccaccaagaattcttttaccctttctagctgcctaaaaataatttctcaataactcctgtattaggacccctttaggaaaacagaaaagaagacacagactctcctgtaggaaagtaaccatagtttttttgtcatggagccccaagagttgcaagtgaacggatttctctcaggtctaaaactctgctcttttctccattgtgttacctgacctctttgccttttacattactttgaactgtaaaaatatttgaccttgtgtgtgtaatggttgctgggtcagtggtaagagctatggttttgaaagtgactaacagtgattataataaattattctggcttcagagggctactcatttccttgcatgtttagatgcaaaagacacagtttaaacaattagggaaatgcctttgtagcaaagtactctgtggaagtgttgcacagtatggtccccactgcattgtcctcttcttggggacctgggattcagtgaaatccttgatttttaatgtctaaatgttgtcccttccaactggtgcccttttttacatatttaaatgattagaatctaaaaattgcaaagactttgttggccctcttccttaatgggctctaccttgagcacagtgattcagttgaagaaaagagaccaaattaaaagctacatctctaaataaacaacaggtgctggagaggatatggagaaataggaacacttttacagtgttggtgggagtgtaaactaattcaaccattgtggaagtcagtgtggcgattcctcagggatctagaagtagaaataccatttgacccagccatcccattactgggtatatacccaaaggattataaatcatgctgctataaagacacatgcacacatatgtttattgcggcactattcacaatagcaaagacttggagccaactcaaatgtccaacaatggtagactggattaagaaaatgtggcacatatacaccatggaacactatgcagccataaaaatgatgacttcctgtcctttgtagggacatggatgaagctggaaaccatcattctcagcaaaccatcgcaaggacaaaaaatcaaacaccgcatgttctcactcataggtgggaattgaacagtgagaccacatggacacaggaaggggaacatcacacaccagggcctgttgtggggtgggaagagaggggagggatagcattaggagatatacctaatgttaaatgacgagttaatgggtgcagcacaccaacatggcacatgtatacatatgtaactaacctgcccgttgtgcacatgtaccctaaaacttaaagtatactaaaaaataaataaataaaaccccgtggtaaatttctattatttttgtgttaccttggcatctctttttaatcttccttgaacacaccaaattttttcttgaaaaagcttaagttctctctctctctctctttgctttgagatgtaaatgtgctatttattttctctaaaactcggtaaagccttcctcagataaacgttaacctttaccatttacaagaaagcaatttgaatccaactatcctttaaactggtgggttttactgatctcatgcctaaagtcctaaaatcaaaattctaaaatccttttgtctctctctatctttatgtgaacatgtatatgttatatgttttatcacatatatgtatatgtcacacatttatatactgttgacacatagtttcaaattaatgtaaaaataaatgagtactcacaaattaagtgaataagccaaaatgcttttctatacatgtgattttaataacctttggtgaatatagatagttttaaaattgttggaaaataaagtataaacgtcttcataatttaatttatacgtttttgcctaggtctgttggcaggcaggtttatattgtctttactagatgttttaaggtcatcaaacagttgcttccatatatatacattttcttaatttgtctgtgagcttatgtctttatatttgaagctttaaattctgagttctagatgagtgaccatagtaagaactggggacaaaacccatcccagcctctggctgtgccttttggccatgctgggagaggtgagattatccaggcattttcttcatagctctgttctttgtcttgggctttgcatctggtacatagttagaatgatttactccctagtttttttctactgaaaataaggctgtataagtctgtttttacattgctacagacaaataaatgaacctgaataatttataaagaaaaaagtttgaatggtctcatgattcagcaggttgtagagtaagcatgattctggcatctgctcagcttttgaggaggcctcagaaaacttacaatcacggagaaagccaatggtggaggaagacatcttatataatgggagctggaggaagagagcaagggttgcacactggtaaacaaccagataaaaactcactgttgctacaacagcaccaaggagaatggtgttaacatatgagaaaccacctccatgatccaatcacatccaaccaggctccacctccaactttggagattacaatttgacatgagatttgggtgggggtaaaggtccaaaaaattattattctctccatcttccctcccaaatctcatgcctttctcatatttaataatataagaatggcttcccaaccatctctagagtcttaactcattccagcattaactcaaaagcccaaaatagcaagtttcatctgagacaaggcaagttcctttcacctatgagtctgtgaattcaaaaacaagttagttactttcaagacacaagggagatctaggcattgggtaaatactcccattccaaagggaagaaataggctgaaagaaataggatacatgccccatgaaagtctgaaaccttgcagcacagtctttaaaacttaaagctccaaaataatctccattgaccccatatctcatattcagggcacactgatgtaaggcttaggcttccaaggttctgggcatcacaggaacattctaagagagtcacaaaagaatttgtagtgtggcttttgatgctaaacagcgtattagaccaagtaagtcactgaagagaaaaaagtcagaggagaagatgggtgagggtgacagaaatggaatggtgaaaggaaaggtctgataaaaatgtttaccggctgggcatggtggctcacacctgtaatcccagcactttgggaggccgaggcgggcagatcacgaggtcaggagtttgagaccagcctgagtaacatggtgaaaccccatctctactaaaaatacaaaaattagccgggcgtggtggcatgcacctgtaatcccagctactcaggaggctgaaggcaggagaatcacttgaacttgggatgcggaggttgcagtgacctgagaatgcagcattgcactccagcctgggtgacagagtgagactccatctcaaaaaaaaaaaaaaaaaagttcacccaagggctcatctggtaccttgctctgtgactaatatcttacacttttgatttactcttccactttcattttctgatgctcaaagggtcacccttctgctgaagatgagaaaagaggctgagggagctcaaatgagtggtctagagtcatccagctacttcatagagtttgtgtgtttcaccttgacatttgcgcacagacagaaaagtgagacatggaaggcaaagcaagtttttgctgtgggtgacatttatgaaagttacctgtgtttgcagaataatggactcctaaaatgtttgcaccctagctccagaacctgtgcatttacttttcttggtaaaaacacagtgcaggggtgataaaattaaaatcttaagatgtagatgttattctagattatctgggtgggcccattgtaatcagaagtgtccttgtaagtgacaaagaaaagcaggggcatcagtgtgagaatgatgagcctgtgaaactccactggccaatgctgggtgtgagcatgcatcaaaagacaaaattacaactaatgtagttatagattttatttttcatttattatttgaggcagctctcactctacaaatatagtgacagccctccctgggctatacaataacaaaacagtgggttttgtcaagtgggaaccagtaaacaaagccatataaataaataaattggttaacattagggtacttcaggtctcttttctgtaaaagttaaagcagaggaaacttttattatgctgtctcaggtagagtggaatctcctgttttcaacaaaaaacaaaggtctgttctggtatctctttgcttcattaaaacttcagttgtagactgtagcatttagcatgagtcgttctattttggagtctctaggctctcacttaggtgagagtgtgaccaaaatttaaagcattggcattcatctcagtaaccatcattttgggcttccatcatttatgagtttatgatgtcttcctgatcacacatttctttgagtttttgtcatttcagccaaagagagaccctttggtatttgttgatggctgcacacaaaactttttaaaaactcttgtagaattcaccacaccaaaatgtagaatttaaaaacctgtagaatttatcacaccagagaggctactagtatgactattaggaggataataccaaaagtttggagtatgcactttaggcaagatgcaaaccaagtaaaatagaatagatcaaagaatgagccagaagagtctagcaattttaaccaagtagtatgtttggtaacttctgtgattgagtcattatgatactcgatgtatttgtttatgtgcaacaatcagtgtcagaaactgcacaggctcctccctgttcagctggtagggaacaattttattatgtagcattcgacggctcattaaattaaaacagggagtgagaacaagtgagtctgaaaatgtaactttaaaaggggccactgtacatttgaagaaacaattgtgttaaagatggtgctaatgtcagccattgggtggactaaatgatatcttatgtaaaaatttgagggtgacatgatatatctgtcactctgttatgctactctcagaagctacttcacatgagattctaatgataccatcatcctgccaaatgaaagaggcaggcataagcatggacaaattaagaggggtaagagcctgattttgatgtgaagacttgttctgacaacttgggaaaagcttttgacagtatgaagttgtcaacttcttaccctggttttcagtttgagtgtctgtagttatggtgtcaaacatattggtgagctccgagtgactcattcttcaggcacgagggttttcctgtgaaatttacattgagctttccacctccaacttataggacttcagtaacagagcagattttgttcttactgattcaataagaaaaaactggatgggaggaactagaagaattcagggtctagtccagtctaccggtgaataataaaaactcgaaaacaatgaacagagctgcaatttcatagcaggtatactacactttttattttcaacattatttttctctctataggcatatctatttttaccaaagaaaatcccagtaggacaaatttgtttacaaagtaggtttagtcttatcaaactttgccaggattctttacataagcgcatcaagagtagcagtggaccacagaggctcttcctaaagtttggttcgctagtttttataagtagtctcagattaaacttttacgaacctcttgagatgaggaagccgaatgaaagccatcttcagactttgcctgcagtacatatgtgtccattctatgtatattctcaaatataacatcttagtcaaagccttggtaatataaccaatgttttgaaatgtgtccttttgtaaagagaagattcttactaaacttgtgcaaatagctgtatcatcataatcatatgaatactcatgaatagtttcccagtcctgggacagttaggtaaagagcaaaaatcaatgagcttcaattattgtttccaaaagtatactttaccaaatttctttagatataactagcttaaaagaagaaaaattccataaatctggaaaaaatcatttaaagaatcatcaaattttcaaataaaaattataaaaacattatccacattatcatttatttcaatgaaagtatttttgttctgcttggtctaggttggcacatttcatgaaggcatcatcctgtttgttaaagttttgaaagtctatagatggtccagtgatataatcttgaactgctcagaaacttgtatgcaagagtacttgtcagtatcttttccataaatcttttgaaatagaagcaattttggactgtagctgattgcaaatgtttcaggaagaatcaaaacaactatctgtgaatgaccaacatgtaaaatgactattgctaaaactctgataagagtttggtataagaaagggagtaactccagccagtactctagtcatgatgctgacagtggccccaactgagagaccaaaagaactttcttatcctgaagcagctgtcatggaaaaaaaaagaggagaaggaataaataataaagacagcaagggttttagccaattattttttgagatagggtctcactctgttgcctaggctggtgtgcagtggcacaatctcagctcactgcaacctgtgcctcccaggctcaagcagtcctcccacctcactctcctgagtagctgggactacaggcacacaccaccatgcatgcttaatgtttgtattttttgtagagatgggcttttaccatgttgttgaggcttgttttgaactcctagacttaagttattcactgccttggcttcccaaagtgcagggattacaggtgtgagccacctctcctgccggtttcatgctttttataataagaatgaactccttatgtaataataaataaataaatgaaattatttgctttggatgtaacaaatgtagatttagattgtccagagtcaggagctaagcctcatattttttttgttttagctcagtgtagagtgcattgaaggtgtcctaaaaataattccatatagtaagccaattttaaaccctgctcacagccaggtctgccaagtatgagccaggtaaaattaccaaaatgggtggttctgactgactccttaacaataacgtggcttacaaacaaagactgatatgaaatagttgatccaacccaaacagtttgctcattttccaaaattttctatacaaacatatgcaacttaccacaacatagagatcataatgaaaggtttcccttttattcctttaaatgaccatatgtttagatctgatgtactgacagcaataattctccattaagcagaaacctaataaaatttgaaaaatagtgattttatctttagatgatactcagatcttctgctacatatgtggaaaatggaattattgctagaaacattgtttaaagattagggtatgcaaggagtattaggaagtcaggaggttctttctttaggaaacagcttatctggattcattcaaagagctttaggcgagtttgaggtctttctgcaaaatgtaaattgctatctgagaaaccatatatagtccaatgatgaaagaatgcaaagccttagaagcacaggagacaattccagtatcttccctaaagttctgacaaaaaggaaaataactatcaaattcttcaactcgaatgcttattatgtatgtataagtcaatcggcagatgaagagaggctggaaatatgacttctacccctagggaactcacagtcttgtgggggccactaggggtggtggtgtgacctgcctggagcagcgctaagtatggacttgtgagtcaagggctatcaaaacctaagtaaactgattgctgttcagagaaggtagagttccattccacagtttgcaagaaggactgttttatggaggaggtcatgttggactagaccttaaaaagttggtagaatttaaaagcaaggatatggaagcaggaagagtgaaagtgagcagaggtacagaagtgaggcaagggtgagcagttttaattttttaatggtggtataaaatacacatcaatatttgccatattattattattattttggagacagtgtctggctctgttgcccaggctggagtgcagtagctcaatcatggctttctgtatcctccacctcctgggctcaagcaatccttgtacatcatcctcctgagtagctgggaccacaaacatataccaccatgcccagctaatttttatatttttgggagtgacaaggtcttcctatgttgcccaggctggtctcgaactgctggactcaaatgatcctcctgccttagccccaaagtgctgggactacaggtatgagccactgcacctgaccccatcttaaaaatttttaagtgcacagttgagaagtacatttgcactgtgcaaccatccgcggcaaccatcttcagagagtatttttcatcgtgtaacagggaaaattcatatccatgaaacattaactcctcattcttcctcctccccaccccaggtaaccactattccagtgtctctatgattttgactgctctagggacttatataaatgagatcatacactgtgtatctttttgtgactggcttatttcacttagcataatgtcctcaaggttcatccatgttgtaacatatgtgagaattttttccttttgaaggctgaataatatttcgttgtacggatggaccaaattttgtttatccattcatctatccatggacacttggtttgccttcacattttggctattgtaaataatgctgctataaacatggaggtaccaatatctgtttgggtctctgctttcaattattttgggtttatacccaggagtggaatggccaagtcatacagtacctgtagttttagttttctgaggaaccaccataatgtttttcacagtggctgcaccatcttaattcttatgaatagtgcacaggggttccaatttttccacagtctccttaacacttactattttctggggcttttgctttgtacttgagagtagccatttaaattggcataaggtataatttcattgtggtttacattttcatttccttaatgattagtgatactgatcaatattttctatgcttgctggccatttgtacatcttctttggagaaatgtttattcaggtcatctgcctatttttttaaattgggttgaatttttttttgctgttgtttaggtagagaaggcaatctttgaataccagtgatgtttcactaatactgggccattgatttcacaagaagttgtatgaggtactagaatgtgtgtttggtttcaatcatggctggggttgaatgccttttccaaaattcagtgtgaatttcaccagaagccacaaagggtccaggagcaagaacatggtgtgactgctctctgctaaagaatttcagcctgatgacagtgagcaggctacacatgagactgacacaagaataggtggagagggagactttccactggaagaaggtgattctaacatgcagaatcaccttcaaggagcaagtaagcagaaaaatagacaatggcacagtggccaggcaagaagacactaggtccagaatctgaggttcaaatcctagctctgtgagataaaaacatgccttggttttcccatgctactgaaacaccaggggttgggtctaggtccctttgctcactgcacagaaagccaaccactgagacaatgagcattgccagggaagaaggctttatttgggtgctgcagccaaggaggtgggagatcagtcttaaattcatctctccagccgactcaaattggagggtttatatagctgggaagggaggtagctacctgcagggaaaacagcaattaaggaggggtaaggaagcaatcatgataaatgaggggtctggtgtctcattgtctgatggtgatttggtgaatttcagtctcttgcctgaaggtctgtttcctaactcagatgactgacaaatgttaagtttcaagttttaagaccagatgggtcaatttctatgtttattcaaaaaccctgtaaatatcagttctatgtggaacttgagctggtttcccccaagtcatcacagttagggttaaatgatgcaatataagtaaaacaccagcagtttctgacacacacacagagtgcatgacacaagtggtgtgttgggacaatatagctcagtgaactccctttgtctactcagttatattgagtgatgaggcatctctgaagatgccactttgctacttctcccctgataatttcaccagatccagccatatgagcactgcaagtggggacttagcttaaatcattcctcgtatttcctgtgcaggcaaatcatttggcaccaaaacatgcacagaagtccaaatcctgctgccagctccacgactgatgacacagacagacttcaggattagtcctttaatctctgtcctctattaaatgaaggtcatcatgctgctgcctaatgtaaaaggattgtggggattttcatcattcattaccgattatcttattctttgaaaccccaagaaaactatacaaattccaaagtctaataggtacacaagggctttattatggatgatgaagtttcaaaggatgctaaaccaaaaaaaaattgtttttctttttttttttggatttatttttttatttatttattttattatactttaagttttagggtacatgtgcacattgtgcaggttagttacatatgtatacatgtgccatgctggtgcgctgcacccactaactcgtcatctagcattaggtatatctcctaatgctatccctcccccctccccctaccccacaacagtccccagagtgtgatattccccttcctgtgtccatgtgatctctttgttcaattcccacctatgagtgagagtatgtggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacctgtgcatgtgtctttatagcagcatgatttatagtcctttgggtatatacccagtaatgggatggctgggtcaaatggtatttctacttctagatccctgaggaatcgccacactgactttcacaatggttgaactagtttacagtcccaccaacagtgtaaaagtcttcctatttctccacatcctctcctgcacctgttgtttcctgactttttaatgattgccattctaactggtgtaagatggtatcttattgtggttttgatttgcatttctctgatggccagtgatgatgagcattttttcatgtgttttttggctgcataaatgtctgcttttgagaagtgtctgttcatgtccttcgcccactttttgatggggttgtttgtttttttcttgtaaatttgtttgagttcattgtagattctggatatcagccctttgtcagatgagtaggttgtgaaaattttctcccactttgtaggttgcctgttcactctgatggtagtttcttttgctgtgcagaagctctttagtttaattagatcccatttgtcaattttgtcttttgctgccattgcttttggtgttttatacatgaagtccttgcccatgcctatgtcctgaatggtaatgcctaggttttcttctagggtttttatagttttaggtctaacatgtaagtctttaatccatcttgaattgatttttgtataaagtgtaaggaagggatccagtttcagctttctacatatggctagccagttttcccagcaccatttattaaatagggaatcctttccccattgcttgtttttctcaggtttgtcaaagatcagatagttgtagataagcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaagaaagtcattggtagcttgattggaatggcattgaatctataaattaccttgggcagtatggccattttcacgatattgattcttcctacccatgagcgtggaatattcttccatttgtttgtatcctcttttatttccccaagcagtggtttgtagttctccttgaagaggtccttcacatcccttgtaagttggattcctaggtattttattctctttgaagcaattgtgaatgggatttcactcatgatttggctctctgtttgtctgttgttggtgtataagaatgcttgtgatttttgtacattgattttgaatcctgagactttgctgaagttgcttatcagcttaaggagattttgggctgagacaatggggttttctagagatacaatcatgtcgtctgcaaacagggacaatttgaattcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttctcatagatagctcttattattttgagatatgtcccatcaatacctaatttatggagattttttagcatgaagggctgttgaattttgtcaaaggctttttctgcatctattgagataatcatgtggttcttgtctttggttctgtttatatgctggattacatttattgatttgcatatattgaaccagccttgtatcccagggatgaagcccacttgatcatggtggataagctttttgatgtgctgctggatttggtttgccagtattttattgaggatttttgcatcaatgttgatcaaggatattggtctaaaattctcttttttggttgtgtctctgcccggctttggtatcagaatgatgctggccttataaaatgagttagggaggagtctctctttttctattgattggaatagtttcagaaggaatggtaccagttcctccttgtacctctggtagaattcagctgtgaatccatctggtcctggactctttttggttggtaaactattgattattgccacaatttcagctcctgttattggtctattcagagattcaacttcttcctggtttagtcttgggagagtgtatgtgtcaaggaatttatccatttcttctagattttctagtttatttgcgtagaggtgtttgtagtattgtctgatggtagtttgtatttctgtgggatcggtggtgatatcccctttatcattttttattgtgtctatttgattcttctctcttttttctttattagtcttgctaggagtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcctttctagttcttttaattgtgatgttagggtgtcaattttggatctttcttgctttctcttgtgggcatttagtgctataaatttccctccacacactgctttgaatgcatcccagagattctggtatgttgtgtcttcattctcattggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttgtaataggtgtggtgtggtgctgaaaaaaatgtatattctgttgatttggggtggagagttctgtagatgtctattaggtccacttggtgcagagctgagttcaattcctggcttgattaggtaaataaagcagccaggaagctcgaactgggtggagcccaccacagctcaaggaggcctgcctgcctctgtaggctccacttctgggggcagggcacagacaaacaaaaagacagcagtaacctctgcagacttaaatgtccctgtctgacagctttgaagagagcattggttctcccagcacgcagctggtgatctgagaaccggcagactgcctcctcaagtgggtccctgacccctgacccccgagccgcctaactgggaggtgccccacagcaggggcacactgacacctcacacggcagggtattccaacagacctgcagctgagggtcctgtctgttagaaggaaaactaacaaacagaaaggacatccacactgaaaacccatctgtacatcagtatcatcaaagatcaaaagtagataaaaccacaaagatggggaaaaaacaaaacagaaaaactggaaactctaaaacacagagcgcctctcctcctccaaaggaacgcagttcctcaccagcaacggaacaaagctggatggagaatgactttgacgagctgagagaagaaggcttcagacgatcaaattactctgagctacgggaggacgttcaaaccaaaggcaaagaagttgaaaactttgaaaaaaatttagaagaatgtataactagaataaccaatacagagaagtgcttaaaggagctgatggagctgaaaaccaaggctcgagaactacatgaagaatgcagaagcctcaggagccaatgcgatcaactggaagaaagggtatcagcaatggaagatgaaatgaatgaaatgaagtgagaagggaagtttagagaaaaaagaataaaaagaaatgagcaaagcctccaagaaatatgggactatgtgaaaagaccaaatctacgtctgattggtgtacctgaaagtgacggggagaatggaaccaagttggaaaacactctgcaggatattatccaggagaactcccccaatctagcaaggcaggccaaagttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctcttggcagaaaccctacaagccagaagagagtgggggccaatattcaacattcttaaagaaaagaattttcaacccagaatttcatatccagcccaactaagcttcataagtgaaggagaaataaaatacttaagagacaagcaaatactgagagattttgtcaccaccaggcctgccctaaaagacctcctgaaggaagcgctaaacatggaaaggaacaactggtaccagccactgcaaaatcatgccaaaatgtaaagaccatcgagactaggaagaaactgcatcaactaacgagctaaccagctaacatcataatgacaggatcaaattcacatataacaatattaactttaaatgtaaatagactaaattctccaattaaaagacacagactggcaaattggataaagagtcaagacccatcagtgtgctgtattcaggaaacccatctcacgtgcagagacacacataggctcaaaataaaaggatggaggaagatctaccaaggaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccagtacaggagcacccagattcataaagcaagtcctgagtgacctacaaagagacttagactcccacacattaataatgggagactttaacaccccactgtcaacattagacagatcaacgagacagaaagtcaacaaggactataactttttataagatacatatgggtttactactaaatattcttaaaatgaatataatgctataatattcttattttgaggtaatatatatatatagtctgcaaaaattaggtttcctggtgtcattaaccacttatgcaattatttttctgaaatgaatacacatgctgtacatgcagttttgcctgatataagttttaaaacaacgtatattggaatcttggaactaaaaatgagaaaatcagtgtccccttgatgtcagtttcagtttcaactgcacttgctattttatttttaattggttacttacattatctgtacattgtcacagttgatggtatttgttttcttctctgtgaccatagtttgcacagatttaaccataatgcatccttaaagattacaagaaatcttttagacacagctcctctcagttgctgaggatcgaacctttacttatgtgttttcttcatgaatatatatttcctgtgttgtatgtttgtacatagctatttgtagcctttgaagtttatggaagtttttttggttgcattcttggggtatattttctttccctgatgactgttaaggttaggatatttgacccttccaaagctcatgttgaaatttagtccccaatattggaggctgggcctaatacaaggtgtttgggtcatggggacagatccctcccattgaatagattaatgtcctctcctgatggtgaatgaattcttcctctattagttcctgcaagacctggttgttaaaagagcgggccacctccccggtttctctcttgcttcctctctcatgtaatctctgcacatgctggcttcccctcctctactgccatgaatgggagcagactgtggccatcaccagatgaagatgcccaattttgaactttccagacaccagaatcataagccaaatcatcccttttcctttataaattatccagcctcaggtattctttatagcaacacaaaagggacaggactttttatatcttgccccactgtcttctagcatttcatgtgtcccataaagaaatcttagtctcctaggttttttttttttctgaatatccacagaattctttccataacttcaaataccaggaatttattggggtatttgttaattattcaatataaacacagccttgtaattcttgggctatttctgtctgcagattcaaatttcactgtatttcaggaatttcaccttgaattgtatctttgaaaatttgttttcatgttccattcattttttaacccatgcaaggcatttagtgttatagatatttgatctcttccctaccactccctcccatccccctctttttctctatctctgtcttccgtcttttacttttcgttcttttccatctcacatgctcattttttcttctcaaaaccatccttcgaattccttcagtggtgtctcatctcccttttgctgcttctatcatgacctttgattttggtctctttttgtctctctctctctgagattctgaggctctgcctattccgtttttattctcatttgtttctaatttgtttccaagactctgtctactcccttttcattctcatttattactaatttatttctgaggctttacccactcacttttcattcccgtctaacctaatgtattatcagttcttccttaaagccttatattgcttctttaaattctcatttcagagaaacaatagtgtctttaattgattccttagaaataactttgttcatggtttttggctgcgttgtggtatataatctttccatttctcatctttgtaaatcatgttctgttcttttttatttcagcatcattttaaaggccccccactggctccaccctttttaagtagcattgttcctcatctttttggactagaattttgggcaaagctctggggaaaggggaagaagaaagtgccaaacaaacgggaagattgggtttcagtctgttatctctaggatgtttctcagctggacttggcctgtgggttatctggtccagcatagcaggatatcttccgggctcacaaggaggctgtgcattttacagaacattttaatgtgattatttcaccttgacttatcttcaccagacagctttgggcaaagacggccaggtagcttatatcttattgactcttccttctatcctataccatgattgaaacatgatgtaggcttccaaaaccaggccatgaaccttgatcttaactttctaagcatgggatagacacatttcctttcaatgtgtgccacccatccactttggataactatgagctgggtccactctgcctgagtcacacatagaaagacaccttctcttggagttcccaaatacctccatccacttctcatacacttggttatcttcctgcatctactgttatccagtgttataggggatctgtagcttcattcaagataacatttgtttgtttcttcttctcttgtttgctttggattggtttcataaaggaaatgagacaaaaatatatttatactaccatttgaaaagaaaagataaattccttctttcaaattcattcctttttctttctttccagtgaatctcatggggtgaggggagcactgaagggaatgtccaatctactcaagtccaaaaagtcacaggtataaggcacagaaaattttaccagtctaatgatggcagttttaatgctatataaggacagactatacaaaaatgctattaatgaggatgaggagctacaggaacaaacctgatgaggaactgtaattctattagagggatgtatatagccatcatttttttctttaatccaaaacaattagattgcttatatacacagccacattcaattctaaggtatttgattgaaatgcaccagaagatgcagatatatatatatacttttaccttagcttccattttattctttccctcccattttatcagtgctatagagtacatttttcccacttgagctcaacatgctgttgtgcagaaagccttctcttgggagttcccaaaatgttggcccagatgagtgcagcagacatttggcccaggtgagcctagcagatatttacatgaaatattagggagcatccatctgggccatgtgacttaggctggcgatacacgacagaggattccaatttgttgtataaatcacccttagagcccccaacagtgaacacatagggggttcttttcattttcatgatgtttaatataatctttaaaaataattaaaattaggtgaagtgtgtagatttctgagagattacagaaaggcattagttttgatacctcttgcttgtagcatttgaccgacataaacaaactaaaaggtttaaaaagaacagggattcttcccagtggtatagggcaatgggtagggaaaaaaagttcaaaattgataaatagaccaatattattctcaaaactcataccattgtgattgggaagaaatgaatacatattacttagtcacatcatgttaccatatacttatattaacacaacaaaaaggaaattatacgaaaaaaagtcatacatttaaaggatggaagaaaatcctaggtttactcagagctcaagatcccattgggatgaatattgttctttcctcggattgtgccttcatttcattcattcacttatgtatgtatttatttatttagagatgggatctatttctgtatttatttatttattgattgattgatggagtattgctctgttgcccaggctggagtatagtggcacaatcatagctcactgcagccttgaactcctgggcttaagtgatgctcctgcatcagcctcctgagtagctgggactgcaggtgtttgccaccatgccccgctaatttttaagtttttttttgtattgattgggtttccctatgtttcccatgctggcctttaacttttcagctcagcgatcttctgccctggcctcccaaagtgctgggattacaggtgtgtcccttcatttctaatgaaggaaggttttcctttgaatatctcacaacagatatttttaaaagaaaggcagatttgagcaaccatcaacaaggtttacttgaaaattaatctgatatttacaagtgcattatataacagaaatgttacagactgaattgtgccacacctaccccaaaactcttatgttgaaatcctaacacccagtacctggaatgtgattgtatttggagatgggtcattaaggagtaaattaaagtaaaatgaggtcacatgggtgggccctaatccaataggactggtgtccttataagaagaggagatgaggacacagatacacgcagagagatgaccctgtgaggatacagggagaagacaccatctacaagcccaggagagaggcctcaggaggcaccatccctgctgacaccttgatctcagacctctagcttctagaactgtaagaacaattgttgctgtttaagcattcccatatgtgggactttgttatggctgcctgagcagcctaatgggagtgcaaagactttctttaaataatgtataacaatgttggtttggaaatgactatccagtgttgagttcaaaactttatctttatgggtgctgctatgagtgagtgtctaatttgggggataatattgacattcttcgggagaaatgcagactccaatcagtgcagaaaatggcacagaataatgtttaaatatgccctccaggccataacatggttgggttaggaggaggaatattaaccattcccatcctaaaacacagaattttgggtttctttctgtgagttcaccacctctgaccttcacaggtaagggaccatcacacagacatctgccattttcatataactctctatccaaacaaaggctgaaaattcagcatggagaaactctcccagcacccgtggtcatccccttgacctgcatccccaccctgggcactggtgtgggggtgggattctttatgaacttgggccccaattctgctttccctggaaagctggacccacacaacatcaccctcatatgcagaccctcatgtgtgggcacctgtgaatacccagagctgggggtctgctctaggagctggttcaggacaggatactcccatccaatctgtgcccaccatagaaaagagccagccaagtgcctgctactacagggctcttcacacatggaaaagctgccctgtggaagtgtcccaggaaagggcagggggacaaaaaaaggtcgcagtgatttgcctccagacactggacactcttccctggagagtacagggcatgctgctctccaaacctgatcttgctacatttgtgctgcccacagtagtggtgccactgagttttcaaagaagacagcaggccctgaattgtgcaaggaaaataagtgcttgaattttgtagcatgcatgcagtgttctacttttaagaatggtaccaggctcctctgatattcaagaaaggcccccaacagctcagatggtagttttctaatcctgtcttcccatatgcacatttacctcctccacccaagaactgaataacagacatgagtgctcaggacgtcatgctgtctactgtcatccccttcctgagaccccctctccaaatctcttgacaaccctcttcttagctccctctttctttctggcctgttacactcaacctctccagcatcctaacaagtacccactcaaacctatttcctcccctgctgtgctgcttcttcaaaagtgctttgcttctcatcctcaccttctttccttgccctcttccctgcttccctcttcaaagcacttctcagctacaaatgagaaggaagcgatctgattaaacaggtgatgagcagagtcacattctgaggggatttgcatttttaaaaggagattaatgaccacatctgaaaatgccaccctggaatcttatgcagagtgacaggggattggggatgagctccattcagggcaggaagtgagagtttggatctgaagtgcttttcagatgctgaagtcataggaggttgcagttgcttcctgggtggagccataaacaaacatctcttctgctgagtgaagtctgagaagatagaggcaatggtgacccaggagctctggaattatctggctgtgttacacttgcaggactacacacatttaagtgtaaaaagcatgctttttgtccacttggctgacctcttagcctgctctcctcttattgttcccttgaaggcatcattttttaaagagaaatttaaactccgtccatctcatcccctttggaagaaagttaagattcctttctgagctctttcatcatctggagtttaaaagcttcccctcctctgtcaactctctttgaatccctcatgtcacaccaaacttcaaaagagacaaataattttgcatgactccctgcaggctccattttgccctgtagtgacagccccatgtcttgactttcctgattggaaaaacttctcaagctttctacattcatgatctctgcttcttcagtgcaaccttctccagtttgtccctgatgtccaatggtccctgcattaatcctgtccaagccacaggtgaccctcatatcatctcagcttctacttcccattcctctctctctctttttttttttctgagacaggggtgtcactctgttgcccaggttgatctcaaactgttgagctctaaagatcctccggcctcatcttcctgagtagctggtaggggtgtgagcccttctgcttggtctccagtcctttgcttttcttttttgacctatacaacatttggtagttgatgtccatgttcatgtaattgtcttctctggcttcttggggccacagtgcattgccttctccctcttttcatttattatcttttcatctagtaagacccatcatcccctaaagatgtatattttcttcaaagcaaggattggcgtaccttcacaaactgagtctccaatgacaacataaactgaaatgcaatataaatcatggacagatgtgagctcatcttctgcttcctgtgtcctccgctggttcttcttaccaacatcatgtattgttaaataagcgagtgatattaagttagagaatggactgagtccattaattcatttggcacgctccaaagtcctcacctgagatctatctactctccaaattacacttgttagaaatacaggaggggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaaatacaggaggatccttttcacatgagctaattagggtgaatacatgtaagtgttggtaagaagtactagaaacactggaatttgtgagatttcactgaagaaccagcttccacccagtccttcacattgttctcttttggtagtttcttgtcatttcctccttttattatcaatagagctgctgtgaacatgcatgtacaagtttctgggtggacatatgttttcatttttattggggggggtagacatcaaagaatagaattgctgtgttgtatgatgagtctgtgttctaacatttcagaagctggacttcaactgcttcctgatttcaccttccacaccatttctgtagtgaggcccactccttggccttataagacctgaattaagttaggtgcccagagccgttctgtcatcgactctgttctttcccttgctagcctgtgtaataattggcaatcagacctttacatgagcaatggtttcatatgtctccccaactatattacaagttccacaggggcagggctatgtctatctccttgacctctgtatctgcgatgcctggcagagggctatgaacactggttacgctccataaacactgggagacaaagaagggtgtcagtagagttagtttttttgcttttttacccccagaactcttagaaaataatttgagctattccttcaaggaagtcctggggcaggtgatcattcatagatgacatgagggagtgcacagcacatgagtttgcaggaaaatgcaaaccccacgttgaaatttgatccccaatgttggagatgaggatttacaggggggtgtttgggtcatgggggcggatccctcacgaatggcttggtgctgccctcatggtaatgagtgcgttctcttttcagtcctgcaagagctgattgttagaaagagcctggcaccttcctctcctctttctcttgcttcttctctcaccatgtcatctgtgcacacagcagctccacttcccattccaccatgagtggaagctccctgaggcctcaccagaagcatatgctggtgcaatgcttcttgtatagcctgcagaactgtgagccaaataaacctcttttctttataaattatccagcctcactcaggtattcctttatagcaatgcaaaactgactgagacagggtatcaggagacctagctttgcctgaatctgagaacttcatcaggacttttggaacaatttagcccacaggtccaaggctgatttttgtcacagtgaagttcaggtagtaagaattctcactggtggctgttgaggatggtggtggtggggatgggtcatatggagaattagcagtgggagactagaaattaaagtggagaaagggaagaattaaaagtcaaaaacagtgtgagggaggaaagcaatggatataacacctcaaatctttatccttgagaggccttaaaaaatctacttaataataatcagatgctattctataagtactttgagactagacatgtgatgacttttaggaacctgtactgtggctgaaaatgcatgcaaatctagttgactcagatccagtcttaactggctcataacttgcttcatatgcatgactgtacgttagcaaggaaatgagagagaataacagcacatcacataggcatgaaaagtatttgcaaagcagcagttctcaaaaatgacattttgcagtgttttccagaagcagattcagaaaactgaagaccaaagtaatgatggagccgtctcatgcctagatgagcagaagcataccaaaggcttagtatttccccaagtagtaggcacctcaaacttatttaaggaaaatactcttcttgatgaaacagatactgcagtcgaagcaggaatgtgtttggtgtgctgccttaaatagcatgggtagatgttcaaacatgttaggactcgctggccctaggaaagacccgcaagtagatactttccacaccaggaaagtgacaatgaaacaccaaacaccttttctcctctaattaccaaggaaaatatttctttcccaatggtggaagacaataatgttgggaatgatgaagttttctggagtgtgaagtggatatgtcttataagtttaatccacagattcaccacttcataagtggataatcgaattgtgcctcagtttcctcagacttggggatattaagagaaccctcagtcaccacaaggtgggtaccagcataagaaaagagtgtagcaaaagcccaggggtgcatgttcttaaagtgcctagtgtgggattagaatgacaagtggtagatgacctacttgtgcagaaatttagagttattttgtgattttcaaatgatcatgggtgctttccatatgctgtccagactaggggtgctgcagctagaaagggaagaaggtttccatatttcctgagattggagtcacatcctctcaccaatgcactcacctgctgactaaccagtgtacttctgggaattgcaaatgcatgaaatggcacccattctagactagtcgcggcagtgttggtgatggccacagaccaggaacgaccttgacgtttatccgtagggaactgggtcatgagccatgatccacatcatggatactgtgcagctgtggcaatgaatgaggtatccttctgtctgtgcaccgggaaaggtttccaagatacactgcacagtgagaaaaacaagaagcagaacaatgcacggtgtgctacctcttgcattacaaaggaggaaatgtaaaattaatttacaaatggccaataaacacatgaaaagatgctcaacatcactaatcattaggaaaataaaaatcacaactacagtgggataccaccttacatcctttacgatggttgttcccaataaaaaaaaaaaaaggaaaacagaaaagaaaagtgttggcgaggaggaattggaatgcttgtgtagtgtttgtgggtttgtaatatggcacaacaactgtggtcatttctcaaaaaattaatcatagacttaccacaagatgcagcaattcggcttctggtgtattccaaaaagaacggaaagcaggggccccagcagatatttgcatgtctttgttcatagcagcattattcacaatagctaaaagttggaaacaagcccagtgtccatccatccatgaatgaataaacaaaaagtggtctatgcgtacaaacaaatgggattcagctgtaacaagaagggtgattctgatgtgtgcttcaacatgattaagccttgagttctttctgctaagtgaaataatcagactcaaaaagacaactactacatgattccacttaacagaggtgcgtaacgtcatgaaatgcataggcagaaaatgaaaaggtggttgtcagcggctggagggagggggaaagaggagttggtgtttaatgggtacagaattccagttggggaatatgaaaaagttctgggtggggatggacagtggtggtggttgaacaacaacctaaatgtacttcctgccactggatgtacacttaaaagtggttaaaatgggccgagcgaggtggcttgcgtctaatcccagcactttgggaggtcgaggtgggcagatcatgaggtcaggagattgagaccatcctggctaacatgatgaaatctccgctctactaaaaatacaaaaaattagctgggcatggtggcatgcacctgtagtcccagctactcaggaggctgaagcaggagaagtggttgaacccgggaggtgaagtttgcagtgagctgagatcatgccattgcattccagcctgggtgacagaagaggaacccttctcaaaaaaaaaaaaaaaaaagacagaaaaaaaagaaaggaaaaaaatggttaaaatggtgaattctatgttatatatatttcacaataatttacaataattcctattgttttgcataaaacagctgtagaaagctttgcaggtcatgaacagcacagctggccactggggctggcgtggggctaggacctgggtgcatagggaacagggatgagacacaggctcttcatgcctgcacacatatacagatacacacagatggaaattactgagccatctaaatacaacacctattcaaaaaatcaaacagaaaaaggaaatgtaatggggctgaaggatgagggtaggtggggtggctgctcaggaggactgtggaggccacatcgcctaaccttcgaggcctctcttagcagctggagtgcatcccggggacttgggagctctggaaagaggagcaggaaagggccatggccggaggaggcctgaaaaagatcatctctgccacagagaagaagctggctcggatgctgctggcccctatggagacagggagacccggggagacaactgtattcattcaaggaggaatgggtggtgatgcaaacttgggtggaggccacagggtgcagaagacaggacacagcagagagagatgtaggacatggaagggacagaaaggagtgaccacaggacataaaggggcaaggaaagtggaagcatgataacatctgctgggcatccggctgaggggttgggtgcctagggtgcccttccctaagggagaaccccaggagcagattcagagaaaaccgcccagctcactccagcaagaatcagaaaaggaccggttaaaggagagggtaggaaggtcaccaagctccaagggccctcatgaatccggcttggaggccacagggcccagggcaaggacaaaccacaggcacaggacagctccggtcaagatcttctggctactgcaggaggcagaaaccacaccctgcaccctgcactgctgaggctggcgctggagtccagaagcttctacaccagaagcttcggtcccccatccctgctcaaaaaattaaaacaaaaacaataacaaatcggtgtcatgcaccctctgcttcctggtgctgttcgggaccctgagtctttcacgggagcacctgatggggaaagcctggacccgtgtcggtgtccctcctgcaaggagtgctgggaaaatgaactttccagcttcctccttgcgaaggcagaacattccccatgtgtactggtggcatttaaaaactgcagggcagccagagaacatggactgtgttccaccgggagagttcctggcgggatgtcccggtgcagaagcccgtcccaaggtgggtatttgagctgaggaactgagaagccggtttctgcctagagttagagatccgagaggcatcagcacatggaagggagggaatctacgatgcctcgagggtgggagatcagatgaaccaggagaggcagggcccgggaggaaccccggggagcagcctcctttaaagcctgggggaagtagcttcagagaaggtggggtaggttgggtgggggttgctggaaaaatataattaagaaacaaatttctgctcagcccagaaacccccctcacatccatagaagtaaaagaaacttgtcttatgattgagtaagcattaagccaaaatgtgatgcaatctgctaagagatgacaaagacagaaagaaatcccacctttgtatccagccaagcaggtgcaacccgttacacacatggtctccagatagatggtgactagttcccagttgagaggactcaacggcaccatttgtcacacgtagttcatcctaaattcacccagtaactgtgttgattctctgtgtggttaattggctttatccacaggaaaaagaaacctctcatctatgacaggaggtagttttgcaactgggagtgagatgcccccagaactgaggttccttccttctcacagaaactgggagacaggggtgctttctgcccggatgcctgcctttcaaagagaggtctcctatggccttgaggaggagaattctgggttgtgaggcaggcaagatacttatgtatgctttagaaagctttgcatacatcttcaagggatagagaaagagttttcaattacacctcttctaaaaaaaatgatctcaaagtccagcctaggcaacacagcaagatcctatctccacacacacaacaataataataaatttgctggacatggtggggtgtgcgtgtagtcccagctactcaggaggctaaggagggaggatcacctgagcccaggatgttaaggctgcagtaagcttagatggcagcactgcactccagcctgggtgacagagtgagactctgtcaatgaatgaatgaatgaataaatgaatgaatagaaaatgctctgagtgaaaagaggagagtctctttatctttttgcaacaggctaaacaaagtttttaaaaatgtatatttgcctcacagagattattccaggaaaagaagtggccctcagtgtcaaaggatgcaaaactaacctctgagttcctggcaggtttagcaataaaggaggatgttgctgatctcagtacaagcaatgttagagaaaggggaagatggaagtggacaaggacgagtgagtggaaggtgacaaatggaagcaaagaaacgtatccagaccattgaagatgcttgagcgagaagaaagaggcggtggagggaatggaagcccgaggaagtcatatgttgcaataaggggcctcagagcacgtgtagagtgtggagcagagcccttgcagaggggctgtggaaggctggcagggtgcaggtggccccactctccgtcaccctgaggagtgtgtggtcagagttaaagctcagtctgtttctgggatcaggtaagaggtgagcgtccggagaagacaggcggatcttcagatcctgcagacctccaccgtgccctctgtccctctcgactgctttttctccatctccattgtctggctcacattggtgtcactttttcatttctccctgcccgtcttttctcttttctcctctctttttcttaacccttgtacctttggaagtcccactaacagaatttaaacagcttttcaagttggttttttgttcccagaaattgattttagactctccatgaataatgtggaaatcaaatgagtataagctggttcatctctctgcaaataaacaaataaaatctacattccaatgtttcttcttccagagtagcccgcacttgattttttttttaattactgtcacttgcaatagatttttaattcctgtaacctggctacacaaataccatggggcaaaagccttacttcctgtgagaggaaaccaggcttgactagcctcatgctggctttgaagaagtaaaatcaggggttgatgaatttgcatagggtaaatatcaaaggtcaaaagtaaacaataggtggtagagggaataccccaaattataaaagaacaaactgtttaagccacaacagaattatcgtagaaataaaccacggtccttcctgctaaaatattccacttagaattgtaaaatattcttctcaataactcctggaagagcctactcataaattaatgaggctgggagcagtggctcacacctctaattccagcactttgggaggcctagacgggcagatcgcttgaggttaggagtttgagaccagcctggccaatatggtgaaaccccgtctctactaaaaatacaaaaattacccaggcatcgtggcaggcacctgtaatcccagctacttgggaggctgaggcaggagaatcgcttgaacccaggaggtggaggttgcagtgagccaagatggcaccactgcactccatcctggatgacagagtgaaactccatctcaaccaaaaaaaaaaaaaaaaagaaattaatgaatgtaagagcatctatgttccaaatgcagtgtattattttatgcaggctttcacaagctccaaaagattcaccgtgcagaactggacgttctagagaaagaccacgcctcctcctgcaggtaactcttcattcaggaagcagctcttggcttatccctgggcttagtggaattggaatacctgaccataggacaccaagggctttaggacctgagtggcacatcgtgtcctggtgacatctgagttacctggggcgtgcacagcagcctccagcatcccagggagagctgtgtatggggtcaggctcaagcaggtcccagggcaccagtgacccaatgggtgaatcagactcccgtggcacctgctccttctgtatctccctctgccatatatatgagctcatgggaagcactgtaacctcttacagaggaggaaagttcatggacttctagcttctagaactgtgatacaataaactcctgttgcttatctactcctctgcagtattttgtcatggcagccctagcaaactactacagggactgtgggggttaggatgacaccaagcatcaaatgccactccctgttccattattatgtaatgtccctctttgtcttttttaactgctgttgctttaaagttagtttttttgatataagaatagttactcctgctcacttttgtggccatttgcatggggtgtctttttctacccttttaccttaagttcatgtgacactttatggttaggggagtctcttgagggcagcagatacttgcttggtgaactattatcaattctgcaattctgtgtcttttaagtggagcatttaggccacttacattcaatgttagtattgagatgtgaggtactgttccattcatcctgctatttgttgcctgaataccttggttttattcatttatttattgtatttgtgttttatacgtcctgtgagattcatgctcaaagaggttctgttttgatgtgtatccaggacttgcttcaagatttggagctccttttagcagttattgtagtgctggcttggtagtggcaaattctctgagcatttgtttgtctgaaaaagactgttatctttcctttatttatgaactttagttttgctggatacaaaattcttggctgataattttttttttttttttctgagatggagtcttgttccgtcacccaggctggagtgcagtggtgcgatctgggctcattgcaaccttcgcctcctggattcacgccattctcctgcctcagcctcccgagtagctgggactacaggcgcctgccaccaggcccggctaattttttttgtatttttagtagagacagggtttcaccatgttagccaggatggtcttgatctcctgaccttgtgatccacccgtcttggcctcccaaagtgctgggactacaagtgtgagccaccgtgcctggcctgataatttttttttaaggaggctgcaggtgggtatgcatgctcatttgaggtgttcttcccttattgaagattactaaaatcacatgtgttgaaaagcatttggtattatttacttaattgatgagtacccatttatttttacattaatttgataccatgtataaacaatatataaacataggtatggacatatacatatgtgatatgtgatacagcatagaacatatacttgtgcacataaagatagagggagacagaaatacttcagatttttgattttaaaactttatgcatgaacacataaaactcactgttaaaaaaaatagctggatttaagttgtgcttttgtaaatagaaaaagttaacatttatctgaggaagcccttgctgagttttagagaaagtaggtagtaaatttacatctcaaagcacacacaaacacacacacacacacacacacacacacagagagaaggagtttgggtgtgttcaaggaagattaaaagtagatgccaaggtaacacaaaaatgatagaaatttataacaggattttataaggagaccaattttatttccatacatagcttttattttggtctctgttttccaactttactccaggaaacacactacacaggctcccttcttaagtgctggtgggccactgcacatgcagacagcccactttaagggaagaatcaggggagaagagatgcagaccccagaattatgccaacatacaaaagcctaagtcaaaggtcaaaccacacacttgaaatctcatcacctgtttggccctgttttaagtgtgctttactttctttaatttctgctctaaagcttttaaataaactttcactcctgctctaaaatttgcctaagtctcttcttctgccttatgacacttagttgaattctttcttctgaagaagcaagaattgaggctgctacagacttgtacagatttgctgccattaatatagtttagtgccattctacatgatagaatatatatattcttatatttatatatatatatatatataaaatttatgtattcatagaggccttgaatctacattcttgctgcactttatgtaaacaatccaggtataagactaaaacttattttggaaatatattggtcccatatgatttctatttcataaaaatgggagacaggagggggaaaattatttttcagaaggaaacaacagaaaaatggttattacattttagatctgttcattttttttaaattttgttatttacctacaatttggactgaatcctaaattttttcctggctacaaatttcaaaactaatggtttcagaattttcttccatttttcttccattttggtatattataaattaaaactgtgctttttaaatttttatctttttttaattacacttttaagttctgggatacatgtgcagaacctgcaggtttgttacataggtatacatgtgtcatggtgttttgctgcacccattaacccatcatctaccttaggtatttctcctaatgctatccctcccctagtcccccacccctcaacaggccccagtgtgtgatattcccctccctgtgtccatgtgttctcattgttcaactcccacttttgagtgagaacatgcggtgtttggttttctgttcctgtgttagtttgctgagaatggtggtttccagcttcatccatgtccctgcaaagatatgaactcatccctttttatgcctgtattgaattccatggtgtatatgtaccacattttctttatccagtctatcattgataggcatttgggttggttccaagtctttgctattgtgaatagtgccacaataaacatatgtgtgcatgtgtctttatggtagaatgatctataatcctttgggtatatacccagtaatgggattactgggtcaaatgatatttcttgttctagatccttgaggaatcgccacactgtctttcacaatggttgaactaatttacactcccacgaacggtgtaaaagcattcctatttctccacatcctctctagcatctgttgtttcctgaccttataatgatcaccattctaactggcatgagatggtatctcactgtggttttgatttgcatttctctaatgaccaatgatgatgagctttttttcctatgtttgttgctcacataaatgtcttattttgagaagtatctgttcatctgcttcacccatttttgattggcttatttgttttttttcttgtatatttgtttaagtttcttgtagattctggatattagccttttgtcagatggatagattaaaacttgcaagctgaaactcgacgacttatgtaaacttctggataaatcatagcaacttatatataaacaacctttgtgcctgctgatgtgtggactacacaaaaggtacacatgaacactgtattcagactgcaattcagaaaaatgtgtcacattgccattgcaattggaagatgcttcagaaactctagaaaacctagtctatagggttagagtgatgtttgccaaacgaattgctctaattgaagcagctgttgtgtgactttaataaggttccaggattatactgtcccttttttgctgtgacttccctttgcccttttctgatttgtcttcatccccttttccatggggcatgacttcttaagaatgagccttcctagtgatgtaggatgagatgaaacatacagtcacaaagtcatgtcttctatgatgctttatctgaaagcttttgaagaattggggggccaggtgtgctggcagaggcctgtaatcccagcagtttgagactctaaggcaggaggatcacttgaaaccaggagtttaagaccagcctgagctacaaagggagaccacgtctctacaaaacataaaacaaatcaaattagccaggtgcagtggtgcatgcctatagtctcagatacttgggaggctaaggtgggaggactgcttcagcccaggagttcaaggctgcagtgagtacactccagtcttggtgacagagcaaggttgtgtctctaaaagaagaaaaaaaaaaaaaaaaaggaaaggaaaggaacggggtaaacaggaaagccaaagatctcgggcatctccagatgattccctgaacaaattgttttttcttggcttcaaaacctttcaagatgtatatttctttgtaaaagaaggacatgccaattgtaactttaagtgagcaatccaaatccagctcctaaaaccgaagtattttaactctcattctgataatatttattttctgaggcaaagaagaaagacaagattagatcaattgtttctctgcccactccatctcttccaacctgccttctcccctttaatcaaatgtataaatactaagcctcctgaaacctcttcagagaaaacacaaaccacagaggttttttgcaactcatgtattcccagggtgcactatcaggctctggctcaataaaactcaactggtcaagactcttgcctcagtcagtcattctggataaccaccaggagtcctgcaaagcccttcagtaatctattgcctgcctaggtgatgtgtacctagatgagtcatatcttcatgagccaaacacttgtcttccttttctgtctttcccaaccctaccactcagtgctgtgtgctctgatctgaccccagttcccaggttgtttgtataggtctaagaaagcaagaccaggaggggcaggttgagaaggaagtaagaggccaacagcagtggaaagtggcaggtagagctgtcattgctcaaagccacacacactgggtgcattgtatgaatttttctggattcaaaatcttttccctgtgtgtctatctagaaactcaccctcctcctactttcttctcattacattttctgtttctagtgcacttgtttatgtccagagaatggccatgcaaatagttgacaatagaataaacaatgacgttttgtgagacttggtagctggcctttgttttttccaaaagagattgaggtttctaaaagctagcttttatgcagggctgtgcagttgtgagtgtagttttatggaacaggtgcataagtgaagggtgagatagaaaacaaaatgctggctgtttgtcaaatcctgaaagtgaatgggacaaaaatcatttttgaagaaggatgtcattcaggagaccttgtaaatcttagagtgtcctcttatcagatgaagtggaggatgaggttgaattatggagttaggtgacagtgggtacatacttctctgcctcagttttttttttttttttaatctgtaaaaatggggattgtggtacttgggattttttggtgaggaccgtagttaactggaaagctctcaggatagtgcctggtacatagtgaatgctgcatcagtgtgagctattataattatgggaatagacaaaggtgccaccctggccatccagagtggggagatattttctggtcagagtccaggcaggccagctggagatgaagctgattagtggggacgcttaacttccaggagtggaagaatttaggaggagtaaacagaatgcacaacattctgtaaacattcctttacccaacagtaggaatactcagagtgggtgtgtcttccgtgacaatcattatctcctgggaatctaaaaatgtgtcctagagtcaaatggctttgatgtaagccaaacccagaaatgggcttcagggctgcctggcacatagcattcattcatcttgaaaaaggaaagcattcatcttgctaaaggaatccccttttctggcccaggccattatttttgttttagtactatcctaatttttaaggtataaggagaaagactgaagaataaaataataaagtacgtgtatgaaataacagggtagaattgagactggtacgtgtaagttaagagaaattgtgtataaattttgtgtgaacagaaaaaggatttcttgttgcaaacagacctctccatataaataatacctattgcctcgagtggatagcagaccgcatcacaagaacattccagcagagtcatgagagaatggttagtgtggcttctttaattggcaggttagactgagtaagttactgaagagaaaggagttgaaggagaagatgggtgcgggcaagaaaaatgggaaggtgaaaggaaaggactgaaaggaatgtttaccaagggctcatcaggtaccaggctctgtgactaatgtcttacacatgttaatttactcttccactgtcattttctgatgcagtaagagtcagccttacactgcagatgaggaaagaggctgagggaggtcaaatgagtggcacagggtcatccagccacttcatagcagagctagtgtgtttcactgtggtttgtgccgacagaaaagtgagacatggaaggaaggcaaaacatttttgttgtgggtgatgtttatgaaagtgacccttatgaggcagaataatggcctcttaaacatgtccacatccgggctggatgcaggggctcacgcctgtcatcccagcactttgggaggctgatacgggtggatcacgaggtcaggagttcgagaccagcctggccgacatggtgaaaccccgtttctactaaaaatgcaaaaattagctgggcgtgggggcgcatgcctgtaatgccagctacttgggaggctgaggcaggagaatcatttgaacctgggaggcggagattgcagtgagcctagattgtcccactgcactccagccagggcaacatgagtgaaactctgtctcaaaaaaaaaaaaaaaaaaaaaaatctacatcctaactcttggaacacatgcatttacttttcttggcaaaaacactgttcaaaggtgatgaagttgagtatcttgagaaggaaagcttattctggcttatctgggtggctcccagtttcatcataagggtccttgtaagtgaaagagcaaggcaggaggctcagggtgagaatgatgcagtctgagagactccactggccattgcttcctgtgaacatgtgtgataagacaaaattataactaatttagttatagatgtaattggcttttatttgtgatttatgatttggggcagctctccctctacagatgcctcagcatcccaagtagctgggactatattgcgggatctggcctgcagcctgcaatgcaatggggctctttctttgttctcaggcagatcggcaggttgagaaataaaagacacacacaagatagtgaaagctgggtccagaggggtcaccgccttctggtcctgcgatgctgccaatgcactggatataccagcatttattattaagtttagtgagagtgggggtaggttagtgagagatttagggccatttataggctctccacaagggtcgcattccattcccagagctatggacatctgcttttctgggataggaatcttggtaatgtgaaacctccctgactgcatgtccgttcataggctctctgcagggggaagcacatcacgtgctgttggctcattctggcagtccaacctggcatttgtctttacacaatcctgcatgcaatttcgtatttacaataatcaggagcatttcatcttttattccatagcaatagtttcagggggtctccctacatctcccccttttctccaatttaaatgaaccatagcaatcatagcttggcactgatcacgattggattgaagaatatttttttccaattttacacatgaacaataaaccaatagcacaaattatacacagaacaaaattaacgatagtggatcctcccaaagattttacctattgaatggggttgagattagataacccctcagagatactgtctaaaacttcagcactgggtaaagcagttaagtgtgcttgagaagcttcaaaaatctgttcttttagcttgcttaagtctaaacttaaattatcttcacttccttgtaaatggcattttactgattcccagttgtgaacagactcattatgttggaatggagttatacaaaaatcagaagtattccaatcaggttgcatttgtaatctatgttctaaactcataattctatctcccatccatgtaacagaagcacatcatgtgctgtaggctcattctggcagcccaacctggcattgtatttacacaatcctgcatgctcttttatatttacaataatcaggagcatttcatcatttgttctgtagcaatagtttcagggcttctccctacaggactacaggtgcgcgccaccatgcccggctaatttttgtatttttagtagagacagggtttcaccatattgaccaggctgatctcgaactcctgaccttgtgatctgcctgccttggcctcccaaagttctgggattacagatgtgagccactgtgcctcgccaataattaacacatttctttgagtttttgtaattccagcacaagagaaaccatttgatatttgaagaatggctgcacaccagtgaaaacatctgtagattgcaccacacgagggagactaccagtatgactatcaggaggaaaatatcaagagtttggaatatgcaccttaggcaagatgcaaaccaactacaataggatagatcaaagaagaagccagaagagtctagtcattttaactaggcagcacatttaatgatttttacaactgagtctgtaatacccaatgtatttatccatgtgcaacaagaagcgtcagaaactgcacaggctcccctctgttcagctgatagagagcaattctattatctagcattgcatgtctatgttaaattaaaacagggagcgagaataggcaagtatagaagtggaagcctaaaaaaaactccatacatttgaggaaaacattgtgttacagatgcagctaatgtcagcctttgggtggactaaaggatctcttggtatgtaaaaatgtgtgggccaggtgcggtggctcacgcctgtaatcccagcattttgggaggctgaggcatgtgggtcccctgaggtcgggagttcaagaccagcctgaccaacatggagaaaccccgtctctactgaaaatacaaaattagctgggtgtggtcatgcatgcctgtaatcccagctactcaggaggctgaagcaggagaatcacttgaacccaggaggtggaggttgcagtgacccaagaatgtgccattgcactccagcatgggcaacaagagcgaaactccatcttataaaataaaagtgtggttgacatgatatatctgacactgttaacttactctcagaagctacttcttgtgaaatcctaagtacagcattattctgggaagcaaaggcgacaggcataagcaaggacaaattaagagaggtaagattcccatcatgattgatagtcttgttctgacatcttgagaaaactgtccacagtgtaaagtcatcaacttgttgtcttggtttgcagtttgagtgtctctaagttatggtgttgaacatttggtgagttcttagcggcccacacctcagacatgagagttttctcatgaaatttacattgagttgtccatctccagcttatatggcttcaggaacagagccactcttgttcttaattatttcattggagaaaattgaattggaagaactaaaagaattcagggtccagtccagtctaccagtggattataaatactcaaagataatgaacagtggttcaatctggtaacaggtgtactacagttctgcttttcaacatagtttttctgtctataggagtctctatttttaccaaagataattccagtaggatgaatttgtttgcaaaataggttgagtctcaccgaacttgcccagactttttacctaagtgcggcaagagtagcaatggaccatagaggctctttttaaacttcgctttgctagaagtttttaataagaatctcagattaaacttccaaaaacctcttgagactaggaagccaaaccaagggcaacttcagactttgcctgcattccctatgggtttattctatgtatattctcaaatataacatcccagtcaaagccttggtaatataaccgatgttttcaaatgtgtcctgttataaagagagcagatccttactgaagttgtgcaaataactttattaccataaacatatgaatactcatgaatagtttcccaattctggggcactcagcaaaagcaaatgtttcaatttttgtttacaaaagtatactttaccaattgttcaaggaaaaaagttcataaatctggagaataaaacattcaaagactcagcacattttcaaatagaaaattatgaaaacattatccttttgattatttattccaataaaattgagttttttttcttctttgtcttgaatttcatgaaggtatcagcctgttcattaaaattttgaaagttcttagtccagtggtatgatcttgaagttatcaggagcttgtattccagagtccttgtcagagtcttttccataaatctccttgaagaaaaagcaattttggactgtagctgatggtaaatactttgaggaagaatcaaagcaactgtctgggaatgacaaagatttaaaatgactatggttaaaaatctaatgagaatttattatggtaaagacacagctcacatagaaatctagttacttctgtggcataagacactatgataacatatttgatttccagaaatttcatataatttttataatactcattaaaaaaattttttttgagatggagtgtcactctctcacccaggctggagtgcagtggtgcgatctcagttcactgcaagctccgcctcctgggtccatgccattctcctgcctcagcctcctgagtagctggggctacaggtgcctgccaccacacctggctaattttgtttttgcatttttagtagagatggggtttcaccgtgttagccaggatggtctcgatctcctgacctcgtgatctgcccacctcggcctctgaaattgctgggattacaggcgtgagacatcacgcccagcctagaatactcatattattaacattcccataaatattatttagagaaggtttagcatcaattatcccttatttgaaaatgctttctataaatttaatatataaaataaggtggattttccgttcagcttctgtttctcaagaggattactgagttgttggtgtagcccattcataaataggaccaaaaaagtatagtcttatgtatgttgaaaaaggtccttaggtaattccagtacttccagcagaaaatcattgatttagttttaagttctacctattacaataagagttctccatccttgttacatgttagtagtgtcagggaagacttaaaaattaccaatgcctgggtccgtctccagacctttaaactggaactaatgggtggggcttgagcatccacttttaaaaatgttttccagtgattccaatgtgtagctctatttcccatcagatttctctgatttcttgtggcattcaattttttctattttggtatcatgattattttcaggtctcatttcctgtcttaggctttatgtctcctggcgtagggaccttgccttcttcatttctgtatcttttttaaacacatgaactggtcatcaggaaaaggtctcaaccacacataggttgtgtcctgagtctcaggttcacatgttaatcctaaagtctttgttctccacgaggtcagatgttgcttgtgatgaagggtgtggttaagtctgcagtgcagatggtggaagggatttcactgtttttagacatagcattggaactaagaattttatgtctatatgggtgaaggggcagggatgtgtaggaagacagttctaattaggatgaaggaattatactaggaagtagaggtaaaggaagtgagaaggcttagtaaatagaagaaatgtgaacttatcaaagtggctagagtagaccactggagattcttgattaagtgaattaactagattttagaaaggtaatgaggcagtcatatgcaaggaagatttcaaagtctggagacaagaagtcaagcaatactttgagaagtggttgagctttatgggaattgagagaattacagtattgagagatgttaaaagtaacgaagagggtttcatcatgtgaaattgtgtttctcatttgaatctgagaaacaaatgagcagaggctggagataattatgtctaaaagacagtggggtacagggagcataaaggccagggagaaagggaactgtaggaattagtgctgagaagcaggagtttagtggaggaaggaggagatgcagtcccagatacaagcaaataagtcttttccctctcccaagcatggcagtcagccctgcaggaaccaggataagagaaaaggccatcatacctgccagtcttcctgaaatacagaaatgacatcaccgctgctctattggagtaaagaaaggaagacgtcctattcctggaggagctgtcatggaaagaaaagaaaagaaggaatgaagatgatgttattttacatgggggagcttgaggaacaggcatgtagcatgaggtactctataattgtttcttcaaggactacattatttctgttggaaaattgatgggagatgattatattcttgcagttttttttccctcttaccatacttctaggttggtgatcagtcctctgtcaattctctactgcactcagatattttggaaggctttcagatgtgagaaaggctgattgctattttctatgtcattagaacttgccacctttgcacctttccatggttgcatctttttctcagtgtctctgttatggcagtcacgaatgagaccctgccaggtctccatggcaggcacctgatttacagaaggcccagatcagtacatttcaaattcaccacctcctttgcacagaaagcttctttcctacaggctcccaggaagggtgtgaaagcaagcctagttctctgaggatctctttaactccaatgggtgactggttggaggattccccatcagccttgcaaaaactcttagaattgcattggtacctaaaacttatttctctttccttttcacaggaatcagccctggatagtggtctgtgggttctcccatactaccttcatgcctgccccacattccctcagaggtgtcttccctgataaattatcttgtatgtctaatcccatcttggatgcatctcaattggtaaaaactaacataccaggcttgattctttgcacttagctttttttctttctctcccacaagtagtcagtagccatgttctagtgttctatgtgttacctctttttccatatgtatggaaaaaggaaggtactgttgaggtgcacttcctatgtgccaggccctgtgctcaatactttacctgtatctcatttaagccacacaataaccctgtcaggtagacattatttccattttggcaatgaaaagacagaagcttagcgtggtgtaaaatctttcctggtgtcatatggctagtgacaggtggatctgagatttgattctaggactatttgacctcaaggctaatgataatggtagtaatatggtagctgacattggttcctctgtgtgtggcatcttgtttcattgactgtattaaacctttaaaagaattgtatgaagaaagtagcctcattgcagttttcaggtgaggaatcagaggttcagagaagttgagtcttgtgcaagaaatttataactgtaaactcttacattaaaaaagaagaaagagctcaggtcaacaacctactttaatacttcaggatatgaaagaagaacaaactaaacccaagcacagtgaatgagggaaataataaggattagagtggatataaataaaatggagaatggaaaaataatagaggaaattactgaaaccaaaagttgattcttcaaaataaaatcaacaaaattgacaaccattaactagattgactaagaaaaaaagagaaaagtttaaaattactaaaatcagaaatgaaaatggactctgagcatggtgggtcgtgttttaatcctagcactttgggaggtcacagcggaaggatttcttgagaccaagtgtttgggccagcatagttaaccctgggagatgctgtctctacaaaaaataaaaaaccaattagctgggcatggtgacatgcacctgtagtcctagcatcttgggaggctgaagaaggagaattgcttgagcccaggaggttgaggctgcagtgagccatagacacaccactgtattccatcctagggtggcctacagagtgagagcctgtccctctctcttcaaaaaaaaaaaaaaaaaaaaaaaaagaaaaatgaagcgattactaccaattctaataaaataatgattatgaaagtagtataaataattgtatgctaataaattggataacctatatgaagtagacaaactcttagaaacacacaaatatatgaatagaactataatcagtaataagattgaatcaataaaagtaattgatgaaattcagtattttttcataataaaaacattctaagaatggaaggaaaccacctcaacataaaggcaatatgtgaaaaacccaatgctaacatcatactcaatagagaaagactgaaagctttccctgtatgagcaggaagaagacaaggatgcctgcttttgacacttttattcaatataatattgaaaggtctagtcagaaaaattaggcaagaattttaaaaaagacattcaaattggaaggaaggagtaaaattatttctgtttacagataacttgaacttatatgtagaaaatcctaaagatggaacaaatctattaggactaataaataaattcagtaatgttgcacaatacaaaatcaacattcaaacatcagttgtatttcaatacactaaccatgaacaatctgaagggaaattaagaaaaaaaaattcaatttctattaacatcaaaaagaataaaatatttaggaataagtttaaccaaagaggtgaaatgattatacccgaaatctacaaaatattgctgaaagaaatgaaagaagacatcaataaattgaaagacattttgttttcatgaattggaagactcaatttggttaggaggacagtgctacccaaagtgagctgcagattcaatacaattcttatcagaatctcagtgacatttttgcagaaaaagaaaaatctgtcctaaaatttatattgcatctcatgactctaaatagacacacagctttgaagaggaagaatgaagctggaggactcacacttcctgatttcagcatttactacaaagccccagtaatcaatacagtgtggtactggcataaaggaggacatagaaattaatgaaatataataacctagaaagaaatgcttgcatatatggccaaatgattttcatcgagtgtgccaagatcgttcaatggggaagggacagtgttctcaccaaatgatattggaaaagctggatatccaagggcaagaagagtggaacctttacctaacaccatgtgcaaaaattaacccacaatacatgaaagatctaaatgtaagagcaaaaactatacaactcttagaagaaaaggtccatgatactggatttcacaatgatttcttggttgtaacaacaaaagcataggcaacaaataaaattgataaattggacttcacaaaaatcaaaaccttttgtatatcgaagaacattatcaggaaggtaaaaaggcaacccatgaaatgataaaaatatttgcaaattatatgtgtgataagaaattaatttccagaatacatgaaaagctacaagtcaacaacagcagacatccaaaaacccaattaaaaaatgaacaaaggattaaaatggagttttctccaaggaagatatacaaatatccaataagcccatgcaaagttcctcagcatcatgaatagttagagatatgcaaatcaaaaccacaatgttacaccacctcacacacttgatgggaatgggaaatgttatagccactgtaaaaagtggtgtggctgtttctcaaaaaattaaacaataaattaccatttgatccagcaattccacttctggacatactccacatagaattgaaagaaatttgaagaaatatttgtactctgatgttcagagaagcattactcacactagccaaaaaatggaaacaaccaaaaagtccattgaaagataagtgggtaggcaaatgaggtgtatctacaattaaaatgttattcaaccttaacaaggaataaaattccaatacatcgtgcaaaatggatgaaccttaaagatattatgctaactgaaataagccagacacaaaaggataattatcatataattccatttataaaagatagttagaatagccagttacatagagacagaatgtagaatgttgtgtgctaagggttatggggagaaggagtgagttactgttcattgggtacagaggtttaatatggtaagaggaaaaagttctggaaatggatagtgtgatggttacacaacactaaattgcacacttagaaatagttaatggtaagtcttatattagatatatataaagtgtttggtagtcttaccctctctataattacacactttttggcactgcccctttcctgcgatgcagagccccaggggtgaatctccctatttctccagctctgcatcagtcactatcctccgtgctgtgtcccacatgctgtgcccacagcctcatacagccggtgacttcagagccaggacgcagctcaggagtctgccctgaggctccctctcttcttatttccctgcagcctggcccgggggaggcttggcttcaactggcagctcgatttagccaaattcaggacaggccaccagggctctttctccacacatgctggtcccaccccaggtggagtcaggcagggccagtcaccagaggagcctggagcagagcaggaagcagagtctgagctgctcctccctcacccaaggggcttccccgtctcatttgggggaacagtgtgagcttgtttcaaagcctcagatgttccttgtagctcatggaagaggtacaagaaaacaaagacgtggcagaaggggatgtgttggtgacatcgagaagcaacttgatcttgaggactctccttctcatccgtctctgaagtctcttctaccacatagggctcagggctgataaagccccctccctaactttcttaggccagacacaaggtcagccatgagaaaacaaaaacaagaagagagtctgtagagacaaattgggagggttcaggaggagaatttgggatttgcttgtgcccatgggacacaggctgggaataaaaatgttttcctaactcttctctgaaagccagatagactccacctaaaaccctattgccaaggatgctgggatccacttaccagagacttcgactgtcatggatttggagctttccttgccagtggctgagttacgaacagagcaagcatagagccctctatgctttgtagtaatttgggggataaagagcttttgttctgattgctgaaacttcccattaattgtccaagagtactatgccggtgggttacattccgcgaagcaggacaagtaaaggttttgtcctgaacggtaataggtgaatgaagggtaaattctggggaggtctggaccatctggagcaaagagaataaagccacaggtgatgtcatccgagggaaggggatgctcctggtctcttaaagggacacagtgaccctctgagccaagacacaccttcaagtcccagccgaaccccctctatgttcactgagctgaagcctgaggtattcacctgtttctccccaatcacaagctatgggcaccaagtctcccatgacaagagcgtcccctccccttatattcttggttaaggctgtgcctacccaggatttcccagggcagggagtcatggccagctcggatgtccagaagtaaaggtgtctatacttggaccggagaaagactgagaggactggcttgtggtcatttagagttaagctggtgtcctggcccacagaggaacaaaagatactcacagaggacattcagggtgactgggttactgcggatgccaccatatcggtcccgtatttcacattgatagggtcctgtttcatttctcgtgacactgggtagaatgaggatcctgttttcaatgggtcactttaccctgggactgactgggaggctctgaccatttagccaccacgtgtaggtgtagttctcacttttagggtcacaggtgaagggtaagacatccttattctccctgggttttgagttgttgatggtgatgtagggcttgggcagcttcgctgtgtggataacagagagaagattgtcctgtgtgacacctttgattcctccacaggcatccctcaatcagagttggcatctcccacctgtcatcccacgcgagtccttgaaagccaatagctggtgcatgtgtcacaagacagatgtatgatgatctaagggctcaaagactgtgaggccgcctgctctgtcttagggaagcatagactttctcaagtgtcaattgagcagcagtgttgggtcatggacagacacatcagtaggagtcacagcccctggtacccctcccagtccctccctaatcagttgactggctggctcaccttgggttccttacctggaatatgcaactgctgggccccttccaaattccatcctactttgtccccctagacgtgatttctctgcagcttccatttccaaggacattctagagatgagtaataatgggacttcccattgtcctgaaaccctgaatatactgagcagcctggcctgggactggatgtttcagcaaaaataagacagcagagaccatagtcaagcctggaggtcagttcagtctacaggcagtggaggcaaaaggtggggcagttttttgcaggtgtttcatgatgacttacttgaaccagtgacctctaaagatagagcagagtgcaaggaatgatctagaaagagtgaaggggacaggcaagagctggaggctttggagcagaaccatgttgcctgtcctgcgttcaagtttcctctccttctgcagagggcaggtgaggaccatgtggatctttccagaaatacatgtggacatttgcatatgcagaactgattggtggaaagggtgggaatgaactgctggaaatctggtcctcatggaccatgtgtgtttgatggatatgatacaaatttagagagaagttttgcaaatattttatttcattggacattctactctctgattccatgggttcgactactctagggacctcatgtaagtggattccagagtgaatatgagaagagactgctggtttccaggagctgggagtggggagaatcagaaattgttcatgggtgtgcagtttcagttatgcaaggtggggaggttatagagattggctgtcgagcttgatacctatagttcacacagattgagtatttcttatgcataagacttaggacaaaaagtgttttggatttctgacattttttgattctgaaatatttgtcatatacttactggtttagcatcccaaatctgaaagattcaaaatctaaaatgctccagtgagcatttcttttcagcatcagattagtaggcaaaagtgggaggtgataagccaaagatattcttgccctttttttttctctcaccacatttctagcttggtgattagtttttggtcaattccatactggccatgctgcactcgtatgtttttgaaggttttgggatgtgagaaagcctgattgctattttctgtgtcatcagaactttccaccttttcatggctgcatcatctttttctcagtgtttgtgttgtggcagtgattaataacagcctgtcaggtcagatttaggacagagttttctgattctgcaaaaaattttactgcgattctgctaggggttgcattgaatctgcaactcactttgggtagtattgtctttctaacaatattgactcttccaatccatgaaaatgaaatgtctttccatatattgatattgcatttaatttctttcagcaatgttttgtagtcttcagtgtataatcatttgacctttttggttaaacttattccaaaatagtttattccttttgatgttaatgtgaattgaaattcttttcttaatttcccttcagatagttcattgttagtgtatagtgtaaagaatgatctagaaagagtgaaagggacaggaaaagctggtggttttggagcagaaacatattccctgtcctgggtttttgattttccctctccctttgcagagggcaggtggctcttccctgatagctagatagacttcactggaaaacatattgccagtcctccagggatccactcaccagggactatgatcctcttgattatgagatttgttccaccaatggctgagttatggatgaaacagacatagacccctctatatgttttggtgatttggggtataaataacacttgtgctgattgctggaacttcccatcaatcagccaagaatgctctgctagtgggtgagagtctgtgaggcaggagagcttggggacttcccttgtatggtaataggtgtatgaggaagaaatggtgggggcatccaggccatctggagcaaagagaataaggtcacaggtgatattgtcagagggaagggaaaatcctggtctgtggaagggccacagttgccccgtgagccaagtcgcaacactgaagtcccaagaaaatccctgctgtgttcactgatctggagagtgagacattcacctgtttctcccatcacaagctctggaccatgagtctcccatgacaggagcagcctcttttctcctattgtggatcaagcctaggcctactcttgttttcctggggcagaaagtcatggccagttttgatgtccagggataaaggtctctgtacttggacctgagagggactgagaggcctggcctctggccatgtgtatttgggatggcagcgtggctcacagaggaacagaagatagtcacggaggagattcagggtgaatgggtcactgcggctggcactcactgggttccgtatttcacattcatagggtcctgcagtatactttgtggcaccaaatataaagagggtcctgttggttttggacagctgcaacctttgagtggtagggaggttctgaccattcatccaccacaggtagcttgcgttcggagttgcaggatcacagattaagatcacagcctccatgatctccctggggtttaatttgctgctggagatggagggcttgggagtctccactgtgcagaaaacagggagaagattgccctgtgtggcacctttgattcctccaaaggcatttttcaatcagagttggcatttccaacctctcagcccacccgagtccttaaaagcccatggcaggtgtgtgtgttacaagacagatgcatggcaatctgagggctcagagattgtgaggctgcctgcttcatgtgggagaagcacagactttctcaagtgtgaattgagcagcagcattgggtcatggaaagacacaggaccagcagtcacagcccctggtgcctctctgagtccctccatctccaactgcctgcctggcccaccttttggtcctcacttggagcatgcagtgctggaatcttcttagcttcagtcttactttgcccccgaggcatgttttctctgcagcttccctttccaaggacatcctagagatggatgatggaacttcccattgtccttaaaccctttgggtactggaaagcctggcctgggactgggtacttcagcagaaataacacaggggagaccagagtcaagcctggaggtcagttcagtcatcaggcagtggagccacaaggtggggcagttttcccagatgtctcatagtgactgacttgagccagtgacctctaaagatagagcagagtccaaggaatgacctacaaagagtgaaggggacaggcaagagctgatagctttggacgaagaccacgttccctgttctgggtccatgatgctcccttccccctgtagagggcaggtgaggaccatgtggatctttctggaaatacatgtggatgtttgcaaatgcagaactgactggtggaaagggcaaacatgaactgatgatggaagtctggccctcatggaccatatgtgtttggtggatattagaccaatatttgggaagaagtcttgcagatactttctctcattagacattctactctctgattctgagtttgactactctatgtacctgatatcagtggattccagagtgaatcagagagtagaatagtagtttgcaggagctgggatcaggggaatagggcgttgttccgtgggtgtgcggtttcagttatgcaggatgaggaggttctagagatctcctgtgcagcctcgtgcctatacttcatgcagatacagtgctccttatgcagaaagcttaaaacaaagtgttttggatgtctaattatttttttattttggaatatttgcagtacatgtactggtttagcatcccaaatctgaaaaatttaaaatccacaatgcgccagtgagcacttctttttagcatcacatcagtggtcagaagtgttgagttttgagcatttcagattgtggatttctggatttcagatgctcaatttgtaatactgtaattttcccataaaaagttttcaggactttagacctcatgttatgttctgactctagtaacaaaaaaaaatttggaggaaacattgaaatgttttcataagtgggaatttttactgatggtccaaacatctgagatcaattgctggtagtagtatttctcttgaggccaacataaggtttaggtgtgccatgaattccagcaggatcacattatgctcaaagaaagatgccaaaggtgatttgaaattagcaactccttaagtagagagagtcccgttaaaaggacaaaactgggtagtgtgtcaattacataaagggaggaatgatgccaaattaaaagaagtgatgtgtgttatgttagtaaatatagaaagaactccctgcttctgctttctgtgccgagttaggaaaaatcgggaggagcacaaagcaggtatgtgaaatactttcttcgttctctcttaagttcaggaaataacactagagtttaagtttgtgtgaattaggaagagtctaagtgagatgccaatggctcgtgtgtctccccacaggaagaactcgaacttatgaaagcagcatcatcatgaggaaacagttgtatgtggcacaggcagtaataccatcagatagcacccacctggccacctccagctggtccccaaaaccaccagtattcccattacatgtaggttacagcctttgtagttgtcccacaacaaagaaatttaaaaattgctattgtcaaaacaaaatattaaatatgaaggcgaatatgttgttccactttttttccccactctttttgacctttcttgtttcagttttggaagtttctattgacacatcctcaagctagggattctttcctcagctctgtgcagtctaccagtaagcatcaaaagcattcttcatttctctaacagcattttttattttctgagacagagtctcactctgtcaccccggctggagtgcagtggcatgatctcagctcactgcaagttccgcctcgcgggttcatgccattctcctgcctcaacctcccaagtagctggcactacaggtgcccaccaccaagcccagctaattttttgtatttttagtagagacggggtttcaccatgttagccaggatggtctctatctcgtgaacttgtgcccgccttggcctcccaaagtgctgggattataggcatgagccactgtgcccagccatctctgaaggattttaacgagttgttgacttttgagtttgttcagtttttacttagcgttagaaccgagtgacaaatttcaagcttgttatatgcctgacaggaagccagaagtctctaggaagtgactggagaatgtgagctccacagcaggttgaggatggagtcacgagtgaaatgagcccatgggctttggggactgcaggcctgtccagcctctgacaccctggtgagtcagagcaaagattacaacagtgacaggaaactagcgtggctgactccatctggcatctagtctcaggctggctgtcctcactcattcctgggcataggccaggctaacattgggaggaatttagtttatggtttaactttgaaacaagaaagataatagtacctccataaaactaacacccttactttgcccaggggctgcctttctaaaactagtgaaagaccatgagattgagattataggagggaaccgaattctgctacaatgtaggcacagtttctataatccctgactgatcaaatgtcatttggccagagtttacaaaatttgtaactaattgctcccatagataacatcactattgcagaacgtgagattagtcttttgagatgtttttcattcttttgcattctggcaactggctgacctcatccatacccatgactaatggctcagccagccatgtggtccctacctagaagtggattcaagcacaaacagttcatttccctccgcccgcatgattccatcaccaaacaatcagcagtactcattttttagtcctgtgtccctgaaatcatccttggaaatgtctaacacctgatccactggggaggctgatttgagtaataataaacctctgtcctcctgtttggcagacttggagtcattaaaatctttctttactacaaaccaccatttcaataattttttttttgtgtgtgtgtttgtgtctgtgtgtgcagaaggccagaagaacttgtctggcaatgataacagtggatggagaactgcctatccctgtcccatggtcttgtccacaggtcagcctcacaaagggaaagagccctagatgggaatacattggaagctcattctcttagtgacctggggacattggctggagataaagcccggcaggagtggcaactccaggtgatttctacacctttcctatttcctgggaggtgggccaggccacagtgttagcaggaagggaacagaactgccagactaattagagggagtgtctggggaaggcctaggtgtggaggaagaagctgtgcaggacagggcttgccagtcagaatgaagtgggaggaagatgagggacacagagaagcagagagaggcagagacaccatggcagtgagcagtgagggagacactgacttcagagaccccaggtaccaggtgcccccatttcctcagtccaggaccaaggagccctgagaaccctccggtggccaaagagcttcagagttgcatgaggtggggtggctttaggggcaagaggtagtagggggatgaaacatgggtgtcagcctctgaaggacaagggacaggtgtggctaggacctcctaggattctgcatccaagatccagtctctaaagaggttttggatcattcatttcttcatttgattccttcatttgttatgtgagagctcctgagtatgtgtctctggctgggcctgtgctggtgcagggtgtgagtggggaaagaaaacaaggtcctctccttgatcctctcatgacagtaacatggacactttgggaaacacaggatttcaggttcagtgatgggggttaagatctgagggggaggcctggacattttttttgcactgactctgatggttgaggcaggtgatttagttctggagtacagactaatcagctgaccatttgctctcactcctctgaggtttggatgcctaagaagagaggatttgagccaataaatgactatggggtgcttgaaacccagtaagccctcacttctggtggaggagaggatgggcctgtggctgcagacagacctcatgtgaccctgatctcccctttgggtttgtgtgactctggttcaaagactgtgccttcctgtgcctctgttttctctcaatcaaataagttaactggcaaatggactgtggcttttcatgctatctgtgaataaatgttaaagtattcacagtcacctgacttaatgcttggcacagtggaggtgttcacacaaacagcatttattattaatttgcttccatgagaaagcacatttatgtcagatccctgtggacaagctgctaccagttacaccttctctcttctgtttctgcttccgggaacattagactttctatggactgtcctgagcctcccaaggcagttggctgatggcctacaaagcttgtctttctgtcctctccactctgaatgtcaggtgaagaaagctctgtccttgcccagatgaggctctgagggctgagccctagctggtgaacagctgcaggagacacagtcctcagacagctggaaaacccttggtcccagtaagccctgcccaagaagccacaacccagccccagtacaggctccttagatttatctgcagcaaggatttagggacaagggtctggggttgaggcttctagggctgagcttctctgagagtatctcaggtggcctctcaggccaagccctactcagttatccagggtctttctcagggtcaaatttatgaagagggcatgaggtgcctggctgagactgatctcctcctgctgagtccccccatcagactgtccttcctctgcagcgagtgtctgcagggtctggatgtgggaaaggaattctgatctgttgaaatttgtctcctctgtgtgtgtcctgcactaaatgcccaaactccagcatgggacataatgcagagggggacacaggcacagtccaggcctgacaatcctgtgtgtgtgaagtagaagtgacccctgtcccccaacacccagggatcatgtggaatcacttacggtataaggtgaaggtgaaatttccagttactcctctagtcccatcacctcgctgtatgatgtgtaaggtgtaggatactccgtcctcccgggtgacattctggatcagcagggatgcattggaatatactgtttctcgtccactgtatgcaggcccatatgtaattctttgaccgtctactacatatgatgtaatgtaatggtagaggtcccttatttgccctttctaccacatgtaaccagtaagattctggggcaaattgtggacaagtagaagaacatccttcccctcggaaactttgggtggctgggcttcagtcgtgacttgggcaatggtaggtgggttccagaagtttaaaagtgatgctaggaggtggagagagcatcagtcaatattgagacctgtgtattggtgtgaaaacatggggccctgggtcctgagaaggtctcttcagtcctcagccttgacaacacagacacacacacacatacaaacacacacacacacacacaaaagcggcatgtgtgattgtgtgtgtgtatgtgtgtgtgtcctactgtcctactaggtcaaggtcagcagcatgacgcccattccttcaacacttctgaccttggcatttttctgtttggaatcctcttccccaggggtccgcatggccccctccacactgccctcaggtcctgcttacatcagggcatcgttagacttctttcctgatgcctgcttcagagaccctgggtcttccctttctgacctttccctgctctgctccctccagggttcttgtcaacacctgacctcacattctagatctctttgcatgtctgtcttcccccccatgacagcgtgagctccgtgaggacagggacttttgtgatcttggttgcaccccagtgcctggaacaggctgcagactcctgtagatgtgagagttctcagggccctccatgccctgggtgttttttttctcccaattgttgaggttttttgctgaggacagcatttcatgtcctgcttatatttttatttgaagtgtcatctgatatagttattattatcatttttcaaaatgtgctggcctctgatgattaatcaggaaaacagaacacttaagattttcctacctcttaccaattccggttcaatgtgactttcctattttgacccctgtccctctctggtgtattttcccctatccaggcatcaacagagcgttctttccttttttttttctttttttctttttttttttttttgtgacggattctcgtactgtcgcccgggctggcattcagtggcactatctcggctagctgcaacttctgcctcccgggttcaggtgattctcctgcctcagcctcccgagtggctaggattacaggagcacaccaccatacctggttaaatttttgtatttttagcagagacagggcttcactgtgttggccagactgatcgtgaactcctgatctcctgatccactcgcctcagcctcccaaagtgctggcttctttcattttttagaaccccatcctctccaggagaccccatccagtcactctgcttcctcctcctgtcctctcccaggaagttctctcctcacctgtgagcaggacccccttccatttgatgtgctgtgtgcagggaggggctgagaggggccccatggtctctgctgcttgtgtgttctcctctgtggagatgagcctaggttccagaaacttcctgagcacggctgtaggctgtgctgtccttcctccttctgcgctgagcctcttcctggggcaggagcacttctcaggctcatgggtggggttaggcccaggacacctctctgtcccctcctctctacatcctgcctccttgtccctccttctgtttttccttttgtctgtgtttcaggtccctgggaattgtggaggcctctgcctttttcagcagtgattctttcaccaaacctcaacacacactttgtgcagacacaaacacacacagacacacacccccccccccacacacacacagaagagacacacacagacccacagtcacacacataccctgcaggttgggcaagcagagtcctgggcctcagcctccaggtgtccccatgggtcttggttgcggtgcacattcatgccctttgccctctttcatccccatctggctctcccttgcagtgcaggaggctggagctgcaccaggtccctgtcacagtgatgccccattgtgctgtgtgtgagctgtgtgttgcctggtgagaaggacccttcctttctctaatcgtgtctagcttggctgcagcttccaaggatggacattgaggacctgggtgtcacagaggaaagtgtcctacctggaggtgtgcagggtgaatctctcatgcctcttgggaggagaggcctgtgctggttgctctttgggggctgtgattcccatagtcaaagggacagttcttggtcagtctatggctccctcgggtctggcggctgagctgaagctcaggatttctcatgttcttcctgaccatctttgatgtcctctcttctctgcccagctgattgtcctgtggtcaccacaccttccccctggtggtgcaggaggaagtggggagtcacccaggaaccccgtgggacatggctcattgagacgcaggagggggagcctgggacagggcaggggttagaggtggagagattcatcccaacttactccgtggccatgatgggctcagccctccatgtgctgacatacccaggggtctatcctgagggttttgacctggtcaagctgctctctgtagaggaggaagaggcagtggccagagagcctgtctggagggaccttgctcacacctgagagggtgtgtgggggtgagttgtgttctgggatcaaagagcaataacaccccccttctcccagcaagcacacaggagaggtctgtcttcccaagggacagctgggggtaggtggccacatcccggatggtgcctgtgtgtgaccatcacacgcactctgagcaccccggggtgcagcgggcaggcaggtcacagggtgcctgactgattcccggggaggctgtgggtcctcaggcagccgctgttctgtgtcggcgctaggcttggcctgggatgccccagagaagaggacagatggagcaggggcgggtatttagagagcagtgacagaaagagttgatgaggatggagggaggccacgaggggaaagcaccccgtgtagcgtcgcgtgcaccagtgctgccctgggagatgcctttagctgggcccagggaaggagcaggtgtgtggggaggagctacctgtagggggagtggtgttaggttggtggccaccaggtcagggaggagctgacagagtccgtgtggggagcatggagagagctgaggacttaggccgaagtgaccctgatgagggtggatcctgctgggctgtgggttccgctgagggaggttggcatcccctaggaaggctccagggtgggagggactctgtcgccctctggtggacagggagggaagtgtgaacggcagcaatcccaggccaggctgcatgttttattccacatggatctgcacacttcacactaggtcacacatatgttatgttacagctccatcacccttccagccccgtgagtcccagtctctgtggctctatgttcactgttctccctttcacaatcagatgtcccaaacgcagatttttgtcactttctgtgagttcgtgtttgtatgcagtaggcggcactgtatataccctgggggcagtgatgtctagggctgagcagtgcacgtgggcttgggaggagaagagggagcagcagagtgggaatatcaatgtcagagggacagggacaagtcactttcattttctcactcccagggaccagaacccaggattctgactccagggcacagtaccacaccttgctggtgtccctggatgtcatgatgctcatagtgtcatgttgccttggcattcattttttaaggtgtaagtttatttgcctcaaatcagaggcagggcttggtcaccatggcagttttcaatactgtatctggttcaagtggctccagttggtgtccagagatcaaatcttagaggcatctctcctgcttggtgtgctgggctctcctctctccagctgctttctttaaactgataattctgacattcaccctcacatttaaagtgaccacctctcagtcacagcatgagctcctggtcccagtgtttgctgcttgctttgaacacatccattaaagctccctgctggaaatctgtcagataacaccctggacttaataaaggcattggcttaccggtctcttctctcctccctgcctgggctcactgacctctgtgtctgtggtctccaggtgtgccaagtgctccccagtgtctgtaagtagtaaaaatacttacactttcacgttgtggttgtattgctgtggcctcacatgccatccagggcctgacattgacgctgccttgtgggacctgtgctggctgagcccctgctggagctgttgttttatggtctctggttctgctggggacaggagcttccagctaacttgattgaaaaactgatgcctttcattgaaaacactgggtcagatgatgtattcatgggcttcagctgccataacaaacaccttagcctgggtgaattaaataatagaaatctatttttcacagttctgtgaataatgtgctattctaaccactttaaaatccacaatcaagtgaaattaaccacacacacagtgttaaattaccatcaccactattttccctagaaaatttttatcattttaaactgaaagtttgtatcttttaaacaataactccctgtatgttccaccctagaccttgatcatctctactctgtctctatgaatttgcctattcttgatgtttcatataaatggaattatacaattatgttatttcatttctgacatatttcacttagcataatgtttccaaagtccatgcatgttccagcgggtgtcagagcttccttcctctttatggcagattatcattctgttgtatgtgtcaccatatttgtttattcatgtgttgatgaacacttggattgttttcatattttatcttttctgaataatgctgcaatgaacattcccatgcaagtacctgtttgagtccgtactttgggtatatacctaggaatggatgttgtttcaaatgagaatactatgattagcttttgtttttgttattattatactttaagttttagggtacatgtgcacaatgtgcaggtttgttatatatgtatacatgtgccatgctggtgtgctgcacccactgactcatcatttagcattaggtatatctcctaaagttatccgtcccccctcccctcaccccacaacagtccccagagtgtgatgttccccttcctgtgttcgtgtgttctcattgttcagttcccacctgtgagtgagaatatgcggtgtttggtttttttgttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaagtatgatattggctgtgggtttgtcatagatagctcttattattttgagatatgtcccatcaatacctaatttattgagagtttttagcatgaagcattgttgaattttgtcaaaggcctcttctgcatctattgagataatcatgtggtttttgtctttggttcttatgctggattacatttattgatttgcgtatgttgaaccagccttgcatcccagggttgaagcccacttgatcatggtggataagctttttgatgtgctgctggattctgtttgccagtattttattgaggatttttgcgtcaatgttgataaaggatattggtctaaaattctcttttttggttgtgtctctgcccggctttggtatcaggatgatgctggcctcataaaatgagttagggaggattccctctttttctattgattggaatagtttcagaaggaatggtaccagctcctccttgtacctctggtagaattcggctgtgaatccatctggtcctggactctttttggttggtaagctattgattattgccacaatttcagatcctgttattggtctattcagagattcaacttcttcctggtttagtcttgggagggtgtatgtgtcaaggaatttatccatttcttctacattttctagtttatttgcatagaagtgcttttagtattctctgatggcagtttgtatttctgtgggatcggtggtgatatcccctttatcattttttattgtgtctatttgattcttctctcttttcttctttattagtcttgctagtggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgaagttagggtgtcaattttggatctttcctgctttctcttgtgggcatttcgtgctataaatttccctctgcacactgctttgaatgcatcccagagattctggtatgttgtgtctttgttctcattggtttcaaagaacatctttatttctgccttcattttgttatctacccagtagtcattcaggagcaggttgttcagtttccatgtagttgacctgttttaagtgagattcttaatcctgagttctagtttgattgcactgtggtctgagagacagtttgttataatttctgttcttttacatttgctgaggagagctttacttccaagtatgtggtcaattttgtaataggtgtggtgtggtgctgaaaaaaatgtagattctgttgatttgggttggagagttctgtagatgtctattaggtccacttggtgcagagctgagttcaattcctgggtatccttcttaactttctgtctcgttgatctgtctaatgttgacaatggggtgttaaagtctcccattattattgtgtgggagtctaagtctctttgtaggtcactcaggacttgctttatgaatctgggtgctcctgtattgggtgcatatatgtttaggatagttagctcttcttgttgaattgatccctttaccattatgtaatggccttctttgtctcttttgatctttgttggtttaaagtctgttttattagagactaggattgcaacccctgccttttcttttttccatttgcttggtagatcttcctccatccttttattttgagcctatgtgtgtctctgcacatgggatgggtttcctgaatacagcacactgatgggtcttgactctttatccaatttgccagtctgtgtcttttaattggagcatttagtccatttaaatttaaagttaatattgttatgtgtgaactttatcctgtcattatgatgttagctggttattttgctcattggttgatgcagtttcttcctagccttgatggtctttacaatttggcatgattttgcagtggctggtaccagttgttcctttccatgtttatcgcttccttcaggagctctttttgggcaggcctggtggtgacaaaatctctcagcatttgcttgtctgtaaagtattttatttctccttcacttatgaagcttaatttggctggatatgaaattctgggttgaaaattcttttctttaagaatgttgaatattggcccccactctcctctggcttgtagggtttctgctgagagatccgctgttagtctgatggggttccctttgtgggtaagtcgacctttctctctgcttcccttaacattttttccttcatttcaactttggtgaatctgacaattatgtgtcttggatttgctcttcttgaggagtatctttgtggcgttctctgtatttcctgaatctgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgttcatttctttttattcttttttctctaaacttcccttctcgcttcatttcattcatttcatcttccatcactgatacccttcttccagttgatcgcatcggctcctgaggcttctgcattcttcacgtagttctcgagtcttggctttcagctccatcagctccttcaagcacttctctgtattggttattctagttataccttcatctaaatttttttcaaagtttttaacttctttgcctttggtttgaatttcctcctggagctcagagtagtttgaacatctgaagccttcttctctcaacttatgaaagtcattctccatccagctttgttccattgctggtgaggaactgcgttccttttgaggaggagaggcgctctgctttttatagtttcgttttactgctctgttttttccccatctttgtggttttatctacttttcgtctttgatgatggtgatgtacagatgggtttttggtgtggatgtcctctctgtttgttagttttccttctaagagacaggaccttcagctgaaggtctgttggagtttactagaggtccactccagaccctgtttgtgtgggtaccagcagcggtggctgcagaacagcggatttttgtgaactgcgaatgctgctgtctgatcgttcctctggaagttttgtctcagaggagtacccggccatgtgaggtgtcagtcttcccctagtggggggtgcctcccagttaggctgctcgggggtcaggcatcatgaacccacttgaggaggcagtctgcccattttcagatctccagctgcatgctgggagaaccactgctctgttcaaagctgtcagacagggacatttaagtctgcagaggttactgctgtctttttgtttgtctgtgcctggcccacagaggtggagcctacagaggcaggcaggcctctttgagctgtggtgggctccacccagtttgagcttcctggctgctttgtttacctaagcaagcgttggcaatggcgggagcccctccccgagcctcactgccaccttgcagtttgatctcagactgctgtgctaggaatcagcgagactctgtgggcataggaccctctgagccatgttcgggatataatctcctggtgcgcctttttttatgcctatttcaaaagcacagtattaggatgggagtgacccgattttccaggtgccatctgtcacccctttctttgactagaaaagggaactccctgacctcttgtgcttcccgagtgaggcaatgccttgccctgctttggctcatgcacagtgcactgcacccactgtcctgtgcccactgtccagcagtcgctagtgagatgaacctggtacctcagatggaaatgcagaaatcacccgtcttctgcatcgctcacgctgggagctgtagaccagagctgttcctattcggccatcttggctccaggaccctatgattagctttttgaggaagagcaaaactgtttctcctagtggctgtacttttttatattctcaccagcaatgtatgaggattccaaattctacataatgctgccacttgttatttaacattttaaaagaattgtagccagttttgtaggtgtggtgtggtatctcattgcagctttgactttgtattttcctaatgactaatgatgttgagtatcttttcatgtccttcttgactatttgtatatcttctttgaagaaacatctatttgagtcttttgtccatttataaattggatggtttctccctttgttattgagttgtagctagttcttgatattatctggacatgaaaactgcctatatgtggtttgcaaatattttctctcattctgtgtctattaattattttcttgatgatttcctttgatgcacaaaaggctcacatcttgataaagcccaatttatcttttttttctcatgcttttgtatcatagctaagaatccattgcacatttgaggtcatcaatatttacctctatgtctattttaagatgtttttatggttataggtcttatatttaactcactgatcaattttttagagaattgtttgatatggtgggaggtagagttatctaaattcactgttttgcatgtggttatctagttgtttctgcattatcattagaaaggagaattgttcctccattaaattgtcttgacacactcttcaaagagtaattgaccataagtgtgagggtttatttctaggctctcagttctatcccatttgtctttatgtccattcttttgccagcagcttatgtctattctttgccagtagcttctgttttaataattgtactcctttgtgagatttcaaataagaaagttcaagtcctacaatttattttggcaagattgttttggctattcaggggtccttttttgaaaggtggggaggccaatatttcacaactgggaaagccgtttctgtcttcttcagggggaaatttgggagaacattttaagaaactttatctaagtaggtaaactgttaccactttatttgctgaagtgctacgttaaagtgtgcattgcctcttgtggaagaattatgagaccctggaagcactagcccacatggtaagagacagtgaattccacaatgaggggcagagaggatgttgttttgggatacaatgttgttgggggagtggtatacatctctacttctttatgtctctgtatagttggtgtagggaccagccacacaaggtcagtgggtttttctccctgtgtgtggagatgagagattgtagaaataaagacagaagacagagataaaagaaaagacagctgggcctgtgggaccactaccaccaagacacagagaccggtagtggcaccgaatgccaggctgcactgacatttattggatacaagacaaaggggcaggataaggagtgtgagccatctccaatgataggtaaggccacaggggtcacatgtccactggacagggggcccttccctgcctggcaaccaaggcagagtgagagaagagaaagagagagagagcttacagcattatttctgcttattagagacttttagtactttcactaatttgcttctgctaactaaatggcagagccaggtgaacaggttggaacatgaaggtggactaggattgtgaccactgaagcacagcatcatagggagacagtcaggcctccaaataactgcaggtggacctgactaatgtcaggccctctacaagaggtggaggagtagagtcttctctaaatttccccagggaaagggagactctaagtagctttcctggtctgctaagtagcaggtgtttttccttgacactgaggctactgctagaccagggtccgcttggcaatgggcatcttcccagacgctgtcattaccgctagaccaaggagccctctagttgccctgtctgggcataacagaaggctcacactcttgtcttctggtcacttctcactatgtctcctgagctcatgtctctgtatggcctggcttttcctaggttatgattatagaaatgaggattattataatattggaataaagagtaattgctaccaagtaatgattaatgatattcatatataatcatatctaagatctatatctggtataactattcttcttttatattttattataccggaagagcttgtgccctcggtctcttgccttggcacctgggtggcttgccacccacaagtgggcatctccgttggacacagtaggttttgaaatccttgtttatcctctggggtctgggtcttggcttacctgttagctgcagctgaaagaggtgtctgctaaggcattgccacctgtggtgagaagaagggttcagcagagtgaaagtagctggggctcagagaaaccaggaaagtctgactcttagaaactatgggtcagcagatgggtgtcctcaggggtaaatgggccatgccagtagacattgcagtggactggaagaaggtaagggatgccaggtatcccatgttctgtctcagctctgcagctgaagatttgggccatgggcttgtacggccctgcagcaggggaagggtatagaggaatggctgcatatcaggaccaagtccatgtcatcttcttaggcattgttaccacagatggaggattctgttcagagactggcctggacacatgggagggcccaccccattcttttaaaattattttaagagaacagtattagcaaaggtggtacatgttttattctgctagaatgtcttactgtcacgttttacaatgtatctcttaggaaacggcaagagccatccacacaatgtggatttaaaggggactctattataatttcagctttcctacgtcttcatacaaaccatcttctctgcaaacacacaggcaatatctctgtgttcatttctattgggagccctgtatgcaaggtggagagagccacatttccccctgagatgttatgtaaaagtttgaggttgagatgacatatctgacactctgttgttactctcagaagctactacatgtgaaattctaatgactgcattatcctgccaagtgaaagaggcaggcatgagcaaggacagttaagaggggggagagcctcatcatgatggggagtcttgttctgacatcttgggaaaaactgtccacagtgtgaagtcatccacttgttgtcctggtttacagtttgagcatctgttgttatggtgtcgaatattttggtgagttctgagtggctcatgcttcacgtacaagggttttcccatgaaatttacattgagttgtccacctccagcttatagggcttctggaacagagtgggtcttgctcttagtgattccatgggagaaaatggaattggaggtactagtagaattcagggaactgtccagtctacaggtggataataaaaacacagaaacaatgaacagagctgcagtctcataacaggtatactacagtttttattttccacataatttttccctctatgggcatctctacttttaccaatgataatttcagtagaataagtttgtttgcaaaataggtggagtttcttcaaatgtggtctgattgtttacataagtgcagcaagagtagcaatggaccatgtaggctgtcttctaaaattttcttttctctaagtttttataaggaatctgagattaaatcttcacaaacctcttgagaataggaagccaaaccaaggctgacttcagactttgcctgcagttcatattggttcattctatctatgtttttaatataacatccgaatcaaagcattggtaatataaccaatgatttcaaatgtgtcatgttacaaagaaagcagattgttactgtacttgtgcaaatatgtgtattaccataaacatatcaattctcatgaatagttgcccaattctggggcagtcaggtagaaagcaaaagtaaatgtttcaattacggttcccagaagtatagtttattgaactgctataagctgtagatagattaaaagagaaaaattccatcaatgtagaaaacaaaccatttaaagaatcagcaaattttcaaataaaaatcataaaaacattatcttcattattatcaattatttcaatgaaatcaatgttcttcctgcttggtctaggctgggaatattatgaagatatcagcctgtttgttaaagttttcgaagttcttagacaaatttggagggttcaggaggagaatttgggatttgcttgtgcccatgggacacaggctgggaatacaattgttttcctgactcttctctgaatgccagatagactccacctaaaaccctattgccaacgatgctgggatccacttaccagagacttcgactgtcatggatttggagctttccttgccagtggctgagttacgaacagagcaaacatagagcccgctatgctttgtagtaatatggcggataaagagcttttgtcctggtagctgaaacttttcattaattgtccaagaatactgtgccggtgggttagagtccgcagaacaggacaagtagaggacttctcctgaacggtaataggtgaatgaagggtaaattctggggaggtctggaccatctggagcaaagagaataaagccacaggtgatgtcatctgagggaaggggatgttcctggtctcttaaagggacacagtgaccctctgagccaagacacaccctcaagtcccagcccaaccccctctatgttcactgagccgaatcctgaggtattcccctgtttctcccatcacaagctgtgggccccaagtctcccatgataagagcatcccctccccttatattcttggttaaggctgtgcctacccaggatttcccagggcagggagtcatggccagctccgatgtccagaagtaaaggtgtctatacttggaccggagagagactgagaggcctggcatctggtggtttggatttaagctggtgtcctggcccacagaggaacaaaagatactcacagaggacattcagggtgactgggtcactgcggatgccaccatatcggtcccgtatttcacattgatagggtcctgtttcatttctcgtgacactgggtagaatgaggatcctgttttcaatgggtcgctttaccctgggactgaccgggaggctctgaccatttagccaccaaatgtaggtgtagttctcactcttaggttcacaggtgaagtttaagacatccttattctccctggggtttaagttgttgatggtgatgtagggcttgggcagcttcgctgtgtggataacagagagaagattgtcctgtgtggcacctttgattcctccacaggtatccttcaatcagagttggcatctcccacctctcattccacccgagtccttgaaagccaatagctggtgcttttgtcacaagatagatgcatgatgatctaagggctcaaagactgtgaggccgccttctctgtcttagggaagcacagactttctgaagtgtcaattgagcagcagtgttgggtcatggacagacacgtcagtgggagtcacagcccctggtacccttcccaggccctccctaatcagttgactggctggctcaccttgggttccttacctggaatatgcaactgctgggccccttccaaattccatcctactttgtccccctagatgtgatttctctgcagcttccatttcaaaggacattctagagatgagtaataatgggacttccctttgtcctgcaaccctgaagatactgagcagcctggcctgggactggatgtttcagcagaaataacacaggggagaccagaatcaaggctggaggtcagttcagtcatcaggcagtggaggctcaaggtggggcagttttttgcaggtgtttcatgatgacttacttgaaccagtgacctctaaagatagagcagagtgcaaggaatgatctagaaagagtgaaggggacaggcaagagctggtggctttggagcagaagcatgttccctgtcttgggttctttaagtttcctctccttctgcagagggcaggtgaggaccatgtggatctttccagaaatacatgtggacatttgcaaattcagaactgactggtagaaagggtgggaatgaactgctggaaatctggtcctcatgaaccatgtgtgtttgatggatatgagacaaatttggagagaggttttgcaaatattttatttcattggacattctactctctgattccatgggttcaactactctagggacctcatgtaagtggattccagagtgaatatgagaagagactgctggttgtcaggagctgggagtgggtagaatcagaagttgttcatgggtgtgcagtttcagttatgcaaggtggggaggttctagagaactgctgtagagcttgatgcctatagttcacacagattgagtatttcttatgcataagacttaggacaaaaagtgttttggatttctgacattttttgattctgaaatatttgtcatatacttactggtttagcatcccaaatctgaaagattcaaaatctaaaatgctccagtgagcatttcttttcagcatcagattagtaggcaaaagtgggaggtgataagccaaagatattcttgcccttttttttctctcaccacgtttctagcttggtgatcagttttcggtgaattccacagtggccatgctgcactcgtatatttttgaaggccttgggatgtgagaaaggctgattgctattttctatgtcatcagaactttccaccttttcatggttacctctttttctcagtgtttgtgttgtgtcagtcattaataagagcctgtcatgtgagatttaggacagtgttttctaattctgcaaaaaatgttactgtgattctggtaggggatgcattgaatctgcaactcattttgggtaatgttgtctttctaacaatattgattcttccaatccatgaaaatgaaatgtctttccatatattgatatcgtctttaatttctttcagcaatggtttgtagttttcagggtataatcatttgacttttttggttaaacttactccaaaatattttattccttttgatgttaatgtgaattgaaattatttccttaatttcctttcagattgttcattgttagtgtatagtctaaagaatgatctagaaagagtgaaggggacaggcaaaagctggtggttttggagtagaaacatattccctgtcctgggtttttgattttccctctccctttgcagagggcaggtggctcttccctgatagctagatagacttcactggaaaacatattgccaatgctccagggatccacttaccagggactatgatcctcttgattatgagatttgttccaccagtggctgagttatggatgaaacagacctagatccctgtatatgttttagtgatttggggtataaagaacacttgtgttgattgctggaacttcccagcaatcagccaagaatgctctgccagtggatggagtctgtgaggcaggagagcttggggacttcccctgtatggtaataggtgtatgaggaagaaatggtgggggcatccaggccatgtggagtaaagagaataatgtcacaggcactattgtcagagggaagggaaaatcctggtctgtggaagggccacaatcacagtgaccctgtgagccaagtcacaacattgaagtcccagccaaatccccactgtgttcacagatctggagcctgagaccttcacctgtttctcccatcacaagctgtggaccctgagtctcccatgacaggagcagcctcttttctcctattgttgatgaagcctaggtctactctggtttgcctggggcacaaagtcatggccaggtttgatgtccaggggtaaaggtctctgtattggacctgagagggacagagaggcctggcctctggccacgtgtatttgggatggcagcctggctcacagaggaacagaagatactcacggaggagattcagggtgactgggtcactgcggctggcactcactgggttccgtatttcacattcatagggtcctgcagtatactttgtgacacccaatagaaagagggtcctgttggtttcggacagcttcaagctgtgagtcatagggaggctctgaccattcatccaccacaggtagcttgcgtctggagtctcagggtcacaggttaagctcacagcctccatggtctccctgggatttaagttgctgctggagatggagggcttaggagtctccactgtgcagaaaacagggtgaagattgccgtgtgtggcgcctttgattcctccaaaggcatttttcaatcagaattggcatttcccacctctcagcccacccaagtccttaaaagcccatggcaggtgtgtgtgatacaagacagatgcatggcaatctgagggctcagagattgtgaggctgcctgcttcatgtgggagaagcacagactttctcaagtgtgaattgagcagcagcattgggtcatggaaagacacaggaccagcagtcacagcccctggtgcctctgtgtgtccctccgtctccaactgcctgcctggcccaccttgtggtcctcacttggagcatgcagtgctggaatcttgttagtttcagtctcactttgcccactgaggtatgttttctctgcagcttcccttgccaaggacatcctagagatggatgatggaacttcccattgtccttaaaacctttgggtactggaaagcctggcctgggactgggtattctagcataaaacaggggagaccagagtcaagcctggaggtcagttcagtcatcaggcagtggagccacgaggtggggcagttttcccaggtgtctcatagtgactgagttgagctagtgactctaaagatagagcagagtccaaggaatgacctacaaagagtgaaggggataggcaagagctgatagctttggaccaagaccatgttctctcttctgggtccatgatgctcccttccccctgtagagggcagttgaggaccatgtggatctttctagaaatacatgtggatctttgcaaatgcagaactgactggtggaaagggcgatcatgaactgatgacggaagtctggccctcatggaccatatgtgtttggtgaatattagaccaatatttgggaagaagtcttgcagatactttctctcattagacattctactctctgattctgagtttgactactctatgtacctgatatcagtggattccagagtgaatcagagagtagaatagtagtttgcaggagctgggatcaggggaatagggtgttgttccgtgggtgtgcagtttcagttatgcaggaagaggaggttctagagatctcctgtacagcctcatgcctatacttcatacagataaagtgctccttatgcagaaagcttgaaactaagtgttttggatgtctaattatttttttattttggaatatttgcagtacatgtactggtttagcatcccaaatctgaaaaatttaaaatccacaatgcgccagtgagcacttctttttagcatcacatcagtggtcagaagtgttgagttttgagcatttcagattgtggatttctggatttccgatgctcaatttgtaacagtgtaatttttccgtaaaaatttgtcaggagtttagacctcatgttatattctgactctagtaacaaaaaaaatttggaggaaacattaaaatgttttcataagtggaaatttttactgatggtccaaacatctaagatcaattgctggtagtagtatttctcttgagaccaaaataaggtttaggtgtgccgtgaattccagcaggatcacgttatgctcaaagaaagatgccaaaggtgatttgaaattagcagctccttaagtagagagagtcccattgaaaggaccgaactggtcagtgcatcaattacataaagggagaaaggatgtcaaattaaaagaagtgatgtgtgttatgttagtaaatatagaaagaactccctgcttctaaattctgtgcagagttaggaaaaatggggaggacctcaaaacaggtatgtgaaatgctttcttcattttctcttaagctcaggaaacaccactagagtttaagtttgtgtgaattaggaagagtctaagtgagatggcaatggctcttgtgtctccccacacgaagatctccaacttatgaaaatgacatcatcatgaggaaacagttataggtggcacaggcagtaaaaccatcagataacacccacctggtcaactccaactagtccccaaaaccaccggtattcccattacgtgtacattacagtctttgtagttgtcccacagctacaaaatttaaaaattgctattgtcaaaacaaaatattaaatatgaagttgaatatgttgttccactttttttccccactctttttgaactttcctgtttcagttttggaagtttctgttgacacatcctcaagctaggtattctttccacagctgtgtgcagtctaccagtaagcatcaaaagcattcttcatttctctaacagggttttttttttctgagacagagtctcgctctgtcaccccggctgcagtgcagtggcatgatctcagctcactgcaagctctgcctcctgggttcacaccattctcctgccttggcctcccaagtagctgggactacaggggcccgccaccatgcctggctaattttttgcatttttagtagagacggggtttcaccatgttagccaggatggtctctatctcttgaccttgtgcccgcctcggcctcccaaagtgctgggattataggcgtgagccactgtgcgcagccgtctctgagggagtttaatgagttgttgccttttgagtttgttcagctttttacttagtgttagaaccgagtgacaaatttcaagcttgttatacgcctgtcaggaagctagaactctctagaaagtgaccggagaatgtgagctccatagcaggttgaggatggcgtcatgagtgaggatggggtcaagagtccactcagagatggagtgcccagccatctctgagggattttaacaagttgttgacttttgagtttgttcagctttttacttagcgttagaaaccagtgacaaatttcaagcttgttatatgcctgacaggaagccagaagtctataggaagtgactggagaatgtgagctccttagcaggttgaggctggagtcacaggtgaaatgagcccatggggtttggggacagcaggcctgtccagcctctgacaccctggtgagtcagtgcagagattacaacagtgacagcaaactagcatggctgactccatctggcatctagtctcaggctggctgtcctcactcattcctgggcataggccaggttaaccttgggaggaatttagtttatggtttaaacttgaagcaagaatgataatagttcctccataaaactaacacccttactttgtccagggactgcctttgtaaaactagtgaaagaccatgagattaagattataggagggaactgaattttgctaaaatgtaggcacagtttctataatccctgactgctccagtgtcattgggacagggtttacaaaatttgtaactaattgctcctatagataacatcactattgtagaacgtgagattggtcttttgagatgtttctcattcttttgcattctggcaaccggctgacctcatccatacctatgactaatggctcagccagtcatgtggtccctacctagaggcagattcaagcacaaacagatcatgtccccctgcccccatgattccatcaccaaacaatcagcagtactaattttttagtcctgtggccctgaaactatccttgaaaatctctaagccctgatccactggggaggctgatttgagtaataataaacctctgtcctcctgtttggcagacttggagtcattaaaatctttctttactgcaaaccgccatttcaattattttattttatttatttatttgtttttttttttttttgtgcaggaggccagaggaacttgtctggcaattatgagagtggatggaggaactgcctatccctgtcccatggtcttgtccacaggtcagcctcacaaagggaaagagccctggatgggaatacagtggaaggtcattctcttagtgacctggggacattggctcgagaggaagcctggcaggagtggcaactccagatgatttctgtgcctttcctctttcctgggaggtgggccaggccacagtgttagtgggaagggaactgaacagccagagtggttagagggagtgtctagggaaggcctagaggtggaggaagaagctgtgcaggacagggcttgccagtcagaatgaagtgggaggaagatgagggacacagagaagcagagagaggcagatacaccatggcagtgagcagtgagggagacactgtcttcagaaactccagggaccaggtgcccccagttccatagtccaggaccaaggagccctcgagaaccctccggtggcttaagagcttcagaattacatgaggtggggtggctttaggggcaagaggtagtggggggatgaaacatggatgtcagcctctgaaggacaagggacaggtgtggctagaacctcctaggattctgcatccaagatccaatctctaaagaggttttggatcattcatttcttcattccattccttcatttgtcatgtgagagctcctgagtgtgtgtctctctcgctgggcctgtggtggtgtagagtgtgagtggggaaagaaaacaaggtcctctccttgatcctctcatgacagtgacaaggacactttgggaaacacaggatttcaggttcagtgatggtggttaagatctgaggaggaggcctggacatttttttgcactgactctgatggttgaagcaggtgatttagttctggagtgcagactaatcagctgaccatttgctctcactcctctgaggtttggatgcctaagaagagaggatttgagccaacaaatgactatggggtgcttggaacccagtaagccctcacttctggtggagtagaggatgggcctgtggctacagacagacctcatgtgaccctgatctcccctttgtgtttgtgtgactcttgctcagtcactgtgccttcctgtgcctcagttttctctcaatcaaataagctaaatggcaaatggactgtggcttttcatgctatctgtgaataaatgttaaattattcacagtcacctgacctaatgcttggcacagtggaggtttcacacaaacagcatttattattaatttgcttccatgagaaagcacctttacgtcagatccctgtggacaagctgctacctggtacatcttctctcttctgtttctgcttctggggacattagtctttctatggactatcctaagcctcctaaggcagttgggtgatggcctacaaagcttgtctttctgtcctctccactctgagtatcaggtgaagaaagctctgtcctggcccagatgaggctctgagggctgagccctggctggtgaacagctccaggagacacagtcctctgacagctggtaaatccttggtcccagtaagccctgcccaagaagccacaacccagtcccagcacaggctcctcagctttatctggaacaaggatttagggacaagggtctggggttgaggcttctagggctgagcttctctgagagtatctcagggggcccctcaggccaagccctactcagttatccagggtctttctcagggtcaaatttatgaagagggcatgaggtgcttggctgagactgatctcctcctgctgagtccccccatcagactgtccttcctctgcagcgagtgtctgcagggtctggatgcaggaaaggaattctgatctgttgaaatttgtctcctctgtgtgtgtcctgcactaaatgcccaaatcccagcatgggacataacgcagtgagtgacacaggcagagtccaggcctgacaatcctgtgtgtgtgaagtagaagtgacccctgtcccccaacacccagggatcatgtggaatcacttacggtgtaaggtgaaggtgaaacgtccagttactcctctagtcccatcatctccctttatgatgtgtaaggtgtaggatcctgcgtcctcccgggtgacattctggatcagcagggatgcattggaatatgctgtttctcgtccactatatgcaggcccatatataattatttcaccgtctactacatatgatgtaatgtaatggtagaggtccctcatttgccctttgtaccagatgtagccggtaagattctggggcaaattgtggacaagtagaagaacatccttcccctcggaaactttggttggctcggcttcaatcgtgacttgggcagtggtgggcaggttccagaagtttaaaagtgatgctaggaggtggagagaacatcagtcaatattgagacctatgtattggtgtgaaaacatggggccctgggtcctgagaaggtctcttcagtcctcagccttgacaacacagacacacacacacatacaaacacacacacacacacacacacaaaagcggcatgtgtgattgtgtgtgtgtatgtgtgtgtgtcctactgtcctactaggtcaaggtcagcagcatgacgcccattccttcaacacttctgacgttggcatttttctgtttggaatcctcttccccaggggtccgcatggccccctccacaatgccctcaggtcctgcttacatcagggcatcgttagacttctttcctgatgcctgcttcagagaccctgggtcttccctttctgacctttccctgctctgctccctccagggttcttgtcaacacctgacctcacattctagatctctttgcatgtctgtcttcccccccatgacagcgtgagctccgtgaagacagggacttttgtgatcttggttgcaccccagtgcctggaacaggctgcagactcctgtagatgtgagagttctcagggccctccatgccctgggtgttttttttcccccaattgttgaggtttcttgctgaggacagtgtttcctgccctgtttatatttttatttgaggtgtcatctgctatagttattattatcatttttcaaaatatggtggcccctgatgattaatcaggaaaacagaacacttaagattttcctacctcttaccaattccggtccaatacgactttcctgttttgacccctgtccctctctggtgtattttcccctatccaggctccaacagagccttctttcctttttttcttttttctttttttttttttgagatggagtcttgtactgtcgcccaggctggcatgcggtggtgctatctcagctatctgcaacttctgcctcccgggttcacgtgattctcctgcctcagcctcccgagtagctaggattataggagcacaccaccatacctggttaaatttttgtattttcagtacagacagggcttcactgtgttggccagactgatcttgaacttctgatctcatgatccacccacctcagactcccaaagtgctggcttctttcattttttagaaccccatcctctccaggagaccccatccagtcactctgcttcctcctcctgtcctctcccaggaagttctctcctcacctgtgagcaggagccccttccatttgatgcgctgtgtgcagggaggggctgagagggttcccatggtctctgctgcttgtgtgttctcctctgtggagataagcctaggatccagaaactctctgagcacggctgtcagctgtgctgtccttcctctttctgtgctgagcctcttcccagggcaggagcaattctcaagctcatgggcagggtcaggcccaggacacctctctgtcccctcctctctaagtcctgcctccttgtccctccttctgtttctccttttgtctgtgtttcaggtccctgggaattgtggcggcctctgcctttttcagcagtgattctttcaccaaacctcaagacacactttgtgcagacacacagacacacacacacacacacacacacacacacacagaagagatacacacagacccacacagtcagacacataccctgcaggttgggcaagaacagtcctgggcctcagcctcctggtgtccccatggctctgggtcggggtgcaaattaacgccctttggcctctttcatccccatcaggctctccccttcagtgcaggaggctggagctgtaccaggtccctgtcagaatgatgccccattgtgctgtgggtgagctgtgtgttgcctggtgagagggacccttcctttctctaatcatgtctagcttggctgcagcttccaaggatggacattcaggacctgggtgtcccagaggaaactgtcctttctggcggtgtgcagggtgaatctctcatgcctcttgggaggagaggcctgtgctggttgctcagtgggggctgtgagtcccatagtcaaagggacagttctctgtcagtctatggctccctggggtctggcggctgagctggagctcatagtttctcatgttcttcctgaccatctttgatgtcctctcttctctgcccagctgactgtcctgtggtcaccacaccttccctgtggtggtgcaggaggaagtggggagttacccaggaaccctgcgggacatggctcattgagatgcgggagggggagcctgggacagagcaggggttcagagctggagagattcatcccaacttactccgtggccatgatgggctcagccctccatatgctgacatacccaggggtctgtcctgatggttttgacctggccaagctgctgtgtgtagaggaggaacaggcagtggccagagagcctgtctggagggacattgctctcacctgagagggcgggtgggggtgagttgtgttctgagatcaaagagcaataacattccccttcttcccgcaagcacacaggagaggtctgtcttcccaagggacagctggtgttaggtggccacatcccggatggtgcctgtgtgtgaccatcacacgcgctctgagcccccagggtgcagcgggcaggcaggtcacagggtgcctggctgattcccggggaggctgtgggccctcaggcagccgctgttctgtgtcagcgctaggcttggcctgggatgccccagagaacaggacagatggagcaggggtgggcatttagggagcagtgccagaaagagttgatgaggatggagggaggtcacgaggggaaagcacccggtgtggcatcgcgtgcaccagcgctgccctgggagatgcctttagctgggcccagggaaggagcaggtgtgtggggaggagctacctgcagggggagtggtgttaggttggcggccgccaggtcagggaggagctgacagtgtccgtgtggggagcatggagggcgctgaggacttgggcagaagtgaccctgtagagggtggacactgctgggctgtgggttccgctgagtgaggttggcatcccctgggaagactccaggctgggagggactctgtccccctctggtggacagggagggaagtgtgaacggcagcaattccaggccaggatgcatgttttattccacgtggatctgcacagttcacacgaggtcacacctgtgttatgttacagccccatcaccttccagccccgtgagtcccagtctctgtggctctatgttcactgttctccctctttcacaatcagatgtcccaaatgcagatttttgtcaccttctgtgagtttgtgtttgtgtgcagtaggcggcactgtgtataccctgggggcagtgatgtctggggctgagcactgcagttgggcttgggagcagcagggtgggaagatcaatgtcaggggggcagggacaagtcattttcattttctcactcccagggaccagaacccaggattctgactccagggcagagtaccacaccctgctggtgtccctggatgtcatgatgctcatagtgtcatgttgccttggcattcattttttaaggtgtaagtttatttgcctcaaatcagaggcagggcttggtcaccatggcagttttcaatactgtgtctggttcaagtggctccagttggtgtccagagatcaaatcttagagacatctctcctgcttggtgtgctgggctcccgtctctccagctgctttctttaaactgataattctgacattcgccctcacattaaaagtgaccacctctcagtcacagcgtgagctcctgttcccagtgtttgctgcttgctttgaacacatccattaaagctccctgctggaaacctgtcagataacaccctggacttaataaagccattggcttaccggtctcttctctcctccctccctgggctcactgacctctgtgtctgtggtctccaggtgtgccaagtgcttcccagtgtctgtaagtagtaaaaatacttacactttcacgttgtggttgtattgctgtggcctcacatgccatccagggcctgacattgaggctgccttatgggacctgtgctggctgagcccctgctggagctcttgttttggggcctctggttctcttggggacaggagcttccagctaacttgattgaaaaactgatgcatttcattgaaaacactgggtcagatgatgtattcataggcttcagctcctataacaaacaccttagcctgggtgaattaaataatagaaatctatttttcacagttctgtgaataatgtgctattttaaccactttaaaatgcacaatcaatgaaattaaccgcatacaccgtgttaaattaccatcaccagtatttttcctagaaaattgttatcattttaaactgaaactttgtatcttttaaacaataactccctgtatgttccaccctaggccttgatcacctctactctgtctctatgaatttgcctattcttgatgtttcatataaatggaattatacaattatgttattttgtttctgacacatttcacttagcataatgttttccaagtccatgcatgttccagcgggtgtcagagcttccttcctctttatggcagattatcattctgttttatgtgtcaccatatttgtttattcatgtgttgatgaacacttggattgttttcatattttatcttttctgaataatgctgcaatgaacattcccatgcaagtacctttttgagtccgtggatttaattctttgggtatatacctaggaatggatgttatttcaaatgagaattctataattagctttttgaggaacagcaatactctttctcctagctgctgtacttttttatattctcaccagccatgtatgaggattccaaattctacataatgctgctacttgttatttaacattttaaaagaacggtagccagttttgtaggtttgatgtggtgtctcattgcagctttgactttgtattttcctaatgactaatgatgtttagtatcttttcatgtccttcttgactatttgtatatcttctttgaagaaatgtatatttgagtcttttgcccatttataaatttaatggtttctccttttgttactgagttgtagctagttctttatattatctggacatgaaaactgcctatatgtggttgtcaaatattttctctcattctgtgtctattaattattgtcttgataattttctttgatgtacaaaaggctcacatcttgataaagcccaatttatcttgtttttcttgtttctcatgcttttgtatcatatctaagaatccattgcacatttgagttcatcaatatttacctctatgtctattttaagatgttttataggtctgatatttaactcactgatgaatttttcagagaattgtttgatatggtgggaggtagagttatctaaattcactgttttgcatgtggttatctagttgtttctgcattatcattagaaaggagaattgttcctccattaaattttcttgacaccctcttcaaagagtaattgaccataaatgtgagggtttatttctagactctcaattctatcccatttttcattatgtccagtcttttgccagcagcttgttttaataattgtactcctttgtgagattgcaaataagaaagttcaagtcttacaatttcttttggcaggattgttttcactattcaggggtacttttttgaaagatggggaggacaaagtttcacaattgggaaagccgtttctgtcttcttcagggggaaatttgggagaagcttttaagaaactttatctaagtaggtaaactgtcaccactttatttgctgaagtgctatgttaaagtgtgcattgcctcttgtggaagaattttggaccctggaagcacttgcccacgtggtgagagacagtgaattccacgatgaggggcagagatgatgttgttttgtgatacagtgttgttgggggagttgtatacatctcaacttctttatgtctctgtaaagtgggcatagggagcagcccgcagggtcggtgggtttttctccccgtgtgcagagacgtgagattgtagaaataaagacgcaagacagagagataaaagaaaagacagctgggcccgggggaccactaccaccaagtcatggagacagatagtggcccttaatgccaggctgtgctgatatttattggatacaagacaaaagggcaggataattagtgtgagccatctccagtgataggtaaggtcacgtgggtcacgtgtccactgcacagggggcccttccctgcctggcagctgaggcagagagagggaggagaaagagagagagagcttacagcattatttctgcttattagagacttttagtactttcactaatttgctattgctaactaaacagcagagccaggtgtacagcatggaacatgaaggcggactaggagcgtgaccactgaagcacagcctcacagggagatggtcaggcctctggataactgcgggtggacctgactaatgtcaggccctccacaagaggtggaggagtagagtcttctctaaactcccctggggaaagggagactccctttcccggtctgctaagtagcgagtgtttttccttgacactgaggctaccactagaccatggtccgcttggcaatgggcatctttccagatgctggcattatcgctagaccaaggagccctctagtggccttctgtgggcataacagaaggctcgcactcttgtcttctggtcacttctcactcttccctgcttccctcttccaaccacttctgagctacaaatgagaaggaagcgatctgattaaacaggtgatgagcagagtcacgttctgaggggatttgcacttttaaaaggagattaatgaccacatctgacaatgtcaccctggaatcttatgcagagtgacaggggagtggggatgagctccgttcaggttcaggaagcgagagtttggatctgaagtacttttcagatgctgaagtcataggagcttgcagttgcttcctgggtggagccataaacaaacatctcttctgctgagtggggtctgagaagatagagggaacggtgacccaggagctctggaattatctggctgtgttacacttgcaggactacacatatttaagtgaaaacaacatggttttcatccacctggctgacctcttagcctgctttcctcttattgttccctcgaaggcatcattttttgaaagagaaatttaaactctgtccatctcatcccctttggacaaaagttgagtcctttctgagctctttcatcatctggagtttaaaagcttcccctcctctgttaactctctttgaatccctcatgtcacaccaaacttcaaaagagacaaatacttttgcatgactccctgcaggctccgttttgccctgtagtgacagccccatgtcttggctttcctgattggaaaaacttctcaagctttctgcattcatgatctctgcttcttcagtgcaaccttctccagcttgtctctgatctccaatggtccctgcattaatcctgtccaagccacaggtgaccctcatatcatctcagcttctacttcccagtctctctctctctctcttttttttttgagacaggggtctcactctgttgcccaggttggtctcaaactgttgagctctaaagatcctctggcctcatcttcctgagtagctggtaggggtgtgagcccttctgcttggtctccagtcctttgcttttcttttttgacctatacaacatttggtggttgatgtccatgttcatgtaattgtcttctctggcttcttggggccaccatgcattcccttctccctcttttcatttattatcttttcatctagtaagacccatcttcccctgaatatgtatattttcctcaaagcaaggattggcttaccttcacaaactgagtctccaatgaccacataaactgaaatgcaatagaaatcatggacagatgtgagctcctcttctacttcctgtgtcctctgcaggttcttctcaccaacgtcacgtattgttaagtaagccagtgatgttaagttagaaagtggactgattccattaattcatttggcatgttccgaagtcctcacctgagatctatctactctccaaattacacttgttagtaatacaggaagatctttttcacatgagctaattagggtgaatacatgtaagtgttggtaagaagtactagaaacactggaatttgtgagatttcattgaagaaccaacttccacccagcccttcacattgttctcttttggtagtttcttgtcatttcctccttttattatcaatagagctgctgtgaacatgcatgtacaagtttctgggtggacatatgttttcattttttggggggtagacatcaaagagtagaattgctgggttgtatgatgaatctgtgttccaacttttcagaaactggacttctactccttcctgatttcaccttccacgccatttctgtagtgaggcccactccttggccttataagacctgaattaagttaggtgcccagagccgttctgtcattgactctgttctttcccttgctagcctgtgtaataattggcaatcagacctttacgtgcgcaatggtttcatatgtctccccaactatattacaagttccacgggggcagggctatgtctatctccttgacctctgtatctgcgatgcctagcagagggctgtgaacaccggtcaccctccataaacactgggagacaaacaagggagtcagtagagttagtttttttgcctttttacccccagaactcttagaatatgatttgagctattgcttcaaggaagtcctggggcagatgatcattcatagatgacatgagggagtgcacagcacatgagtttgcaggaaaatgcaaaccccacattgaaatttgatccccaatgttggagatggggatctacatgggggtgtttgggtcatgggggcggatccctcatgaatggcttggtgctgccctcatggtaatgagtgggttttctactcaatcctgcaagagctgattgttagaaagagcctggcaccttcctctcctctttctcttgcttcttctctcaccatgtcatctgtgcacacagcagctccccttcccattccaccatgagtggaagctccctgaggcctcaccagaagcagatgctggtgcaatgcttcttgtatagcctgtagaactgtgagccaaataaacctcttttctttataaattatccagcttcactcaggtattcctttttagcaacacaaaactgactaagacagggtatcaggagacctagctttgcctgaatctgagaactccatcaggaatcttggaacaatttagcccacaggtccaaggctgattttttgtcacagtgaagttcaggtagtaagaattctcactggtggctgttgacggtggcggtggtggggatgggtcatatggagaattagcagtgggagactagaaattaaagtggataaagggaagaattaaaagtcaaaaacagtgtgagggaggaaaggaatggatataacacctcacagctttatccttgagaggccttaaagaatctacttaataataatcagatggtattctataagaactttgagactagacatgtgatgacttttaggaaactgccctggagctgaaaatgcatgcaaatctagctgactcagctccagccttaactggctcataacttgtttcataaacatgactgtatgttagcaaggaaatgagagagaataacagcacatcacataggcatgaaaagtatttgcaaagcagcagttctcaacaatgacattttgcagagttttccagaagcagattcagaaaactgaagaccaaagtaatgagggagctgtctcatgcctagatgagcagaagcataccaaaggcttagtatttccccaagtaataggcacctgaaacttatttaaggaaaatactcttcttgatgaaacaggcactgcagttgaagcaggaatgtgtttggtgtgctgccttaaatagcatgggtagatgttcaaacatgttaggactcgctggccctaggaaagacccgcaagtatctggtctacaccaggaaagtgacaatgaaacaccaaacaccttttctcctctaattaccaagaaaagtatttctttcccaatggtggaagacaataatgttgggaatgatgaagttttctggagtgtgaagtggatatgtcttataagtttaatccacagcttcaccacttcataagtggataatcgaattgtgcctcagtttcctcagacttggggatattaagagtatcctcagtcaccacaaggtgggtaccaacataagaaaagagtgtagcaaaagcccatgggtgcatgttcttaaagtgcctagtgtgggattagaatgacaagtggtagatgacctacttgtgcagaaatttagagttattttgtgattttcaaatgatcatgtgtgctttccatatgctgtccagactgggggtgctgcagctagaaagggaagaaggtttccatatttcctgagactggagtcacatcctctcaccaatgcactcacctgctgactaaccagtgtacttctgggaattgcaaatgcatgaaatggcacccattctagactagtcacggcagtgttggtgatggccacagatcgggaacgaccctgacgtttatccatagggaactgggtcatgagccatgatccacatcatggatactgggcagctgtggcaaagaatgaggtatctttcttctgtgtactgggaaaggtttccaagatataccgcacagtgagaaaaacaagaagcagaacaatgcacggtgtgctacctcttacattacataggaggaaatgtaaaattaatttaccaatggccaataagcacatgaaaagatgctcaacatcactaatcatttggaaaataaaaatcacggctacagtgagataccatcttacatccattatgatgattgttcttaaaaaaaagaaaaacagaaaagaacaagtgttggcaggtaggaattggaatgcttgtgtagtgtttgtgggtatgaaatatggcgcacccactgtcatcgtttctcaaaaaattaatcatagacttaccacaagatgcagcaattcggcttctggtgtattccaaaaagaacggaaagcaggggccccagcagatatttgcatgtctttgttcatagcagcattattcacaatagctagatgttggaaataagcccagtgtccatccatccatgaatgaataaacagaatgtggtctatacgtacaaatgaatgggattaaaccataacaagaagggtggttctgatgcgtgcttcaacatgaataagccttgagttctttctgctaagtgaaataatcagactcaaaaagacaaacattgcatgattccacttaacagaagtgcctgacgtcatgaaatgcatagacagaaaatgaaaaggtggttgtcagcggctggagggagggggaaagaggagttgttgtttaattggtaaagaattccagttggggaatatgaaaaagttctgggtggggatggacagtggtggtggttgaacaacaacgtaaatgtacttcctgccactggatgtacagttaaaagtggttaaaatgggccgggcaaggtggctcacgtctaatcccagcactttgggagattgagacaggcggatcactttagattaggagtttgagaccagcctgggcaatatggtgaaaccccatctctactaaaaatacaaaaattacccaggcatggtgacaggcgcctgtaatcccagctacttgggagggtgaggcaggagaatcgcttgaacccaggaggcggaggttgcagtgagccaagacggcgccactgcactccatcctggacgacagagggaatctccatctcaaccaaaaaaaaaaaaaaaagaaattaacgaacgaagagcatctatgttccaaatgcagtgtattattttatgcaggctttcacaagctccaaaagattcaccgtgcagaactggagattctagagaaagaccacgcctcctcctgcgggtaactcttcattcagcaagcagctcttggcttatccctgggcttagtggaattcgaatacctgaccataggacaccaagggctttgggacctgaatgacacatcatgtggtggtgacatctgagttacctggggcgtgcacagcagcctccagcatcccagggagagctgtgtatggggtcaggctcaagcaggtctcagggcaccagtgacccaatgggtgactcagactcccatggcacctgctccttctgtttctcccttcgccatatatatgagctcatgggaaacgctgtgacctcttacagaggaggaaagttcatggacttctagcttctagaactgtgatacaataaactcctgttgcttatctactcctctgcagtattttgtcatggcagccctagcaaactactatagtgactgtgggggttaggatgacaccaagcatcaaatgccactccctgttccaacagtgagaccattccacagcccctgaatgacaagacaggccttcaaactcaagactacctggctaggtaagaagtactttagtcacaccacttctgaactttcttgcctacctgcagggcaggaatttttaccatttttaaatgaggacactgaagctcagagaagtgatgctatttcctgatgggtaagaggtgatatatttcagtcctcagaccaactctggagtagcaaggttctagtcttaagagtcaaacttggctaggcatggtggctcaagcctgtaatcccagcattttgggaggccaaggccggtggatcacctgaggtcaggagttcgagaccagcctggccaacatggtgaaacctcgtctctactaaaaatacaaaaattagctgggcgtggtggcatgtgcctgtaatcccagctacttgggaggctgaggcaggagaatcgcttgaacccgggaggcagaagttgcagtgagctgagattgtgccattgcactctagcttggggaacaagagtgagacatcagctcaaaaaaaaaaaaaaaaaaaaaagtcaaccttgagccaggcatggtggctcatgcctgtaatctcagcactttgggaagccgatgaagtcaggatttcgagagcagcttgggcaacatgctaatacgctgtctctaccaaaaattaaaaaattagtgggtatggtggctcatgcctgtaatcccagctatttgggaggctgaggcacaaggatagcatgaaccctggaggtggagctgcagtgagccaagattgtgccattgtactccagtctggagtgcaaaaaaaaaaagtccatctcaaaaaaaacacaaaaagaataaatatggggcctcatgactgtatattactgggcttccgacctagactgaaagatcagggaagactttcctgaagagaaagtgagctctgatgggcccactgtactctagcctgggcaatgtaatgaggctctgtctcaagaaaaacatgcagaataaaaccacaataagataccactacagaactattagaatggctaagattaaaaagagtgaccatgacaagtgttggcaaggatgtggaggcactggaatgctcacgctactggtgggaatgtaagatggtacaaccactatgaaagcagtctggcagcttctaaaaatttcagcatacacccactatactactcggcaattccattccattcccacattatttttatttaaaggaaaatcaagtggtatgatctttaaggcatttttgcctgacaaatagatgaaatgtgggtagcagcccaacactccctggtaagtcttcacagggcatatgtggactcgtggcccccaggaaatatggctctttccacaagtgctaagtccactctctccatcaatcctaagatgttagttccacagcactgccagcattgggctttgtctatttctttctttctttgtcttttttgagaggggtcttgctctgtcatccaggctgaagtgcagtgatgcaatgttggttgtaatggctcccatttcatttccaattgatcttatttggctcttccctctttttttcttggttaatcttgccaatggtctatcaattttatttatttttcccaaaaatcagctttacattttatttatattttgtattattttgtttcaatttcatttagttctactctgatgttggttattttctttcttctgctggatttgggtttggtgtgttcttgtttcttgagtttctagaagtgtaaccttagattgtctatttgtgctctttcagtctttttgatgtaggcatttaaggctataaacttttagcacactctttgctgtattccagatgttttgatagggtgcgtcactattgttcagtttgaagaatttttaaatttccatcttgatttcatatttgacccaatgatcattcaggagcaagttatttaatttccatgtgtttgcatggttttgaaagttccttttggagttgatttccagtttattctaccattgtctgagagagtacttcatataatttcaattttcttaaatttattgagacttgttttgtggcctatcatatggcctatcttgaagaaagttccatgtgctgatgaatagaatgtatattttgtggttgttgggtagaatattctgtaaatatctcttaagtctatttgctctagggcatagtttaaatccattgtttcttccttgactttctgtcttgatgacccgtctagtgctgtcagtggagtaatgaagtccctcacaattattgtgttactgtctatctcatttcttaggtctagtagtaatggctatataaatttgggagctccagtgttaggtgcatgtttatttaggactgtgatattttcctgttggacaagtccttttattattatataatgttcctctttgtcttttttaagtgctgttgctttaaagttagtttttttgttataagaatagttactcctgctcacttttgtggccatttgcatggggcgtctttttctacccttttaccttaagtttatgtgacactttatggttaggggagtctcttgagggcagcagatacttgcttggtgaattattatcaattctgcaattctgtatcttttaagtggagcatttagaccacttatattcaatgttagtattgagatttgaggtactgttccattcatcctgctatttgttgcctgaataccttggttttattcatttatttattgtatttttgttttataggtcctgtgagattcacgctcaaagaggttctgttctgatgtgtttccaggatttgtttcaagatttggagctccttttagcagttattgtagtgctggcttggtagtggcaaattctctgagcatttgtttgtctgaaaaagactgttatctttcctttatttatgaactttagttttgctggatacaaaattcttggctgataattttttttttctttttctgagatggagtctttccctgttgcccaggctggagtgcagtggtgtgatctcggctcactgcaacctccgcctcctggattcacgccattctcctgcctcagcctcctgagtagctgggattacaggcgcctgccaccaggcctggctaattttttttgtatttttagtagagacggggtttcaccatgttagccaggatggtctcgatctcctgaccttgtgatctgcccgcgtcggcctcccaaagtgctgggactacgggcgtgagccaccgcggccggcctgataaatttttttaaggaggctgcagatgggtatgcatgctcattggaggtgttcttcccttattgaagattattaaaatcacatgtgttgaaaagcatttgggactgtttacttaattgatgagtactcatttatttttacattaattttgataccatgtataaacaatatataaacataggtatggacatatacatatgtgataggcgatacagcatagaacatatacatgtgcacataaagatagagtgcgacagaaatacttcagatttttgattttaaaactttatgcatgaacctataaaactccctgttaaaaaaaaaaaactggatttaaattgtgctattgtaaatataaaaattaacatttatctgaggaagcccttgctgagttttagagagagtaggtagtaaatttacatctcaaagcacacacacacacacacacacacacacacacacacacacacagaagaatttgggtgtgttcaaggaagattaaaagtagatgccaaggtaacacaaaaatgatagaaatttataacaggattttataaggagaccaattttatttccatacatagcttttattttggtctctgttttccaactgtactccaggaaacacactacacaggctcccttcttaagtgctggtgagccactgcatatacagacagcccactttaagggaagaatcaggggagaagagatgcagaccccagaattatgccaacatacaaatgcctaagtcaaaggtcaaactgcacacttgaaatctcatcacctgtttggccctgttttcagtgtactttactttctttaatttctgctctaaagcttttaaatgaactttcactcttgctctaaaatttgcctaagtctcttcttctgccttatgacacttagtttaattctttcttctgaagaagcaagaattgaggctgctgcagacttgtacagatttgctgccattaatatactttagtgccattctacatgatagaatatacatattcttatatttatacatatatataaaatatatgtattcatagaggccttgaatctacattcttgctgcacttcatgtaaacaatccaggtagaagactaaaagttattttggaaatacatttgtcccatatgatttctatttcataaaaatgggagacaggagggggaaaattatttttagaaaaaaacaacagaacaacagttattaaattttagatctgttcatttttttttttgaattttgttatttacctacaatttgggctgaatcctaaattttttcctggctacaaatttcaaaactaatggtttcagaattttcttccattttggtatattataaattaaaactgtgctttttaaatttttatcatttttttattacgcttttaagttctgggatacatgcacagaacctgcaggtttgttacataggtatacatgtgtcatggtgttttgctgcacccattaacccatcatctaccttaggtatttctcctaatgctatccctcccctagtcccccacccctcaacaggccccagtgtgtgatgttcccctccctgtgtccatgtgttctcattgttcaactcccacttataagtaagaacatgcagtgtttggttttctgttcctgtgttagtttgctgagaatggtcatttccagtttcatccatgtccctgcaaaggacatgaactcatccttttttatggctgcattgaattccatggtgtatatgtaccatattttctttatccagtctatcattgataggcatttgggttggttccaagtctttgctattgtgaatagtgctgcaataaacatatgtgtgcatgtgtctttacagtagaatgatctataatctttgggtatatacccagtaatgggatcactgggtcaaatgatatttcttgttctacatccttgaggaatcgccacactgtctttcacaatggttgaactaatttacattcctaccaacagtgtaaaagcgttcctatttctccacatcctctccagcatctgttgtttcctgaccttttaatggtcaccattctaactagcatgagacagtatctcattgtggttttgatttgcatttctctaatgaccagtgatgatgagcttttttttgtatgtttgttggtcacaaaaatgtcctattttgagaagtgtctgttcatgtgcttctcccactttttgatgggcttttttttttcttgtaaatttgtttaagtttcttgtagattttggatattagccttttgtcagatggataggttaaaccttgcaagctgaaactcgatgacttatgtaaacttctggagaaatcatagcaacttatatataaacaacctttgtgcctgctgatgtgtactatacaaaaggtacacatgaacgctggattcagactgcaattcagaaaaatgtgtcagattgccattgcaattagaagatgcttcagaaactctagaaaacctagtctatagggttagagtgatgtttgccaaacgaattgctctaattgaagcagcagttgtgtgactttaataaagttccaggattatactgtccctttgttgctgtgacttccctttgcctttttctgatttgtcttcatccccttttccacggggcatgacttcttaagaatgagccttcctagtgatgtaggatcagatgaaacatacagtcacaaagtcatgtcttctacaatgctttctctgaaagcttttgaagaatcgagggaccaggtgtgctgacacagacctgtaatcccagcagtttgagagtccaaggcaggaggatcacttgaaaccaggagtttaagaccagcctgagcaacaaagggagaccatgtctctaccaaacataaaataaatcaaattagccaggtgcagtgatgcatgcctacagtctcagatacttgggaggctaaggcgggaggaccacttcagcccaggagttcaaggctgtagtgagtacactccagtcttggtgacagagcaaggttgtgtctctaaaagaaaaaaaaaaaggaaaggaaaagaatggggtaagcaggaaagccaaagatctcgggcatctccagatgattccctgaacaaattgttttttcttggcttcaaaacctttcaagatgtatatttctttgtaaaagaaagacatgccaattgtaactttaagtgagcagtcaaaatctagctcctaaaactgaagtattttaactctcattctgataatatttattttctgaggcaaagaagaaagacaagattagatgaattgtttttctgcccacaccatctcttccgacatgccttatccctttaatcaaatgtataaatactaagcctcctgaaacctcttcagagaaaacacaagccacagaggtttttttgcaactcatgtattcccagggtgtactttcaagttctggctcaataaatctcaatttatcaagacccttgcctcagtcagtcattctggataaccaccatgagtcctgcaaagcccttcagtaatctgttgcctgcctaggtgatgtgtaaggtgagtcaggtcttcatgagtcaaacactcgtcttcctttctgtctttcccaaccctaccactcagtgctgtgtgctctgatctgaccccagctcccaggttgtttgtattggtctaagaaagcaagaccaggaggggcaggttgagaaggaagtaagaagtgaacatggaaagtggcaggtggggctgtcattgctcaaagccacacaccctgggtgcattttatgaatttttctggattcataatcttttccctgtgtgtctatctagaaactcacccccctcctactttcttctcattactctttctgtttctagtgcactcgtttatggccagagaatggccgtgtaaatagttgacaatagaataaaaaatgatgttttctgagacttggaagctggcctttcttttttccaaaagagattggggtttctaaaagctagcttttatgcagggctgtgcagttgtgagtgtagttttagggaacagatgcataagtgaagggtgagacagaaaacaaaatgctggctgtttgtcaaatcctgaaagtaaatgggacaaaaatcatttttgaaggaggatgtcattcaggagaccttgtacatcttagcgtgtcctcttaccagaagaattggaggttgaggttgaattatggatttaagtgacagtgggtatataattctctgcctcagtttttttttttaatctgtaaaaatggggattgtggctcttgggattttttggtgagcactatagttacctgaaaagctcttaggatagtgcctggtgcatagtgagtgctgcatcagtgtgagctattataattatgggaatatacaaaggtatcaccctggccatccagagtggggagatattttctggtcagggtccaggcaggccagctggagatgaagctgattagtagggaagcttaacttccaggagtggaagaatttaggaggagtaaacagaatgcacaacattctgcaaacattcctttacccaacagtaggaatactcagagtgggtgtgtcttccgtgacaatcattatctcctgggaatctaagaatgtgttctagagtcaaatggctttgatgtaagccaaacccagaaatgggcttcagggctgccttgcacatagcattcattcatcttgaaaaaggaaagcattcatcttgctaaaggaatcccctcttctggcccaggccattatttttgtttttgtgctatcctaatttttaaggtgtaagcagaaagactgaagaataaaataatgaagtacatgaatgaaataacagggtagaattgagactgctacatgtaagttaagagaaattgtgtataaatttttgtgaacagaaaaaggatttcttgttgcaaacagacctctctatataaataatacctcctgccttgagtggatagcagaccgcatcacaagaacattccagcagagtcatgagagaatggttagtgtggcttctttaattgtcaggttagactgagtaagttactgaagagaaaggagttgaaggagaagatgggtgagggcaagaaaaatgggaaggtgaaaggaaaggactgaaaggaatgtttaccaagggctcatcaggtaccaggctctgtgactaatgtcttacacatgttaatttactcttccactgtcattttctgatgcagtaagagtcagccttacactgcagatgaggaaagaggctgagggaagtcaaatgagtggcccagggtcatccagccacttcatagcagagctagtgtgtttcactgtggtttgtgcagacagaaaagtgagacatggaaggaaggcaaaacatttttgttgtgggtgatgtttatgaaagtgacccgtatgaggcagaataatggcctcttaaaaatgtccacatccgggccgggtgcaggggctcacgcctgtcatcccaccactttgggaggctgatacgggtggatcacgaggtcaggagttcaagaccagcctggccaacgaggtgaaaccccgtttctactaaaaatgcaaaaattagctgggcgtggtggcgggcaactttaatgccagctacttgggaggctgaggcaggagaatcatatgaacctgggaggcggagattgcagtgagcctagattgtcccactgcactccagccggggcaacatgagtgaaactgtctcaaaaaaaaaaaaaatccacatcctaactcttggaacacatgcatttacttttcttggcaaaaacactgttcaaaggtgatgaggttgagtatcttgagatggaaagcttattctggcttatctggatggctcccagtgtcatcataggggtccttgtaagtgaaagagcaaggcaggagggtcagggtgagaatgatgcagtctgagagactccactggccattgcttgctgtgaacatgtgtgataagacaaaattacaactgatttagttatagatgtaattggtttttatttgtgatttatgatttggggcagctctccctctacagatgcctcagcatcccaagtagctgggactatattgtgggatctggccagcaacctgcaatgcaacagggctctttctttgttcccaggcagatcggcaagttgagaaataaaggacacacacaagatagggaaagctgtgtccaggggtgtcaccgccttctggtcctgcgatgctgccaatgcactggatacaccagcatttattattaagtttagtgagagtgggggtagtttagtgagggatttagggtcatttataggctctccataagggtcacattcctttcccagagctacagacatctgcttttctgggataggaatcttggtaatgtgaaacctccctgactgcccatccattcataggctctctgcagggggaagcacatcacgtgctgttggctcattctggcagtccaacctggcatttttctttacacaatccttcatgcaattttgtacttacaataatcaggagctttaaaggatgtcttgttatgtaaaaatgtgttggctgggtgcggtggctcatgcctgtaatcccagtactttgggaggctgaggcgtgtggatcacctgatgtcgggagttcgagaccagcctgaccaacatggaggaaccctgtctctactgaaaatacaaaattagctgggcatgatggtgcatgcctgttatcccagctacttgggaggctgaggcaggagaatcacttgaacccagggggcggaggttgtattgagccaagattgtcccattgcactccagcatgggcaacaagagtgaaactccatcttaaaaaataaatgaagtgtggttgacatgatatatctgacactgttaacttactctcagaagctacttcttgtgaaatcctaagtacagcattattctgggaagcaaaggagacaggcataagcaaggagaaattaagagaggtaagagtctcatcatgattgatagtcttgttctgacatcttgagaaaagctgtccacagtgtaaagtcatcaacttgttgtcgtggtttgcagtttgagtgtctctaagttatggtgttgaacatttggtgagcttttagtggcccacacctcagacacgagggttttcccatgaaatttacattgagttgtccacctccagcttatatggcttcaggaacagagctgctcttgttcttaatgatttcattggagaaaattgaattggaagaactaaaagaattcagggtccagtccagtctaccagtggattataaatactcaaagataatgaacagtagtggttcaatctggtaacaggtgtactacagtttttcttttcaactagtttttctctctataggagtctctaattttaccaaagataattccagtaggatgaatttgtttgcaaaataggttgagtctcaccgaacttgcccagattttttacctaagtgcggcaagagtagccgtggaccatagaggctctttttaaacgtccctttgctagaagtttttaataagaatctcagatgaaacttccaaaaacctcttgagactaggaaactaaaccaagaccaacttcagactttgcctgctttccctatgggtttattctaggtatattatcaaatataacatcccagtaaaagctttggtaatataaccaatgttttcaaatgtgtcctgttataaagagagcagattcttactgaacttgtgcaaataactttattaccataaacctatgaatactcatgaatagtttcccaattctggggcactcagatagagagcaaaagcaaatgtttcaatttttgtttacaaaagtatactttaccaattgctgaagaaaaaaagttcataaatctggagaataaaacattccaagaatcagcacattttccaataaaaaattatgaaaacattatccttttgattatttagtccaataacattgagtttttttcttctttgtcttgaatttcatgaaggtatcaacctgttctttttctcagtgtctctattgtggcagccattaatgagactctgtctggtttccatggcagggacctgattgacagaaggcccaggtcagcgcatttcaaattcactacctcctttacagagaaagcttctttcccacaggctcccagcaagggtgtgaaagcaagtctagttctccgaggctctctttaactccaatgggtgactggttggaggattcctcatcagccttgcaaaaactcttagaactgcattggtacctaaaacttctttctctttctttttcacaggaatcagctctgcatagcggtctgtgggttctcccatactaccttcatgcctgccccacattccctcacaggtgtcttccctgataaattatcttgtatgtctaatcccatcttggatgcatctcagttggtaaaaactaacataccagacttgattctttgcacttagctttttttctttctctcccacaattagtcagtaaccatgtcctagtgttttatgtgttaccgcttttttcatatctatggaaaaaggtaggtactgttgaggtgcactttctatgtgccaggccctgtgctcaatactttacctgtatctcatttaatccacacaataaccctgtcaggtaggcattatttccattttgctgatgaaaagacagaagcttagcatggtgtaaaaactttcctggtgtcatatggctagtgacaggtggatctgagatttgattctaggactatttgacctcaaggctaatgatgatggtagtaatatagcagctgacattggttcctctttgtgtggcatcttgtttcattgactgcattaaacctttaaaagaatggtatgaagaaagtactcttattgcaattttcaggtgaggaatcaggggttcagagaagttgagtcttgtgcaagaaatttataactgtaaactcttacattaaaaaagaagaaagagctcaggtcaacaacctactttaatacttcaggatacgaaagaagaacaaactaaacccaagcacagtgaatgagggaaataataagtattagggtggatataaataaaatggagaatggaaacagaatagaggaaattactgaaaccaaaagttgattcttcaaaataaaatcaacaaaattgacaaccattaactagattggctaagaaaaaaagagaaaagataaaattactcaaatcataaatgaaaatggactctgagcatggtgggtcatgttttaatcctagcactttgggaggtcacagcagaaggatttcttgaaaccaggtgtttggaccagcataggtaacctggggagatgctgtctctacaaaaaaaaaaaaaaccaattagctgggcatgttgacatgcacctgtagtcctagcatcttgggaggctgaagaaggagaattgcttgagcccaggaggttgaggctgcagtgagccataatcacaccactgtattccatcctagggtggcctacagagtgagagcctgtctctctgtcttaaaagaaaaagaaaaaagaaaaatgaagcgattactaccaattctaataaaataatgattatgaaagtactataaataattgtatgccaataaattggataacctagatgaaatagacaaactcctagaaacacacaaaaatatgaatataactataatcagtaagaagattgaatcaataaaagcatttgatgaaattcagtattttttcataataaaaacattctaagaatggaaggcaaccacctcaacataaaggcaatatgtgaaaaacccaatgctaacatcttacataacagagaaagactgaaaactttccctgtatgagcaggaaaagacaaggatgcctgctattgacacttttattcaacatagtagtgaaaggtctaatcagaaaaattagggaagaatttttaaaaagacattcaaattggaaggaaggagtaaaattatttctgtttatagataacttgaacttatttgtagaaaatcctaaagatggaacaaacctattagaattaataaattcagtaatgttgcacaatacaaaatcaacattcaaacatcagttgtatttcaatacactaaccatgaacaatctgaagggaaattaagaaaaataatttcaatttatattcacatcaaaaagaataaaatatttaggaataagtttaaccaaagaggtgaaatgattatacctgaaatctacaaagtattgctgaaagaaatgaaagatgacatcaataaattgaaagacattttgtgttcatgaattggaagactcaatattgttaggaggacagtgctgcccaaagtgagctgcagattcaatacaattcctatcagaatctcagtgacatttttgcagaaaaagaaaaatctgtcctaaaatttatattgcatctcatgactctaaatagacacacagctttgaagaggaagaatgaagctggaggactcacacttcctgatttcagcatttactacaaagccccagtaatcaatacagtgtggtactggcataaaggaggacatagaaattaatgaaatatcatagcccagaaagaaatgcttgcatatatggccaaatgattttcatcgagtgtgccaagatcgttcaatggggaagggacagtgttctcaccaaatgatattgggaaaggtggatatccaagggcaagaagagtggaacctttacctaacaccatgtacaaaaattaacccacaatagatcaaagatctaaatgtaagagtaaaaactatacaactcttagaagaaaaacttcatgatagtggatttcacaatgatttcttggttgtaacaacaaaagcataggcaacaaataaaatggataaatcagacttcataaaaatcaaaaccttttatatagcccatgcaaagttcctcagcatcacgaatacttagagatatgcaaatcaaaaccacaatgttacaacacctcacacactttaggatggctttgataaacaacaacaatgacagcaacactaaacaacaggtgtttccaagtagatggaaaaattggagctctagtgcattgctgatgggaatgggaaatgttatagccaatgtaaaaagtagtgtggctgtttttcaaaaaattaaacaataaattaccatttgatccagcaattccccttctggacatactccctatagaattgaaagaaatttgaagaaatatttgtacactgatgtacagagaagcattactcacactagccaaaaatggaaacaactgaaaagtccattgaaagataagtgggtaggcaaatgagatgtatctatacattgaaatgttattcaaccttaacaaggaagaaaattacaatacatcgtgcaaaatggatgaaccttgaagatattatgccaactgaaataagccagacacaaaaggataattattatataattccatttataaaagatagttagaatagccagttacatagagacagaaagtagaatggtgggtgttaagggttagggggagaaggagtgagagttactgtttattgggtacagaggtttaatatggtaagaggaaaaagttctggaaatggatagtgtgatagttacacaacactaaattgcacacttagttaatggtaagtctaatattagatatatataaagtgtctcgtggtcttgccctctctataattacacactttttggcactgcccctttcctgccatgcagagccccaggggtgaatctccctatttctctagctctgcatcagtcactgtcctccgtgctgtgtcccacgtgctgtgcccaaagcctcatacagctggtgacttcagagccaggatgcagctcaggagtcagccctgaagctccctctcttcttatttccctgcagcctggcccgggggaggcttggcttcaactggcagctcgatttagccaacttcaggacaggccaccagggccctttctccacacatgttggttccaccccaggtggagtcaggcagggccaggccagtcaccagaggagcccggagcagagcaggaagcagagtctgagctgctcctccctcacccaaagggcttcctcctctcatttgggggaaaagtgtgagcttgtttcaaagcctcagatgttccttgtagctcatggaataggtacaagaaaacaaagacatggcagaaggggatgtgttcgtgacagcgagaagcaacttgatcttgaggactctccttcttgtccctctgtgaagcctcttctaccacatagggctcagggctgataaagccccctccctacctttctcaggccagacacaaggtcagccatgagaaaacagaaaaacaagcagaagagagtctgtagagataagttgggagggttcaggaggagaatttgggatttgcttgtgcccatgggacacagtctgggaatacaaatgttttcctgactcttctctgaaagccagatagactccacctaaaaccctattgccaaggatgctgggatccacttaccagagactttgactatcatggatttggagatttccttgccagtggctgagttacgaacagagcaagcatagagcccgctatgatttgtagtaatttgggggataaagagcttttgtcctgatagctgaaacttcccattaattgtccaagaatactctgccggtgggttagagtccgcaaagcaggacaagtcgaggttttctcctgaacggtaataggtgaatgaagggtaaattctggggaggtctggaccatctggaggaaagagaataaagccacaggtgatgtcatccaagggaaggggatgctcctggtctcttaaagggacacagtgaccctctgaaccaagacacaacctcaagtgacagccaaatcccatctatgtttactaagcccaagcctgaggtattcccctgtttctctcattacaagctgtgggcccctagtgtcccatgacaagagcgcccctccccttatattcttggttaaggctgtgcctacccaggatttcccagggcagggagtcatggccaggtctgatgtccagaagtaaagttgtctatacttggaccggagagagactgagaggcctggcctctggtcgtttggagttaagctggtgtcctggcccacagaggaacaaaggatactcacagaggacattcagggtgactgggttactgcggatgccaccatatcggtcccgtatttcacattgatagggtcctgtttcatttctcgtgacactgggtagaatgagtatcctgttttcaatgggtcgctttaccctcggactgaccgggaggctctgaccatttagccaccaaatgtaggtgtagttccgactcttaggttcacaggtgaaggctaacacatccttcttctccctggggtttaagttgttgatggtgatgtaaggcatgggcagcttcgctgtgtggataacagaagattgtcctgtgtggcacctttgattcctccacaggcatccttcattcagagttggcatctcccacctgtcaacccacatgagtccttgaaagccagtagctggtgcatgtgtcacaagacagatgtatgatgatctaagggctcaaagactgtgaggcctcctgctctgtcttagggaagcacagactttctcaagtgtcaattgagcagcagtgttgggtcatggacagacacgtcagtgggagtcacagcccctggtacccctcccagtccctccataatcagttgactggctggctcaccctgggttccttacctggaatgtgcaactgctgggccccttccaaattacatcctactttgcccccctagatgtgatttctctgcagcttccatttccaaggacattctagagatgagtaataatgggacttcccattgtcctgaaaccctgcagatactgagcagcctggcctgggactggatgtttcagcagaaataacacagggaagaccagagtcaagcctgtaggtcagttcagtcatcaggcactagaggcaccaggtggggcagtttttttgcaggtgtttcatgatgacttacttgaaccagtgacctctaaagatagagcagagtgcaaggaatgatctagaaagagtgaaggggacaggcaagagctggtggctttggagcagaagcatgttccctgtcctgggttctttaagtttcctctccttctgcagagggcaggtgaggaccatgtggatctttctagaaatacatgtggacatttgcaaatgcagaactgagtggtggaaagggtgggaatgaactgctggaaatctagtcctcatggaccatgtgtgtttgatggatatgagacaaatttggagagaagttttgcaaatattttctttcattggacattctactctctgattccatgggttccactaatctagggacctcatgtaagttgattccagattgaatatgagacgaggctgctggaagccaggagctgggagtggggagaatcagaagttgttcatgggtgtgcagtttcagttatacaagttggagaggttctagagatctgctgtagagcttgatgcctatagttcacacagattatctcttatgcataagttttaggacaaaaagtgttttggatttctgatattttttgattctcaaatatttgtcatatacttactggtttagcatcccaaatctgaaagattcaaaatgtaaaatgcttcagtgagcatttcttttcagcatcagattagtaggcaaaagtgggaggtgataagccagatatattcttgcccttttttttctctcaccatgtttctagcttggtgattagttttcggtgaattccatagtggccatgctgcactcgtatatttttgaaggctttgggatgtgagaaaggctgattgctattttctatgtcatcagaactttccaccttttctggttgcttctttttctcagtgtttgtgttgtggcagtcattaagaagagcctgtcagctcagatttaggacagagttttctaaattctgcaaaaaatgttactgggattctggtaggggttgcattgaatctgcaactcaattgggtagtattgcctttctaacaatattgcttcttccaatccatgaaaatgaaatgtgtttccatatattgatatcgtctttaatttctttcagcaatgttttgtagttttcagggtataatcatttgacctttttggttaaacttattccaaaatattttattccttttgatgttaatgtgaattgaaattctttccttaacttcctttcagattgttcattgttagtgtattgtctaaagaatgatctagaaagagtgaaggggacaggcagaagctggtggttttggagcagaaacatattccctttcctgggttttgattttccctctccctttgcagagagcaggtggctcttccctgacagctagatagactttactggaaaacatggtgccaatgctccagggatccacttaccagggactatgatcctcttgattatgagatttgttccaccagtggctgagttatggatgaaacagacatagacccctctatatgttttagtgatttggggtataaagaacacttgtgctgattgctggaacttcccatcaatcagccaagaatgctctgccagtgggtgagagtctgtgaggcaggagagcttggggacttcccctgtatggtaataggtgtatgaggaagaaacggtgggagcatccaggccatgcggagcaaagagaataatgtcacaggcgatattgtcagagggaagggaaaatcctggtctgtggaagggacacagtcacagtgaccctgtgagccaagttgcaacactgaagtcccagccaaatccccgctgtgttcactgatctggagcctgagacattcacctgtttcttccatcacaagctgtggaacctgagtctcccatgacaggagaagcctcttctctcttattgttgatcaagcctaggcctactctggtttgcctggagcagaaagtcatggccagctttgatgttcagggataaaggtctctgtacttggacctgagagggactgagaggcctggcctctggccacttgtatttgggatggcagcctggctcacagaggaacagaagatactcacggaggagattcagggtgactgggtcactgcggctggcactcactgggttccgtatttcacattcatagggtcctgcaatatactttgtgacaccaaatagatagagggtcctgttggttttggacagctgcaacctgtgagtcatagggaggttctgaccattcagcaaccacaggtagcttgcatccggagtctcaggatcacagattaagcgcacagcctccatgacctccctggggtttaagttgctgctggagatggagggcttgggagtctccgctgtgcagaaaacagagagaagattgccctgtgtggcacctttgattcctccaaaggcatttttcaatcagagttggcatttccaacctctcagcccacccaagtccttaaaagcccatggcaggtgtgtgtgttacaagacagatgcatggcaacctgagggctcagtgattgtgaggctgcctgctttatgtaggagaagcatggactttctcaaatgtgaattgagcagcagcattgggtcatggaaagacacaggaccagcagtcacagcccctggtgcctctctgagtccctccgtctccaactgcctgcctggcccaccttttggtccttacttggggcatgcagtgctggaatcttgttagtttcagtctcactttgccccctgaggtatgttttctcatcagcttcccttgccaaggacatcctagagatggatgatggaacttcccattgtccttaagccctttgggtattagaaagcctggcctggaactgggtacttcagcagaaataacacaggggagaccagagtcaggcctggaggtcagttcagtcatcaggcagtggagccacaaggtggggcagttttccaggtgtctcatagtgactgagttgagccaatgactctaaagatagagcagagtccaaggaatgacctacaaagagtgaaagggacaggcaagagctgataggtttggcccaagaccatgatccctgttctgggtccatgatgctcccttccccctgtagagggcagttgaggaccatatggatctttctagaaatacatgttgatgtttgcaaatgcagaactgactggtggaaagggcaaacatgaacagatgacagaagtctggccctcagggaccttatgtgtttggtggatattagaccaatatttgggaagaagtcttgcagatactttctcttattagacattctactctctgattctgagtttgactactctatgtacctcatatcagtggattccagagggaatcagagattagaatagtagtttgcagcaactgaaatcacgggtatagggcgttgttccgtgggtgtgcggtttctgttatgcaggatgaggaggttctagagatctcctgtgcagcctcgtgcctatacttcatgcagatacagtgctccttatgcagaaagcttaaaacaaagtgttttggatttctaattttttttattttggaatatttgcagtatatgtactggtttagcatcccaaatctgaaaaatttaaaatccacaatgcgcgagtgagcacttctttttagcatcacatcagtggtcagaagtgttgagttttgagcatttcagattgtggatttctggatttccgatgctcaatttgtaatactgtaattttcccataaaaagttgtcaggagtttagacctcatgttatattctgactctagtaacaaaaaaaatttggaggaaaccttaaaatgttttcataagtggaaatttttactgatggtccaaacatctaagatcaattgctggtagtcatatttctcttgagaccaaaataaggtttaggtgtgccatgaattccagcaggatcacattatgctcaaagaaagatgccaaaggtgatttgaaattagcaactccttaagtagagagagtcctgttaaaaggaccgaactggttagtgtgtcaattacataaaaggaggaaggatgccaaattaaaagaagtgatgtgtgttatgttagtaaatatagaaagaacctgcttctaatttctgtgcagagttacaaaacatggggaggaccccaaaacaggtatgtgaaatgtcttcttcattttctcttaaggtcaggaaacaccactaaaatttaagtttgtgtgaattaggaagagtctaagtgagatgccaatggctcttgtgtctccccacacgaagaactccaacttatgaaaacggcatcatcatgaggaaatagttgtatgtggcacaggcagtaaaaccatgagataggacctacctggccacctccatctggtccccaaaccacaagtattcccgttaagtgtatgtgacagcctttgtagttgtcccacaactacaaaatttaaaaattgctattgtcaaaacaaaatattaaatatgaagttgaatatgttgttccgctttttttccccactctttttgagctttcctgtttcagttttggaagtttctattgacacattctcaagctagggattctttcctcagctctgtgcggtctatcagtaagcatcaaaagcattcttcatttctctaacagcatttttttttctgagacagagtctcgctctgtcaccccagctgcagtggcatgatctcagctcactgcaagctccacctcctgggttcatgccattctcctgcctcggcctcccaagtagctgggactacaggtgaccaccaccatgcccagctaattttttgtatttttagtagagacggggtttcaccatgttagccaggatggtctctatctcctgaccttgtgcccgcctcagcctcccaaagtgctgggattataggcgtgagccactgtgcccagccatctctgaaggattttaatgagttgttgacttttgagtttgttcagctttttacttagtgttagaaccgagtgacaaatttcaagcttgttttatgcctgacaggaagccagaagtctctagaaagtgaccggagaatgtgagctccatagcaggttgaggatggagtcactagtgaaatgggtgaaatgagcctatgggcttaattgctcctataattgctcctatagataacatcactattgtagaacgtgagattggtcttttgaaatgtttctcattcttttgccttctgacaaccggctgacctcatccatacctatgcctaatggctcagccagtcatgtggcccctacctagaggcagattcaagcactaacagatcatttccctccgcccgcatgattccatcaccaatcagcagtactcattttttagtcctgtgcccctgaaactatccttgaaaatctctaacacctgatccactggggaggctgatttgagtaataataaacctccaccctcctgtttggcagacttggagttcttaaaatctttctttactgcaaaccaccatttcaataaattttattttattttatatttttttgtgtgcaggaggccagaggaacttgtctggcaattacaagggtggatgggggaactgcctatccctgtcccatggtcttgtccacaggtcagcctcacaaagggaaagagccctggatgggaatacagtggaaggtttctcttagtgacctggggacattggctcgagaggaagcctggcaggagtggcaactccaggtgatttctgcacctttcctatttcctgggaggtgggccaggccacagtgttagcgggaagggaacagaacagccagcctagttagagggagtgtctggggaaggcctagggttggaggaagaagctgtgcaggacagggcttgccagtcagaatgaagtgggaggaagatgagggacacagagaagcagagagaggcagagacaccatggcagtgagcagtgagggagacactgacttcaaaaaccccagggaccaggtgcccccagctccacagtccaggaccaaagagccctgagaaccctccggtggccaaagaacttcagagttgcatgaggtggggtggctttagggtcaagaggtagtggggggatgaaacatgggtgtcagcctctgaaggacaagggacaggtgtggctagaacctcctaggattctgattccaagatccagtctctaaagaggttttggatcatccatttcttcattccattccttcatttgttatgtgagagctcctgagtgtgtctctctcactgggcctgtgctgaggcagggtgtgagtggggaaagaaaacaaggtcctctccttgatcctctcatgacggtgacatggacacttgggaaacacaggatttcacattcagtgatggaggttaagatctgagggggagacctggacattttttttgcactgactctggcggttgaagccagtgatttagttctggagtacagactaatcagctgaccatttgctctcactcctctgaggtttggatgcctaagaagagaggatttgagtcaataaatgactatggggtccttggaacccagtaagccctcacttctggtagaggagaggatgggcctgtggctgcagacagacctcatgtgaccccgatctcccctttgtgtttgtgtgactgtggctcagtgactgtgccttcctgtgcctcagttttctctcaatcaaatgagctaaatggcaaatggactgtggcttttcatgctatctgtgaataaatgttaaagtattcacagtcaactgacttaatgcttggcacagtggaggtgttcacacaaacagcatttattattaatttgcttccatgagaaagcacctttgcgtcagatccctgtggacaaacggctacctggtgcatcttctctcttctgtttctgcttctggggatattagactttctatggagtgtcctaggcctcctaaggcagttggctgatggcctacaaagcttgtctttctgtcctctccactctgagtgtcaggtgaagaaagctctgtccttgcccagatgaggctctgaggactgagccctggctggtgaacagctccaggagacacagtcctcagacagctggtaaatccttggtcccagtaagccctgccaaagaagccacaacccagtcctggcacaggctcctcagctttacctggagcaaggatttagggacaggggtctgggattgaggcttccagagctgaggttctctgagggtatctcagtgggcccctcaggccaagccctactcagttttccagggtctttctcagggtcaaatttatgaagagggcatgaggtgcttggctgagactgatctcctcctgctgagtccccccatcagactgtccttcctctgcagcgagtgtctgcagggtctggatgcgggaaaggaattctgatctgttgaaatgtgtctcctctgtgtgtgtcctgcactaaatgcccaaaccccagcatgggacataatgcagagagtgacacaggcagagtccaggcctgacaattctgtgtgtgtgaagtagaaatgacccctgccccccaacacccagggatcatgcggaatcactcacagtataaggtgacagtgaaatatccagttactcctccagtcccatcgcctcgctttatgatgtgtaaggtgtaggatcctgcatcctcctgtgtgacattctggatcagcagggatgcattggaatatactgtttctcgtccactgtaggcaggcccatatataatttgaccgtgtactacatatgatgtaatgtaatggtagaggtccgtcatttgccctttgtaccagatgtagccagtaagattctggggcaaattgtggacaagtagaagaacatccttcccctcggaaactttgggtggcttggcttcaattattacttgggcagtggtgggcaggttccagaagtttaaaagtgatgctaggaggtagagacagcatcagttaatatttggacctatgtattggggtgaaaagatggggccctgtgtcctgagaaggtctcttcaatcatcagccttgaagatatgcacacacacacatacaaacacacacacacaaaagggcatgtgtgtttgtgtgtgtgtatgtgtgtgtgtcctactgtcctactaggtcaaggtcagcagcatgacccccattccttcaacactcctgaccttggcatttttctgtttgcaatcctcttccccaggggtccgcacggccccctccacactgccctcaggtcctgctcacatcagggcatccttagacttctttcctgatgcctgcttcagagaccctgggtcttccctttctgacctttccctgctctgctccctctagggttcttgtcaacacctgacctcacattctatatctctttgcatgtctgtcttcctccccatgagagtgtgagctctgtgaggacagagacttttgtcatgttggttgcaccccagtgcctggaacaggatgcagactcctgtagatgtgagagttctcagggccctccatgccctgggtgttttttttcccccaattgttgaggttttttgctgaggaaagtgtttcatgccctggttacatttttatttgaggtgtcatctgatatagtcattattatcatttttcaaaatgtggtggcccctgatgattaatcaggaaaacagaacacttaagattttactacctcttaccaattccggttcaatgtgactttcctattttgacccctgtccctctctggtgtattttcccctatccaggctccaacagagccttctttccctttttttctttcttctttttattcttttttttttttttttttgaaatggagtctcgtactgtcacccaggctggcgtgcagtggtgctgtctcggctagctgcaacttctgcctcctgggttcatgtgattatcctgcctcagcctcccgaaagctgggattacaggagcacaccaccatacttggttaattttttgtattttttggtagagacacgtctacactgtgttggccagactgatcttgaactcctgatctcgtgatccacccacctcagcctccctaagtgctggcttcttttattttttagaaccccatcctctccaggataccccatccagtcactctgcttcctcctcctgtcctctcccaggaagtcctctcctcacctgtgagcaggagccccttccaggtgatgtgctgagtgcagggaggggctgagaggggtcccatggtctctgctgtctgtgtgttctcccctgtggagatgagcctaggatccagagacttcctgagcagggctgtcaggtgtgctgtccttcctccttctgtgctgagcctcttcccagggcagaagcacttctcaggctcatgggcggggtcaggcccaggacacctctctgtcccctcctctctcagtcctgcctccttgtccctccttctgtttttccttttgtctgtgtttcaggtccctgggaattgtggaggcctctgcctttttcagcagtgattctttcaccaaacctcaacacacactttgtgcagacacacacacacacacacacacacacacacacagacccacacagtgacacacataccctgcaggttgggcgaggacagtcctgggcctcagcctcctgctgtccccatggctctgggtcggggtgcacattcatgccatttgccctctttcatccccatctggctctccccttcagtgcaggaggctggagctgcaccaggtccctttcacagtgatgtcccattgtgctgtgggtgagctgtgtgttgcctggtgagagggacccttcctttttctaatcgtgtctagcttggctgcagcttccaaggatggtcattcaggacctgggtgtcccagaggaaactgtccttcctggaggtgtgcagggtgaatctctcatgcctcttgggaggagaggcctgtgcctgttgctcagtggtggctgtgagtcccatagtcaaagggaaagttctcggtcactgtatgactccgtggggtccggtggctgagctggagctcatggtttctcatgttcttcctgaccatctttgatgtcctctcttctctgcccagctgattgtcctgtggtcaccacagcttctccgtggtggtgcagaaggaagtgaggagttaaacaggaacccggtgggacatggctcgttgagacgcaggagggggagcctgggtcggagcagagtttcagagctggagagattcatcccgaccaactccgtggcaatgttgggcagagcctttcatgtgttgacatacccaggggtctgtcctgagggtttttgacctggccaagctgctgtgtgtagaggaggaacaggcagtggccagagatcctgtctggagggacgttgctcacacctgagcgggcgggtggggggtgagttgtgttctgggagcaaagagcaataacatcccccttctccccgcaagcacacaggagaggtctgtcttcccaagggacagctggggataggtggccacacctcggatggtgcctgtgtgtgaccatcacacgcgctctgagccccgtggggtgcagcgtgcaggcaggtcacagggtgcctggctgattcccggtgaggctgtgggccctcaggcagccgctattctgtgtcagcgctaagcttggcctgggatgccccagggaacaggacagatggagcaggggcgggcatttagggagcggtgacagaaagagttgatgaggatggagggaggtcacgaggggaaagcgcccagtgtggcatcgcgtgcaccagcgctgccctgggagatgcctttagctgggcccagggaaggagcaggtgtgtggggcaggagctacctgcagagggcgtggtgttaggttggtggcccccaggtcagggaggagctgacagagtccgtgtggggagcatggagggcgctgaggacttaggccgaagtgaccctggtgagggtggacactgctgggctgtgggttccgctgagggaggttggcttcccctgggaaggctccaggctgggagggactcggtcaccctctggtggacagggagggaagtgtgaacggcagcaatcccaggccaggctgcatgttttattccacgtggatctgcacacttcacacgaggtaacacgtatgttatgttacagctccttcaccttccagccccgtgagacccagtctttgtggctgtacgttcactgttctccctctttcacagtcagatgtcccaaaggcagatttttgtcacctttgtgagtttgtgtttgtgtgcagtaggtggcactgtgtataccctgggagcagtgatgtctggggctgagcagtgcacgtgggcttgggagcagaagagggagcagcagcgtgggaagatcaatgtcagaggggcagggacaagtcattttcattttctcactcccagggaccaatcccaggattctgactccagggcacagtaccacaccctgcttgtgtccctggatgtcatgatgctcatagtgtcatgttgccttggcattcattttttaaggtgtaagtttatttgcctcaaatcagaggcagggcttggtcaccatggcagttttcaatactgtatctggttcaagtggctccagttggtggccagagataaaatcttagaggtatctctcctgcttggtgtgctgggctcacctctctccagctgctttctttaaactgataattctgacatttgccctcacatttaaagtgaccacctctcagtcacagcttgagctcctggtcccagtgtttgctgcttgctttgaacacatccattaaagctccctgctggaaacctgtcagataacaccctggacttaataaaggcattggcttaccggtctcttctctcctccctgcctgggctcactgacctctgtgtctgtggcctccaggtgtgctgagtgctccctagtgtctgtaagtagtaaaaatacttatattttcacgttcttgttatatcattatagcctcacatgccatccagggcctgacattgaggctgccctatgggacttgtgctggttgagcttctgctggagctcttgttttggggcctctggttctcctggggacaggagcttccagctaacttgattgaaaacctgatgcctttcattggaacactgggtcaggtgatgtattcatgggcttcacctgccataacataaccttagcctgggtgaattaaataatagaaatctatttttcacagttctgtgaataatgtgctattttaaccactttaaaatgcacaatcaagtgaaattaaccacatacaccatgttaaattaccatcaccactatttttcctagaaaatttttatcattttaaactgaaactttgtcacttttaaacaatacctccctgtatgttccaccctagaccttgatcatctccactctctctctatgaatttgcctattcttgatgtttcatataaatggaattatacaattatgttattttgtttctgacatatttcacttagcataatgtttcccaagtccatgcatgttccagtgggtgtcagagcttcattcctctttatggcaggttaacaatctgttgtatgtgtcaccatatttgtttattcatgtgttgatgaacacttggattattttcatattttatcttttgtgaataatgctgcaatgaacattcccatgcaagtacctgtttgaggccctggatttaattctttgggtatgtacctaggaatgcctgttgtttcaaatgagaattctatgattagctttttgaggaacagcaaaactctttctccaagtggctgtaccttttcatattctcaccagccatgtatgaggattccaaattctacataatgctgctacttgttgtttaacattttaaaagaatggtagccagttttgtaggtgtgatgtggtgtctcattgcagctttgactttgtattttcctaatgactatagatgttgagtatcttttcatgtccttcttgactatttgtatatcttctttgaagaaatgtctatatgagtcttttgcccatttataaattggatggtttgtccttttgttattgagttttagctagttctttatattaactggatatgaaaactgcctatatgtggtttgcaaatattttctttcattcttttctattaattattttcttgataatttcctttgatgtacaaaaggctcacatcttgataaagcccaacatatcttgtttttcttgtttctcatgcttttgtatcatatctaagaatccattacacatttgagttcatcaatatttacctctatgtctagtttaagatgtttttatggttataggtcttatattttactcactcatcaattttttagagaattgtttgatatggtgggaggcagagttatctaaattcactgttttgcatgtggttatctagttgtttctgtactatgatttgaaaggagaattgttcatccattaaattgtcttgacaccctcttcaaggagtaattgaccataagtttgagggtttatttctagattcttaattctatcccatttgtctttatgtctattcttttgccagcagcttatgtctattctttggcagcagcttccattttaataattgtactcttttgtgagatttcaaataagaaagttcaagtcctacaatttattttggcaagattgttttagctactcaggggtacttttttgaaaggtggggaggccaatgtttcacaattgggaaagccttttctctcttcttcagggggaaatttgggagaagcttttaagaaactttatctaagtaggtaaactgtcaccactttatttgctgaagtgctatgttaaagtgtgcattgcctcttgtggaagaattatgagaccctggaagcacttgcccatgtggtgagagacagtgaattccacgatgaggggcagagaggacattgttttgggatacagtgttgttgggggagttgtatacatctcaacttctttatgtctctgtacagtgggtgtagggagcagccccacagggtcgttgggtttttctccctgtgtgtggagatgagagattgtggaaataaagacacaagactaagagataaaagaaaagacaactgggcctgggggaccactaccaccaagatgcggagaccggtagtggccctgaatgccaggctgcactgatatttattggatagaagacaaaggggcaggataaggaatgtgtgccatcttcaatgataggaaatgccacctgtgtcacatgtccactggacagggggcccttccctgcctggcaggtgaggcagagagagggaggagaatgagagagagagcttacagcattatttctgcttattagagacttttagtactttcactaatttgctactgctaactaaatggcagaaccacgtgtacagtatggaacatgagggcggactaagagtgtgaccactgaagcacagcatcacagggagacggttaggcctctggataactgtgggtggacctgactaatgtcaggccctccacaagaggtggaggagtagagtcttctctaaactccgccggggaaagggagactccctttccggtcggctaagtagtgggtgtttttccttgacactgaggctaccactagaccacggtccacttggcaaagggtgtcttcccagacgctggtgttaccgctaggccgaggagccctctagtggccctgtctgggcataacagaagccttgcactcttgtcttctggtcacttctcactatgtctcctcagctcctatctctgtatggcctggcctttcctaggttatgattataaagcgaggattattataatattggaataaagagtaattgctaccaactaacaattaatgatattcatatataatcatatctaagatctgtacctggtataactattcttcttttatattttatgatactggaacagctcatgccctgagtctcttgcctcagcacctgggtggcttgccgcccacaagtgggcatctccattggacacagtaggttttgaaatccttgtttatcctctggggtctgggtcttggcttacctattagctgcaactgaaagaggagtctgttaagtcaatgactcctgtacggagtagaaggtttcagcagagtgaaagtagctggggttcatagaagccaggaatgtctgactcttagaaactgtgtgtcagcagatgggtgtcctcaggggtacatgggccatgccagtagccactgcagtggactggaagaaggtaagggatgctgggtatcccatgttctctctcagctctgcagctgaagatttgggccctgggcttgtacgaccctgaagcaggggaagggtatacaggaatggctgcatatcaggaccaagtccatgtcatcttctgaggcattgttactgcagatggaggattctgttcagagaccaggcctggacacatgggagggcccaccccattcttttaaaattgttttaagagaacagtattagcaaatgtagtacatgttttattctgctagaatcagtcttactgtcacgttttacaatgtatctcttaggaaatggtgagagccatccacacaatgtgcatttaaaggggagtctactataatttcagctttcctactctttatagaaaccatcttctctgcaaacacacaggcaatatctctgtgttcatttctattgggagccctgtatgcaagatggagagagccacatttcctcctgagatgttatgtaaaagtctgaggttgagatgacatatctgacactctgttgttaccctcagaagctcctatactacatgtgaaattctaatgactgcattatcctgccaagtgaaagaggcaggcacaagcaaggacagctaagaggggtgagagcctcatcatgatggggagtcttattctgacatcttgggaaaagctgtccacagtgtgaagtcatcaacttgttttccttgtttacagtttgagcagctgttgttatggtgttgaacattttggtgagttctgagtggctcagacatcaggtacaaggattttcccatgaaatttacattgagttgtccaactctgacttatagggcttctggaacagagtgggtcttgctctttgaggttccatgggagaagatggaattggaggaactagtagaattcagggtaatgtccagtctacagtggataataaaaacacagaaacaatgaacagagctgcaatctcataacaggtgtactacggttttattttccacataatttttctctctatgggcatctctagttttaccaatgataatttcagtagaataagtttgtttgcaaaataggttgagtttcttcaaacttggtctgattgtttacataagtgcagcaagagtagcaatggactatgtaggctctcttttaaaattttctttgctgtaagtttttataaggaatctcagattaaacctttacaaaactcttgagaataggaagccaaaccaaggctgacttcagagtttgcctgcagttcatactggttcattctagctatattcttaaatataacatcccagtcaaagccttggtaatataaccaatgatttgaaatgtgtcctgttacaaagagagcaggttgttactctgtttgtgcaaatatctgtattaccataaacatatcaatactcatgaatagttgcccaattctggggcattcaggtagagagcaaaagtaaatatttcaattatcattcccagaagtatagtttattgaaccactataagctagagatagattaaaagacaaatttccataaatctagaaaactatccacataaagaatcagcatattttcaaataaaaatcataaaaacattatcctcattattatcaattatttcaatgaaatcaatgtttttcctgcttggtctaggctgggaatgttatgaagatatcagcctgtttgttaaagttttcgaagttcttagacaaatttggagggttcaggaggaaaatttgggatttgcttgtgcccatgggacacaggctgggaatacaaatgttttcctgacttttctctgaaagtcagatagactgcacctaaaaccctattgccaaggatgctgggatccacttaccagagactctgactgtcacggatttggagctttccttgccagtggctgagttacgaacagagcaagcatagagcccgctatgctttgtagtaatctgggggatagaaagcttttgtcctgatagctgaaacttcccattaattgtccaagaatactgtgccggtgggttagagtccgcaaagcaggacaagtagaggttttgtcctgaatggtaataggtgaatgaagggtaaattctggggaggtctggaccatctggaggaaagagaataaagccacaggtgatgttatccgagggaaggggatgctcctggtctcttaaagggacagagtgaccctctgagccgagacacaccctcaagtgacagccaaatcccctctatgttcactgagccgaagcctgaggtattcacctgtttctcccatcacaagctgtgggccccaagtctcccatgacaagagcgtccactccccttatattcttggttaaggctgtgcctacccaggttttcccagggcagggagtcatggccagctcggatgtccagaagtaaatatgtctatacttggaccggagagagactgagaggactggcctctggtcgtttggagttaagctggtgtcctggcccacagaggaagaaaggatactcaaggatactcacagaggacattcagggtgactgggtcactgcggatgccaccatatcggtcccgtatttcacattgatagggtcctgtttcatttctcgtgacactgggtagaatgaggatcctgttttcaatgcgtcgctttaccctgggactgaccgggaggctctgaccatttagccaccaaatgtaggtgtagttctcactcttaggttcacaggtgaaggttgagacatccttattctccctggggtttaagttattgatggtgatgtagggcttgggcagcttcgctgtgtgaataacagagagaagattgtcctgtgtggcacctttgattcctccacaggcatccttcaattagagttggcatctcccacctgtcaacacgtgtgagtccttgaaagccaatagctggtgtgtgtgtcacaaggtagatgcatgatgatctaagggctcaaagactgtgaggccacctgctcagtcttagggaagcatagactttctcaagtgtcaattgagcagcagtgctgggtcatggacagacatgtcagtgggagtcacagcgcctggtacccctcccagtccctcactaatgagttgactggctggctcaccctgggttcattacctggaatgtgcaactgctgggccctttccaaattgcatcctactttgcccccctagatgtgatttctctgcaacttccatttccaaggacattctagagatgagtaataatgggacttcccattgtcctgaaaccctgcagatactgagcagcctggcctgggactggatgtttcagcagaaataacacaggggagaccatagtcaagcctggaggtcagttcagtcatcaggcagtggaggctcaaggtggggcagttttttgcaggtgtttcatgatgacttacttgaaccagtgacctctaaagatagagcagagtgcaaggaatgatctagaaagagtgaaggggacaagcaagagctggtggttttggagcagaagcatgttccctgtcctgggttctttaagtttcctctccttctgcagagggcaggtgaggaccatgtggatctttccagaaatacatgtggacatttgcaaatgcagaactgactggtggaaagtgtgggaatgaactgctggaaatctggtcctcatggaccatgtgtgtttgatggatataagacaaatttggagagaagttttgcaaatattttctttcactggacattctactctctgattccttggggttgactactctagggacctcatgtaagtggattccagagtgaatatgagaagagactgctggttgccaggagctgggagtggggagaatcagaagttgttcatgggtgggcagtttcttttatgcaagatggggagtttctagagatctgctgtagagcttgatgcctatagttcacaaagatggagtatttcttatgcctacaacttaggacaaaaagtgttttgcatttctttcattttttgattctgaaatatttgtcatatacttactggttaagcatcccaaatctgatagattcaaagtctaagatgcttcagtgagcatttcttttcagcatcagattagtaggcataagtgggaggtgataagccaaagatattcttgcccttttttttctctcaccacgtttctagcttggtgattagttttcggtgaattccatactggccatgctgcacttgtatatttttgaatgccttggcatgtgagaaaggctgattgctattttctatgtcatgagaactttccaccttttcatggttgcatctttttctcagtgtttttgttgtggcagtcattaagaagagcctgtcagctcagatttaggacagagttttctaattctgcaaaaaatgttactgggatgctggtaggggttgcattgaatctgcaactcactttgcgtagtattttctttctaacaatattgattcttccaatccatgaaaatgaaatgtgtttccatatattgatatcatctttaatttgtttcaggaaggtttgtagttttcagggtataatcatttgacctttttggttaaacttattccaaaatattttattccttttgatgttaatgtgaattgaaattattttcttaatttcttttcagattgttcattgttagtgtatagtctgaagaatgatctagaaagagtgaagggtacaggcaaaacctggtggttttggagcagaaatatattccctttcctgagttttgattttccctctccctctgcagagggcaggtggctcttccctgatagccagatagacttccctggaaaacatattgccaatgctccagggatccacttaccagggactatgatcctcttgattatgagatttgttccaccagtggctgagttatggatgaaagagacatagacccctctatatgttttagtgaattggggtataaagaacacttgtactgattgctggaacttcccatcaatcagccaagaatgctcggccagtggatgagaatctgtgaggcaggggagcttggggacttctcttgtatggtaataggtgtatgaggaaaaaatggtgggggcatccaggccatgtggagcaaagagaataatgtcacaggtgatattgtcagagggaaggtaaaatcctggtctgtggaagggccacagtgaccctgtgagtcaagtcgcaacactgaagtcccagccaaatccccgctgtgttcatgatctggagcctgagacattcacctgtttcttccatcacaagctgtggaccctgagtctcccatgacaggagcagcctcttttctcttattgtggatcaagcctaggcctactctggtttgcctggggcaggaagtcaccaccagctttgatgtccaggggtaaaggtctacatacttggacctgagagggactgagaagcccggcctctggccatgtgtatttgggatggcagcctggctaacagaggaacagaagatactcacggaggagattcagggtgactgggtcactgcggctggcactcactgggttccgtatttcacattcatagggtcctgcagtatagtttgtgacaccaaataggtagagggtcctgttggtttcagacagctgcaagctgtgagtcatagggaggctctgaccattcatccaccacaggtagcttgcatctggagtctcaggatcacaggttaaaatcacagcctccgtggcctccctggggttgaaattgctgctggagatggagggtttgggagtctccactgtgcggaaaacagagagaagattgccctgtgtggcacctttgactcctccaaaggcatttttcaatcagagttggcatttccaacctctcagcccacccaagtccttaaaagcccatggcaggtgtgtgtgttacaagacagatgcatggcaatctgagggctcagagattgtgaggctgcctgctttatgtgggagaagcatggactttctcaagtgtgaattgagcagcagcattgggtcatggaaagacacaggaccagcagtcacagcttctggtgcctctctgagtccctccatctccaactgcctgcctggcccaccttgtggtcctcacttggagcattcagtgctggaatcttcttagtttcaatcttactttgccccctgtggtatgttttctcttcagcttccctttccaaggacatcctagagatggatgatggaacttcccattgtccttaaaccctttgggtactggaaagcctggcctgggactgggtacttcagcagaaataacacaggggagaccagagtcaagcctggaggtcagttcagtcatcaggcagtgcagccacaaggtggcgcagttttcccaggtgtctcatagtgactgacttgagccagtgacctctaaagatagagcagagtccaaggaatgacctacaaagagtgaaggggacaggcaagagctgataggtttggcccaagaccatgttccctgttctgggtccatgatgctccctttcccctgtagagggcaggtgaggaccatgtggatctttctagaaatacatgttgatgtttgcaaatacagaactgactggtggaaagggtgaacatgaactgatgatggaagtctggtcctcatggaccatatgtgtttggtggatattagaccaatatttgggaagaagtcttgcagatactttctctcattagacattctaccctctgattctgagtttgactactctatgtacctcatatcagtggattccagagtgaatcagagagtagaatagtagtttccaggagctgggattaggggaatagggcactgttccgtgggtgtgtggtttcagttatgcaggatgagggggttctagagatctcctgtacagcctcatgcctatagttcatacagataaagtgctccttatgcagaaaggttaaaacaaagtgttttcaatttctaatttttttattttggaatatttgcagtacatgtactggtttagcatcccaaatctgaaaaatttaaaatccacaatgcgccagtgagcacttctttttagcatcacatcagtggtcagaagggttgagttttgagcatttcagattgtggatttctggatttgggatgctcaattcgtaatactgtaattttcccataaaatgttgtcaggagtttagacctcaggttatgttctgactctaataacaaaagaaaaatttggaggaaacattaaaatgttttcattagtggaaatttttactgatggtccaaacatctaagatcaattgctggtagtagtatttctcttgagacgaaaatgaggtttaggtgtgccgtgaattccagcaggatcacattatgctcaaagaaagatgccaaaggtgatttgaattagcagctccttaagtagagagagtcccgttaaaaggacagaactggtcagtgcatcaattacataaagagaggaaggatgccaaattaaaagaagtgatgagtgttatgttagtaaatatagaaagaactgcctgcttataatttctgggcagagttaggaaaaatgcggaggaccccaaaacaggtatgtgaaatgctttcttcattttctcttaagctcaggaaacaccactagagtttaagtttgtgtgaattagtaagaggctaagtgagatggcaatggctcgtgtgtctccccacacgaagaactccaacttatgaaaacggcatcatcatgaggaaacagttgtatgtggcacaggcagtaaaaccatgagatagcacctacctggccacctcgatctggtccccaaaccacctgtattcccattaagggtatgttacagcctttgtagttgtcccacaactacaaaatttaaaaattgctattgtcaaaacaaaatactaaatatgaagttgaaatgttgttccactttttttcccccactctttttgaactttcctgtttcagttttggaagtttctattgacacattctcaagctaggtattctttccacagctgtgtgcagtctaccagtaagcatcaaaagcattcttcatttctcaaacagcattttttttttctgagacagagtctctctttgtcacccaggctggagtgcagtggcatgatctcagctcactgcaagctccgcctcccggtttcactccattctcctgcctcagcctcccgagtagctgggactacaggtgcccaccaccacgtcccactaattttttgtatttttagtagagacggggtttcaccatgttagccaggatggtctgtatctcctgaccttgtgcctgcctcggcctcccaaagtcctgggagtataggtgtgagccactgtgcccagccatctctgagggattttaacgagttgttgacttttgagtttgttcagcgttttacttagtgttagaaccgagtgacaaattccaagcttgttatatgcctgacagaaagccagaagtctctaggaagtgacaaaagaatgtgagctccatagcaggttgagaatggagtcacgagtgaaatgggtgaaatgagcccatgggctttgggaactgcaggcccttccagcctctgacaccctgatgagtccgtgcaaagattacaacagtgacagcaaactagcgtggctgactccatctggcatctagtctcaggctggctgtcctcactcattcctggacataggccaggctatccttgggaagaatttggtttatggtttaactttgaagcaagaatgatgatagttcctccataaaactaacacccttactttgcccagggactgccttggtaaaactagtgaaagaccatgagatttagattataagagggaactgaattctgctaaaatgttggcacagtttctataatccctgactgctccagtgtcatttggcaagagtttacaaaatttgtaactaattgctcctatagataacatcactattgtagaacgtgagattggtcttttgagatgtttctcattcttttgcattctggcaaccggctgacctcatctatacctatgactaatggctcagccagtcatgtggtccctacctagaggcagattcaagcactaacagatcatttccctctgcccacatgattccatcaccaaacaatcagcagtactcattttttagtcctgtgcccctgaaactatccttgaaaatctctaacccctgatccactggggaggctgatttgagtaataataaacctctgtcctcctgtttggcagacttggagtcattaaaatcattctttactacaaatcaccatttcaatatatatatatatatatatatatatatatatatatatatatttttttttttttttggtgtatgtatgtgtgcaggaggccagaagaacttgtctggcaattataagagtggatggaggaactgcctatccctgtcccatggtcttgtccacaggtcagcctcacaaagtgaaagagccctggatggaaatacagtggaagctcattctcttagtgacctggggtcattggctcgagatgaagcctggcaggagtggcaactccaggtgatttctgcacctttcctatttcctgggaggtgggccaggccacagtgttagcgggaagggaacagaacagtcagcctagttagagggagtgtctgcggaaggcctagcagtggaggaagaagctgtgcaggacagggcttgccagtcagaatgaagtgggaggaagatgagggacacagagaagcagagagaggcagagacaccatggcagtgagcagtgagggctacactgacttcagtgaccccagggacaaggtgcccccatttccacagtccaggaccaaggagccctgagaaccctccgtggccaaagagcttcagagttacatgaggtggggtggctttaggggcaagaggtagtggggtgatgaaacatgggtgtcagcctccgaaggacaagggacaggtgtggctagaaactcctgggattctgcatccaagatccagtctctaaagaggttttggatcagtcatttctgcattcaattcctttatttgttatgtgagagctcctgagtatgtgtctctggctgggcctgtgctggtgcagggtgtgagtggggaaagaaaacaaggtcctctccttgatcctctcatgacagtgacatgggaactttgggaaacacaggatttcaggttcaatgatgggtgttaagatctgagggggagacctggacattttttttgcactgactctgatggttgaggcagctgatttagttctggagtgcagactaatcaggtgaccacttgctctcactcctctgaggtttggatgcctaagaagagaggatttgagccaataaatgagtatggggtgcttggaacccagtaagccctcacttctggtggaggagaggatgggcctgtggctgcagacagacctcatgtgaccctgatctcccctttgtgtttgtgtgactctggctcagtgactgtgctttcctgtgactcagttttctctcaatcaaataagctaaatggcaaatggactgtggcttttcatgctatctgtgaataaatgttaaattattcacagtcacctgacctaatgcgtagcactgtggaaatgttcaccaaacagcatttattattaatttgcttccatgagaaagcacctttacgtcagatccctgtggacaagctgctacctggtacatcttctctcttctgtttctgcttctggggatattagactttctatggagtgtcctaggcctcctaaggcagttggctgatggcctacaaagcttgtctttctgtcctctccactctgagtgtcaggtgaagaaagctctgtccttgcccagatgaggctctgagggctgagccctggctggtgaacagctgcaggagacacagtcctcagacagctggaaaattcttagtcccagtaagccctgcccaagaaaccataacccagtcctggcacaggctcctcagctttatctggagcaaggatttagggacaggggtctggggttgaggcttctagggctgagcttctctgagggtctcagggggcccctcaggccaagccctactcagttttccagggtctttctcagggtcaaatttatgaagagggcatgaggtgcttggctgagactgatctcctcctgctgagtccccccatcagactgtccttcctctgcagcaagtttctgcagggtctggatgtgagaaaggaattctgatctgttgaaatttgtctcctctgtgtgtttcctgcaataaatgcccaaaccccagcatgggacataatgcagagagggacacaggcacagtccaggcctgacaattctgtgtgtgtgaagtagaaatgacccctgccccccaacacccagggaccatgtggaatcactcacggtataaggtgaaggtgaaacgtccagttactcctccagtcccatcacctcgctttatgatgtgtaaagtgtaggatcctgtgtcttcctgggtgacattctggatcagcagggatgcattggaatatactgtttctcatccactgtatgcaggcccatatttaattatttgaccgtctactatatatgatgtaacataatggtagaggtccctgatttgtcctttgtaccagatgtggccagtaagattctggggcaaattgtggacaagtagaagaacatccttcccctcggaaacttttggtggctgggcttcaatcgtgacttgggctgtggtgggcgggttccagaagtttaaaagtgatgctaggaggtggagagagcatcagtcaatattgagacctatgtgttgggttgaaaagatgggcccctgggtcctgagaaggtctcttcaatcctcagccttgaagacacacacacacacacacacacacacacacacacacacacaaacacacacacacacatataaaaggggcatgtgtgtttctgtgtgtgtcctactgtcctactaggtcaaggtcagcagcatgacccccattccttcaacactcctgactttggcatttttctgtttggaatcctcttccccaggggtccgcacggccccctccacactgccctcaggttctgctcacatcagggcatccttagacttctttcctgacacctccttcagagaacctgggtctttcctttttgacctttccctgctctgctccctccagggttcttgtcaacacctgatctcacattctagatctctttgcatgtctgtcttcctccccatgacagcatgagctccgtgaggacagggacttttgtgatcttggtcgcaccccagtgcctggaacaggctgcagactcctgtagatgtgagagttctcaggggcctccatgccctgggtgttttttttcctcccaattgttgaggttttttgctgaggacagtgtttcatgccctgcttatatttttatttcaagtgtcatctgatatagttattattttcatttttcaaaatgtggtgacccctgaggattaatcagaaaaacagaacacttaagattttcctacctcttaccaattccggttcaatgtgactttcctattttgacccctgtccctctctggtgtattttcccctatccaggctccaacagagccttctttccttttttttcttttttcctttttttcttttgggacggagtctcatactgtcacccaggctggcatgcagtggtgctatctcggctagctgcaacttctgcctcccgggttcatgtgattctcctgcctcagcctcctgagtagctaggattacaggagcacaccaccatacctggttaattttttgtatttttagtacagacagggctacattgtgttggccagactgatcttgaactcctgatctcttgatccacccacctcagcctcccaaagtgctggcttcttttattttttagaaccccatcctctctaggagaccccatccagtcactctgcttccttttcctgtcctctcccaggaagttctctcctcacctgtgagcaggagccctttccaggttatatgctgtgtgcagggaggggctgagaggggccccatggtctctgctccctgcgtgttctcctctgtggagatgagcctaggatccagaatcttcctgagcacggctgtcagctgtgctgtccttcctccttctgcactgagcctcttcccggggcaggagcacttctcaagctcatgggtggggtcaggcccaggacacctctctgtcccctcctctctcagttctgcctccttgtccctccttctgtttttccttttgtctgtgtttcaggtccctgggaattgtggagccctctgcctttttcagcagtgattctttcaccaaacctcaacacacactttgtgcagacacacacacacacacacacacatacacacacacacacacacacagaagagacacacacagacccacagagtcacacacataccctgcaggttgggcaagcgcagtcctgggcctcagcctcctgctctccgcatggctctggttaggggtgcacattcacgccctttggcctctttcatccccatctggctctcccctgcagtgcaggaggctgaagctgcaccaggtccctgtcacagtgatgccccattgtgctgtgtgtgaactgtgtgtttcctggtgagagggacccttcctttctctaatcgtatctagcttggctgcagcttccaaggatggacgttcaggacctgggtgtcccagaggaaactgtccttcctagaggtgtgcagggtgaatctctcatgcctcttgggaggagaggcctgtgctgattgctcagtgggggctgtaagtcccatagtcaaagagagagttctcggtcactctttggctccctggggtctggcggctgagctggagctcaggatttctcgtgttcttcctgaccatctttgatgtcctctcttatgtgcccagctgattgtcctgtggtcaccacaccttccctgtggtggtgcaggtggcagtgaagagttacccaggaaacccgcgggacatggctcgttgagacacaggagggggagcctgggacagagcaggggttcagagctggagagattcatcctgacttactccgtggccatgatgggctcagccctccatgtgccgacatacccaggggtctgtcctgagggttttgacctggccaagctgctgtgtgtagaggaggaacaggcagtggccagagatcctgtctgcagggacgttgctcacgcctgagatggtgggtgggggtgggttgtgttctgtgtgcaaagagcaataacacccccctttccccgcaagcacacaggagaggactgtcttcccaagggacagctgggggtaggtggccacatcccagatggtgcctgtgtgtgaccatcacacacgatctaagccaccaggggttcagcgggcaggcaggtcacagggtgcctggctgattcccggggaggctgtgggcccttaggcagccgctgatctgtgtcagctctaggcttcacctgcgaagccccagagaacaggacagatggagcaggggtgggcatttagggagcagtgacagaaagagttgatgaggatggagggagttcacgaggggaaagcgcccagtgtggcgttgcgtgcaccagagctgccctgggagatgcctttagctgggcccagggaaggagcaggtgtgcggggaggagctacctgcagggggagtggtgttaggttggtggctgccaggtcagggaggagctgacagagtccatgtggggaacatggagggcgcgctgaggacttgagccgaagtgaccccggtgagggtggaccctgctgggctgtgggttccgctgagggaggttggcatcccctgggaaggctccaggctgggagggactctgtcaccctctgttggacagggagggaagtgtgaacggcagcaatcccaggccaggctgcatgttttattccatgtggatctgcacacttcacacgagatcacacatatgttatgttacagctccttcaccttccagccccgtgagtcccagtctctgtggctctacgttcactgttctccctctttcacaatcagatgtcccaaacgcagatttttgtcaccttctgtgagtttgtgtttgtgtgcagtaggcggcactgtgtataccctgggggcagtgatgtctggggctgagcagtgcacgtgggcttgggagcagaagagggagcagcagggtgggaagatcaacgtcaggggggcagggacaagtcattttcattttctcactcccagggaccagaacccaggattctgactccagggcagagtaccacaccctgcttgtgtccctggatatcatgatgctcatagtgtcatgttgccttggcattcactttttaaggtgtaagtttattggcctcaaatcagaggcagggcttgtacaccatggccgttttcaatactgtgtctggttcaagtggctccagttggtgtccagagataaaatcttagaggcatctctcctgcttggtgtgctgggttcccctctctccagctgctttctttaaactgataattctgacatttgccctcacatttaaagtgaccatctctcagtcacagcttgagctcttggtcccagtgtttgctgcttgctttgaacacatccattaaagctccctgcctgaaacctgtcagataacaccctggacctaataaagccattggcttaccggtctcttctctcctccctgcctgggctcactgaacactgtgtctgtggcctccaggtgcgccgagtgctccctagtgtctgtaagtagtaaaaatacttatattttcacgttctggttgtatcattgtagcctcacatgccatccagggcctgatattgaggctgccctatgggacctgtgctggttgagcccctgctggagctcttgttttgggacctctggttctcttggggacaggagcttccagctaacttgattgaaaacctgatgtctttcattgaaacactgggtcagatgatgtattcatgggcttcagctgccataacaaacaccttagcctgggtgaattaaataatagaaatctgtttttcacagttctgtgaataatgtgctattctaaccactttaaaatgcacaatcaggtgaaattaaccacatacacagtgttaaattaccctcaccactatttttcctagaaaattgttatcattttaaactgaaactttgtatcttttaaacaataactccctgtatgttccaccctaggccttgatcacctctactctgtctctatgaatttgcctattcttgatgtttcatataaatggaattatacaattatgttattttgtttctgacatatttcacttagcataatgtttcccaagtctatgcatgttccagtgggtgtcagagcttccttcctctttatggcagattatcattctgttgtatgtgtcaccatatttgtttattcatgtgttgatgaacacttggattgttttcatattttatcttttgtgaataatgctgcaatgaacattcccatgcaagtacctgtttgagtccctggatttaattctttgggtacatacttaggaatggatgttgtttcaaatgagaattctatgattagctttttgaggaacagcaaagctttttctcttagcggctgtaccttttcatattctcaccagcaacgtatgaggattccaaattctacataatgctgctacttgttatttaacattttaaaagaatggtagccagttttgtaggtgtgatgtggtgtctcattgcagctttgactttgtattttcctaatgactaatgatgttgagtatcttttcatgtccttcttgactcttggtatatcttctttgaagaaatgtctatatgagtcttttgcccatttataaattggatgctttctccttttgttattgagttgtagctagttttttatattatctggacatgaaacctgtctatatgtggtttgcaaatattttctctcatctgtgtatattaattattttcttgataatttcctttgatgcacaaaaagctcacatcttgataaagcccaatttatcttgtttttcttgtttctcatgctttcgtatcatatctaggaatccactggatacttgaggtcatcaatatttacctctatgtctattttaagatgtttttatggttatatatctgatatttaactcactgatcaattttttacggaattgtttgataaggtgagaggtagggttatctaaattcactgttttgcatgtggttatctagtggtttctgcactatgatttgaaaggagaattgttcctccattaaactgtcttgacaccctcttcaaagtgtaattggccataagtgtgagggtttatttctagactctcaattctatcccatttgtctttatgtctattcttttgccagcaacttgtgttttaataattgtactcctttgtgagatttcaaataagaaagttcaagtcctacaatttattttggcaagattcttttggctattcaggggtacttttttgagaggtgggtaggccaatgtttcacaattgggaaagccttttctgtcttcttcagggggaaatttgggagaacctttaagaaactttacctaagcaggtaaactgtcaccactttatttgctgaagtgctatgttaaagtgtgcattgcctcttgtggaagaattatgagaccctggaagcacctgcccaggtggtgagagacagtgaattccatgatgaggggcagagaggacattgttttgggatacagtgttgttgggggagttgtacacatctcaacttctttatgtctctgtacagtgggtgtagggagcagctccatagggtcagtgggtttttctccctgtgtgcagagacgtgagattgtagaaataaagacgcaagacaaaaagataaaagacagctgagcctgggggaccactaccaccaagatgcagagataggtagtggccccgaatgccaggctgtgctgatatttattggaaagaagacaaaggggcaggataagcagtgtgagccatctccaatgataggtaaggtcacatgggtcatgtgtccactggacagggggcccttccctgcctggcagctgaagcagagaaagagagaagaaagagagagagagcttacaccattatttctgcttattagagacttttagtactttcactaatttgctactgctaactaaacagcagagccagttgtacaggatggactatgaaggcggactaggagtgtgaccacttaagcacagcaccatagggagacggttaggcctcttgataactgcgggtcgacctgactaatgtcaagctctccacaagaggtgaaggagtagagtcttctctcaactccctcggggaaagggagactcccattcctggtcggttaagtagcaggtgtttttccttgacactgagacaatcactacttcatggttcgcctggcaacctgcatcttcccagacgctggtgttaccgctacacgaaagatccctctagtggccctgtctgggcataacagaaggctcgcactcttgtcttctggtcacttctcactatgtctccccagctcctatctctgtatagcctggcttttcctaggttatgattatagagcgaggattattataaattggaacaaagagaaattgctgccaactaatgattaatgatattcgtatataatcatatctaagatctatatctggtataactattcttcttttatattctatgataatggagcagctcgtgccctcagtctcttgcctcagcaccttggtggcttggtgcccagaagtgggcatctccgttggacacagtaggttttaaaatccttgtttatcctctggtgtctgggtcttggcttagctgttcgctgcagctgaaagaggtgtctgctaaggcaatgacacctgtggggaggagaagggttcagcagagtgaaagtagctggggctcagagaagacaggaaagtctgactctttgaaactgtgggtcagctgatgggtgtcctcaggggtacatgggccatgccagtagccactgcagtggactggaagaaggtaagggatgccgggtatcccatgttctctctcagctctgcagctgaagatttcggccctgggctggtacggccctgcagcaggggaagggtacacaggaatggctgcatatcaggaccaagtccatgtcatcttctcaggcattgttactgcagatggaggattgtgttcagagacctggcctggacacatgggagggcccaccccattctattaaaattattttaagagaacagtattagcaaatgtggtacatgttttattctgctagaatcagtcttgctgtcatattttacaatgtatctcttaggaaatggtgagagtcatccacacaatgtggatttaaaggggactctactataatttcagctttcctactctttatagaaaccatcttctctgcaaacacacaggaaatatctctgttcatttctattgggagccctgtatgtgaggtgaggtggagagtgccacatttcccttgagatgttatgtaaaagtttgaggttgagatgacatatctgacactctgttgttaccctcagaagctactacatgtgaaattctaatgactgcattatcctgccaagtgaaagaggcaggcacaagcaaggacagctaagaggggtgagagcctcatcatgatggggagtcttattctgacatcttgggaaaaactgtccacgtgtgaagtcatcaacttgttttccttgtttacagtttgagcagctgttgttatggtgttgaacattttggtgagttctgagtggctcagacatcaggtacaaggattttcccatgaaatttacattgagttgtccaactctggcttatagggcttctggaacagagtgggtcttgctctttgaggttccatgggagaagatggaattggaggaactagtagaattcagggtaatgtccagtctacaggtggataataaaaacacagaaacaatgaacagagctgcaatctcataacaggtgtactacagtattattttccacataatttttctctctatgggcatctctagttttaccaatgataatttcagtagaatatgtttgtttgcaaaataggttgagtttcttcaaacttggtctgattgtttacataagcgcagcaagagtagcaatggaccatgtaggctctcttttaaagttttctttgctctaagtttttttaaggaatctgagattaaattttacaaacctcttgagaataggaagccaaaccaaggctgatttcagactttgcctgcagttcatactggttcattctatctatattcttaatataacatcccagtcaaagccttggtaatataaccaatgatttcaaatgtgtcctgttaaaaagagagaagattgttactgtacttgtgtaaatatctgtattaccataaacatgtcaacactcaggaatagttgcccaattctggggcagtcaggtagagagcaaaagtaaatatttgaattattgttcccagaagtatagtttattgaactgctgtgagctatagatagattaaagaaaaaaaattccataaatctagaaaacaaaccatttaaagaatcagcaaattttcaaataaaaatcataaaaacattatcctcattattatcaattctttcaatgaaatcaatgtttttcctgcttggtctaggctgagaattttatgaagatatcagcctgtttcttaaagttttggaagttcttagacagtccggtggtataatgtgaaaattatcagaaacttgtattagagagtacttgtcagcatcttttccataaatctccttgaaaaggaagcaattttggactgtagctgattggaaatgctttgaggaagaacaaaaacaacatctgtgaatgacaaagattttgaatgactatggttaaaactctgatgagaattcattatgataacacagctcacataaaaagttagttacttctgtggtacatgacattatggctgataacatatttaatttctaggaatctactttttccttcggggattacattaattttgtgggagggttgctggtagatgattagccaactatattcttgcagtttttttctatctcaatgtgtttctaggttagtgatcagtcttctgtcaatttcatcctgaccatgctgcactcagatatttttgaaggctttatgatgtgagaaaggctgactgctattttctgtgtcattagaactttgtacccttttatggttgcatctttttctcagtgtgtcagttgtggtaggcatgaataagactctgtcaggtctccatggcagcttgtgtttctcaagaggattactgagttcttggtggagcacattaatgaataggaccgagaaagtataggcttatgtatgttgaaaaatgtccctaggtaattccagcactcccagctaataattgattaattaataatcaattgacttgattgacagaaggcccaaatcagtgcattccagactgacaacctactttgcatagggtcctcactttcctgaagctcccagcagggatatgaaagcaagcccagttctatgagactctgttttattctcctgggtgactggtgggaagactccccatcagtcttcccatgctctctttgaactgtagctaaatcttctgtctctttctccttcgcaggaatcagatttgcatagtggtcccaaagctccccagatttttaagcctgccccaccttccctcacagacatttttcctaatacattatcctgcatgtctaatctcatcttggatgcatctcagtgggcataaactaacataccaggcttgatttttttgcacttagcttttttctgtctctcccacatgtagccagtaaccatgtcctagtgttttatgtgttacctcttttttcatgtttatagggaaaaaatatgtttccatatacttatttatatgtaatatatataataaaatgtgtaatataaaatgtataataatgtaaaacatatacacattttccatatatgtatatggaaaaagaggtaacacataaaacaccaggacatttacgtataataaaattgacataagttatatatgtatgtagtgtctggtagtcttaccctctttataaatacacactttctatcactgccccttccttccttcccatgtagagctcccatggccaaatctccctatttctccaagtttgtgtcactcactgtcctctgtgctgtgtcccatgtgctgtgtccgcagcctcctagtgttttatgtgttctctgtttctatatatatatggaaaaagcatatacatatttctctgtgtatatttatatacaatatataataatataaaaatatagaatatataacaatttaagatatatacatatttccatatctatgaaaaaaggtaacacataaacactaggccatttatatataaaattctcatatgtaatataaatgccaattttatcatatataaataagtatatacactatagatttatcatatataaggtgaatttggaatgccctgacctgggccctctgtcagtcaagtccttgccatggaggccattcatggctgccacaactgagacaccgagagaaagatgcaactatgaaaaggtgaaaagttctaaagtcatagaaaacagcaatcagcctttctcatatcccaaaattttcaaaaatatctgagtgcagcatgtccaagatggaattaaaaacttcaatcttgaaaaggaaaaaggaagctggaggattcacactttcagatttcagcatctactgcaaagctacagtaatcaatacagtgtggtactggcataaaggaggacatagaaatgaatgacatggaatagagaacccagaaaaaaagcttgcatatatggccaaatgatttttgtcaagagtgccaagaccattccatggggaaaggacagtctttttaacaagtgatactgggaaagctggctatccatggacaagtatgagttgaacctttacctcacaccatatacaaaaaatgaacccacaatggatcaaagacctaaatggaatagtgaagactaccagactcttagaagaaaacataaggaaaaagcttcatgatattgaatttcagaatgatttattagttataactacaaaagcataggcaacaaaaagggataaattggacttcatgaaaattaaaaacttttatgtatgaaaggccattatcaagaatgtaaaaaggcaaactatgacatagggaaaatatctgaaaatcatatatctgataagggattaatttccagaatacatgaagaacactacaaatcaaaaacagcaaaaatacaaaagcccaattaaaaaatggacaaaggactgaaagagagattttattaaagaagatatacaaatggccaatgaggacatgcaaggattctcaatattactaatatttagagatttgcaaagcaaaaccacggtgatacatgacctcacacacattaggatggctttgataaaaacaacatgaacaacatcacaaaacaagtgttttcaagtatgcagaaaaaatgaagctctttgtgtattgctgatgggaatgggaagtgttatagccactgtggaaaaaatggcatggcacggccggctcatgcctgtaatcccagcactttgggagctgagatgggtggatctcttgaggtcaggagtttgagaacagcccggcaagcatggtgaaaccccatctctactaaaaatacaaaaattagctgggtatggtggcatgcgcctgtaatcccagctactcaggacgctgaggcatgagaatcacttgaaccttggaggtggaggttgcagcgagccacgattgcaccattgcactccagtctgggtgacagaggaagacccggtctcaacatcaacaacagaaaagaaaatggtatgtcagtttcttaaataaattaaagcattaccacttgaaccagcaattctacttctggacatacagccaaaagtattgaaaaatatttaaacaggtatttgtacaccgatgttcacagcagcatcactcacaatagccaatgggtggaaacaaccaaaaagtctattgaaagataagtggatgaacaaaaagcaatatccatactttggaatgttcttcaatcttagcaaggtataaaattctgacacatggtgcaaaatggatgaaccatgaagacattatgcaaagtgaaataagccagacacaaaagcataattattatatacttccatttatgtaagatagttagaatagtcagttacttagagacagaaattagaatggtgattaccaggggttaaggggaggaggaatgagagttatcatttattgggttcagaggtttagtatagtaggataaaaaaagctctggaaatagatagtgttgatagtaacacaacactaaattgcacgcttagaaacagttaatagtaaatcttagatgtatagtgtctggtactcttaccttctctataaatacacactttttgtcgctgttcctcccctgccatagggagcttctgtgagttaatctccctatttctccaagtgtccatcactcactgtcctctgtgctgtgttccaggagctgtgtccacagactcagacaggcagtgacttcagagccaggacacagtcctattcccattttttaaagccttacccatgggaggcttggcttctactggccactcgatttagccagattcagaacaggccaccgaggcaccttatccacatgccctggccccagcccgggtggagtcagggcaggggcagtcactgggtgagcccacagcaatgcagggagcagtgtccgagctgcttctccctcacccaaggggcttcctcctctcatttggggaaaagtgtgggcttgttttgaagcctctgatgttcattgcagctcatggtgtacacacacacagacacacacacaaaggagacagaagggatgttttggtgacagaaacagcttgaccatgaggaccctcctctttctccctctgtgaaggcccttatactgcatagtgcttggggctgataaagccatttccctacatttctcaggctggacccaaggtcatccaccagaaatccggaaaacaaagggaagagaatctgtagatatgaattgggagtgttcaggagaaaaatttgggatttacttttgtgcatgggacacaggctgagaataaaaatgttttcctggctctttcttggaaagccagataggcttcacctgaaagcatattgccaatgctccagtgatccacttacaagggactctgattttcttggttgcgaagtttttgccattagtgactgggttatggacataacacagatagtccccactattttcagtagtgacttgggggataaagagctcttgtcctatttgttggttattcccattcagcagccaagaatactctgctgatggattagagcccgtgaggcaggagaggttgaggtttgaccctggatagtaacaggtgtctgaagaataagttgtgggttcatctgggccatctggagcaaagagaataaagccacaggtaatgttatcagagggaatgggaagctcctggtctgtgaaaggggcatagtgttcctttttgccaagtcacaaccccgaagtcccagccaaaacttcctctgtgttcactgaactggaggagtcaacgacattcacctgtttctcccatcgcaagctatggaaccagagtcccctaagaccggagaagcccctcccttcctgggcctacccaggtttgcctgggacaggaagtcatggccagcttgggggtccaggggtaagtgtcttcatacttggacctgagagggactgagaggcctggcctcatgttatgtggatttgggctggcagccttgtccatgaaggaaaagaggatactcacagagaacatccaggagactgggtcactgtggctggtgctcactatattcttcctttgacgttcatagagtcctttgtcactccttgtgacactgagtagagcaaggatcctgttatcattggacatctttagcctgggactgagtgtgagtctatgactatttacccaccacatgtagattgtgccatgagtctcaggttcacaggttaagaccacagcctcctcatcctctgcggagttgctggtgacatagggcttgggcagattggctgtgcagataacagagaagattcccctgtgtggcatcattgatttctccatgagcgttttccaataagagttgacatctcccacctctcagccaatccaagtccttaaaagcccacagcaggtctgtgtgtcaaaagacagatggatgcatgatgatctgagggctcagaggccatggggccacctgctctgtgtgcaagatgcacagacttctgaagtgtggatcgagcagcaatattggtgaagtgtgaattgagcagggtcaaacaattagagtttgattaactttgtttaaattgagaagagtccaagtgaggcagcagtggctcatgcatctccccaactgaaggaccccaccttataacactgttgttattatgaatacacaggtgtgaatgaaacaggcagtaaatcagacagcacccacctggccagctccacctggtcctaagaaccaccagtattcccattatgtgtatgttacagctttttaggctacaaaatataaaatacaatcacagaatataaaatatgctactgtcaatacaaaacattgaatatgaagctgaatatgttgttccactttttctcactcttgttaaactttgctgtttcagttttggaagtttctattgacacacacttaagctagagattctttcctcagctgtgtgcagcctacgagtaagcccatggagggcattctttatttctcttaaagtgtttttaatctctagcatttcttttgcttctttcttagaatagccatctctgtttaaatcacccatctattcctgaaaggtgtctccttttaaaatcataatccttaaccagagttgttttaaatttccagtctgataatttcaacatccttaccacatctgtgtctggttccaatccttgctctgtctttcaaactgcatttttttttttttgccatagtctgtcttgtatttttttgaaaaccacacatgatgtactgggtaaaagggacttgagtgggcaggcattcagtgacacggtggtgagtgtggggagggaagggttctgtggttctggatgaggtctgtgtcctgggctgtgaatgtcacaagtgcccctcaggtttttctttccattaggtgggatatgatgacttgaggaggctggagttggatacttcccctccctctggccagttaagctcctatcaaaccgcagctaattaggctgcagtgaaatagtttctcttaaatgtaggtcttaccaagaagaatataaatcactgacaactttccaagtgtttttttcccttcttccaagaagaaggatgtggattcttttttgatattgactgtgagaacctggtagagctccaggagctaaaagtcataaaactgtccccctactcccaagactaatccatcctctggtttgtttatctctgcgctgtgtccacactgagcctccagaatttcctgaattacagttcaggttttctgaaccccagcactggttcccgctggggtttctgtgcctgtgtttctgctcaggtacggtgcgctgctctgtatttgcctgtgggtctctccaatatgtgggccagttagcactgagaccttgcttcctgagaaatctaaacgagttgttgatttttcagtttgttcagctttttacttgttgttagaactgagtgaaaatttttaagctacttacatgcctgatggaaattcgaagtctctagggcatgacaggaggatatgagccccacagcaggttgaggatggagtcatgagtgaaatgggtgaaatgagcccacgggctttggaaactgcagatctgtccttctgcctctgaccccctggtgagtccatgtagaaagtgaaaccacctttgcaaagcatatgatggtgagaggaagctagcttggctgaccgcatctcacctctagcctcaaacttgctctctttgattcctgggcataggccagggtaagcatgggaggaatttatagtttaactttgaagcaaggatgataatagtccctccctaaaattagctcctccttgtcgggggctaccttggtaaatctaagaaaaaagattgaatggtctcatgattcagcaggttgtagagtaagcatcattctggcatctgctcagctttcgaagaggcctcagaaacttgcaatcacggagtaagccagtggtggaggaagacatcttatataatgggagctggaggaagagagcaagggttgcacactggtaaacaaacaggtaaaaactcacttttgctacaacagcaccaagaagaatggtcttaaagtatgagaaaccacctccattatccaatcacattcaaccaggctccacctccaactttggagattacaatttgacatgagatttgggtgggggtaaaggtccaaaaaattattattatttccatggtccctcccaaatctcacatctttctcacatttaataatatgaggatggcttcccaacagtctctagagtcttaactcattcagcattaactcaaaagcccaaaatagcaagtttcatctgagacaaagcaagttccttttacctatgagcctgtaaattcaaaaacaagttagttactttcaagacacaatggaggtataggcattgggtaaatactcccattccaaagggaagaattaggctgaaggaaataggatacaggccccatgaaagtctgaaagcttgcagcacagtctttaaaatttaaagctccaaaataatctcctttgaccccatatctcatattcagggcacactgatgtaaggcttaggcttccaaggttctgggaatcacagaaacattccaagagagtgaaaaaagaatttgtagtgtggcttttgatgctaaacagcgtattagactgagtaagtcactgaagagaaaaaagtcagaggagaagatgggtgagggtgacagaaatggaatggtgaaaggaaaggtctgataaaaatgtttaccggctggacatggtggctcacacctgtaatcccagcactttgggaggctgaggtgggcagatcatgaggtcaggagtttgagaccagcctgaccaatatggtgaaaccccatctctactaaaaatacaaaaattagccgggcgtggtggcatgcacctgtaatcccagctactcaggaggctgaaggcaggagaatcacttgaacttgggatgcggaggtagcagtgacctgagaacgcagcattgcactccagcctgggtgacagagtgagactccatctcaaaaaaaaaaaaaaaagtttacccaagggctcatctggtacctggctctgtgactaatgtcttacacattttgatttactcttccactttcattttctgatgcacaaagggtcacccttctgctgaagatgagaaaagaggatgagggagctcaaatgagtggtctagagtcatccagctacttcatagagcttgtgtgtttcaccttgatgtttgtgcacagacagaaaagtgagacacagaaggaaggcaaagcaagtttatgctgttggtgacacttatgaaagttacctgtgttggcagaataatggactcctaaaatgtttgcaccctagctccagaacctgtgcatttacttttcttggtaaaaacacagtgcaggggtgataaaattaaaatcttaagatgtggacgttgttctagattatctgggtgggcccattgtaatcagaagtgtccttgtaagtgacaaagaaaagcaggggcatccatgtgagaatgatgagcctgtgaaactccactggccaatgctgggtgtgagcatgcatcaaaagacaaaattacaactaatgtagttatagattttatttttcatttattatttgaggcagctctcactctacaaatatagtgacagccctccctgggctatacaataacaaaacagtgggttttgtcaagtgggaactggtaaacaaagccatataaataaataaattggtgaacttcaggtctcttttctgtaaaagttaaagcagaggaaacttttattctgctgtctcaggtagagtggaacctcctgttttcaacaaaaaacaaaagtctgttctggtatctctttgcttcattaaaatttcagttgtagactgtagcatttagcatgagtggttctattttggagtctctaggctctcacttaggtgagagtgtgaccaaaatttaaagcattggcattcatctcagtaaccatcatattgggcttccatcatttataggtttatgatgtcttcctgatcacacatttctttgagtttttgtcatttcagccaaagagagaccctttggtatttgttgatggctgcacacaaaactttttaaaaacttttgtagaattcaccacaccaaaatgtagaatttaaaaacctatagaatttatcacaccagagaggctactaatatgactattaggaggataacaccaaaagtttggagtatgcactttaggcaagatgcaaaccaactaaaatagaataggtcaaagaatgagccagaattgtctagcaattttaaccaagtagtatgtttggtaacttctgtgattgagtcattattatactcgatatatttgtttatgtgcaacagtcagtgtcagaaactgcacaggctcctccctctttagctggtagggaacaattttattatgtagcattcaatggctcattaaattaaaacagggagtgagaacaagtgagtctgaaaatgtaactttaaaagggaccactgtacatttgaagaaacaattgtgttaaaaatgctgctaatgtcagccattgggtggactaaatgatatcttatgtaaaaatttgagggtgacatgatatatctgtcactctgttacgctactctcagaagctacttcacgtgagattctaatgataccatcatcctgccaagtgaaagaggcaggcataagcatggacaaattaagaggggtaagagcctgattttgatgtgaagacttgttctggcaacttaggaaaagcttttcacagtgtgaagttgtcaacttcttatcctggttttaagtttgagtgtctgtagttatggtgtcaaacatattggtgagctccgagtgactcatacttcaggcacgagggttttcctgtgaaatttacattgagctttccacctccagcttataggacttcagtaacagagcagattttgttcttactgattcaataagaaaaaactggatgggaggaactagaagaattcagggtctagtccagtctaccggtgaataataaaaactcgaaaacaatgaacagagctgcaatttcatagcaggtatactacactttttattttcaacattatttttctctctataggcatatctatttttaccaaagacaatcccagtaggacaaatttgtttacaaagtaggtttagtcttatgaaactttgccgggattctttacataagtgcatcaagagtagcaatggaccacagaggctcttcctaaagtttggttcgctagaaatttttataagtagtctcagattaagcttttacaaacctcttgagatgaggaagccaaatgaaagccatcttcagactttgcctgcagtacttatgggtccattctatgtatattctcaaatataacatcttagtcaaagccttggtaatataaccaatgttttgaaatgtgtccttttgtaaagagagaagattcttactagtgcaaataactgtatcatcataatcatatgaatactcatgaatagtttcccaatcctgggacagttaggtaaagagcaaaaatcaatgggcttcaattattgtttccaaaagtatactttgccaaattgctttagatatagctagcttaaaagaagaaaaattacataaatctggaaaaaatcatttaatgaatcagcaaattttcaaataaaaattataaaaacattatccacattatttatttcaatgaaattatttttgttctgcttggtctaggttggcatatttcatgaaggcatcatcctgtttgttaaagttttggaagtctatagacggtccagtgatataatcttgaactgctcagaaacttgtatgcaagagtacttgtcagtatcttttccataaatcttttgaaatagaagcaattttggactgtaggtgattgcagatgctttcaggaagaatcaaaacaactatctgtgaatgaccaacatgtaaaatgactattgctaaaactctgataagagtttggtataagaaagggagtaactccagccagtactccagtcatgacgctgacaggggccccaactgagagaccaaaagaactttcttatcctgaagcagctgtcatggaaaaaaaaagaggagaaggaataaataataaagacagcaaggattttagccaattaatttttgagatagggtctcactctgttgcctaggctggagtgcagtggcacaatctcagctcactgcaacctgtgcctcccaggctcaagccgtcctcccacctcgctctcctgagtagctgggactacaggcacacaccaccatgcatgcttaatgtttgtattttttgtagagatgggcttttaccatgttgttgaggcttgttttgaactcctggactcaagttatccacccgccttggcttcccaaagtgcagggattacaggtgtgagccaccgctcttgctgctttcatgctttttataataagaatgaactccttatgtaataataaataaataaatgaaattatttgctttggatgtagcaaatgtagacttagattgtccagagtcaggagctaagcctcatttttttttgttttagctcagtgtagagtgcattgaaggtgtcctaaaaataattccatatagtaagccaattttaaaccctgctcacagctaaatctgccaagtatgagccaggtaaaattaccaaaaaaggtggttctgactgattccttaacaataacgtggcttacaaacaaagactgatatgaaatagttgatccaacccaaacactttgctcatttcccaaaattttctatacaaacatatacaacttaccacaacataaagatcataatgaaaagtttgccttttattcctttaaatgaccatatgtttagatctgatgtactgacagcaataattctcctttaagcggaaaactaataaaatttgaaaaatagtgattttatatttagatgatactcagatcttctgctacgtatgtggaaaatggaattattgctagaaacattgtttaaagattagggtatgaaaggagtattaggaagtcaggaggttctttctttaggaagcagcttatctggattcattcaaagagctttaggttagtttgaggtctttctgcaaaatgtaaattgctatatgagaaactatatatagtccaatgatgaaagaatgcaaagccttagaagcacaggcgacaattccagtatcttccctaaagttctgacaaaaaggaaaataactatcaaattcttcaactcgaatgcttattatgtatgtataagtcagttgtcagatgaagagaggctggaaatatgacttctacccctagggaactcacagtcttgtgggggccactaggggtggtggtgtgacctgcctggagcagggctaagtatggacttgtgagtcaagggctatcaaaacctaagtaaactgattgctgttcagagaaggtagagttccatttcacagtttgcaagaaggactatttcatggaggaggtcacgttggactagacctttaaaagttggtagaatttaaaagcaaggatatggaagcaggaagagtgaaagtgagcagaggtacagaagtgaggcaagggtgagcagttttaattttttaatggtggtattataaaacacacatcaaaatttgccatattattattattattttggagacagtgtctggctctgttgcccaggctggagtgcagtagctcaatcatggcttactgtagcctccacctcctgggctcaagcaatcctcgtacatcatccccctgagtagctgggaccacaagcatataccaccatgcccagctaatttttatatttttgggagtgacaaggtcttcctatgttgcccaggctggtcttgaactcctggactcaaatgatcctcctgccttagccccaaagtgctgggactacaggtatgagccactgcacctgaccccatcttaaaaatttttaagtgcacagttcagaaatacatttgcattgtgcaaccatcagcgccacccatcttcagagaatatttttcatcttgtaacagggaaaattcatatccatgaaacactaactcctcattcttcctcctccccaccccaggtaaccactattccagtgtctctatgattttgactgctctagggacttatataaatgagatcatacactgtgtatctttttgtgactggctgatttcacttagcataatgtcctcaaggttcatccatgttgtaacatatgtgagaatttttttccttttgaaggctgaataatatttcattgtatggatagaccacattttgtttatccattcatctatccatggacacttgggttgccttcactttttggctattgtaaataatgctgctataaacatggaggtaccaatatctgtttgggtctctgctttcaattattttgggtttatacccaggagtggaatggccaagtcatacagtacctctagttttagttttctgaggaaccaccataatgtttttcacagtggctgcaccattttaattcttatgaatagtgcacaggggttccaatttttccacagtctcattaaaacttattattttctggggtttttgctttgtgtttgagagtagccatttaaattggcataaggtataatttcactgtggtttatattttcatttccttaatgattagtgatattgatcaatattttctatgcttgctggccatttgtacatcttctttggagaaatgtttattcaggtcgtctgcctattttgttaaattgggttgattttttttttctgttgtttaggtagagaaggcaatccttgaataccagtgatgtttcactaatgctgggccattgatttcacaagaagttgtatgaggtattagaatgtgtgtttggtttcaatcatggctgaggttgaatgccttttccaaaattcagtgtgaagccacaaaggatccaggagcaagaacatggtgtgactgctctctgctaaagaatttcagcctgatgacagtgagcaggctacacatgagactgacacaagaacaggtggaaagggagaccttccactggaaaaaggtgattctaacatgcagaatcaccttcaaggagcaagtaagcagaaaaatagacaatggcacagtggccaggcaagaagacactaggtccagaatctgaggttcaaatcctggctctgtgagacaacaacatgccttggtttcctcatgctactgaaacaccaggggttggggctaggtcccattgcttgctgcacagaaagccaaccactgagacaatgaacattgccagggaagaaggctttatttggctgctgcagccaaggaggtgggagatcagtcttaaattcatctctccagccaactcaaattggatggtttatatagcttggaagggaagtaactacctgcagggaaaacagcaattaaggagggctaaggaagcaatcatgataaatgaggagtctggtgtctcattgtctgatggtgatgtggtgagtttcagtctcttgcctgaaggtccgtttcctaactcagatgactgacaaatgttaagtttcaagttttaagaccagatgggtcaatttctatgtttattcaaaaaccctgtaaatatcagttctatgtggaacttgagctggtttgcccccagttatcacagttagggttaaatgatgcaatataagtaaaacaccagcagtttctgacacacacacagagtgcatgacacaagtggtgtgttgggacaatatagctcagtgaactccctttgtctactcagttatattgagtgatgaggcatctctgaagatgccactttgctacttctcccctgataatttcaccagatccagccatatgagcactgcaagtggggacttagcttaaatcattcctcgtatttcctgtgcaggcaaatcatttggcaccaaaacaggcacagaagtccaagtcctgctgccagctccacgactgatgacacagacagactttgggattagtcctttaatctctgtcctctattaaatgaaggtcatcatgctgctgcctaatgtaaaaggattgtggggattttcatcattcattaccgattatcttattctttgaaaccccaagaaaactatacaaattccaaagtctaataggtacacaagggctttattatggatgatgaaatttcaaaggatgctaaaccaaaaaaaaattgtttttcttttttgagacagagtcttgctctgttgcccaggctggagtgcaatggtgcgctattggctcatggtaagatccaccattctcctgtctcagcctttggagtagctgggactacaggcacccaccaccacacccggctaatttttgttgtatttttagtagagacggggcttccccatgttagccaggatggtctcaatctcctgaccttgtgatcagcctgcctcggccactcaaagcactggcattacaggcatgaaccaccgcacccggccaaaaaaattttttttaatgcgctctcttttccatataatcccaaggttggtgaatcacctctaagtcaggagtttatcttagctgatactgccttagtgttggcacaacttaaatttagttaaactaatatttgcatgatctttgcacaacacataaacacccaggaacaggtggtgctcctcggtggtcaacaccaggatggctatggcagggcacattctttctctatagcccaggccactggcattcaaagaaatatttttcaatgtctgatttttctctggaagtaggaaaatgctttcctaactgctttacttataagggtgtttcttgctaattctgtgcccagagtaactaatggggacatagacatagacatcattcaaatggcattctctctttaccataacccatgctttaaaatgaaataaactgaacccatgccttaagacgacaatcaagaaatacattctgcctaaggaaaagtcctgcgttcaaaggtttttgtccaaataatctgacattgtggtcatgaaacattgaaaatagcatttggagcagtaagtataaaaatttagaaggagtaaaactacttgaatgcttgttgggaggtttacaatgtagtcaaacaccagttaagcaaaaataaaatttactacttaactatttacattttctaatgtgtggtttcatggaattgttgagataaaagtagatactgaaataggagtacttgaaagtaataagacagagatttttataaaatcatttctgacctgattaagaaaaatataatctctatcacatatgaaataaacacctttagaaaaatgcaatgtcaaagaaaacacttggaatggccaacaaatatctactacagatagaaatgaaaatatttatgttatgtaaatgtcgggtatcaaattgtctccgaagttgccttctagagaactttgtttagttggtatattcttcctatgaatcaaaggaatacagtgttacgatcataagtcatgagggacatgagacaattttaaggatttaggaaagtagggaagcagtgaggtgaagggtaggcagatacttcagagggtaaaaagtgtttttgattcaaaagaaaagctaaggtagtttgaagaaaacatgcatcatctactagttaatctggggtacaatgaaggtggtgttattttaacagtgttcagaaaagaccaattaattctgtggccatacagaaagaatggaaagattgcataaaacagattctgaggaatacaaatcaatatagcaaggaactttatgatgaaggacgaatgtgagcatagaatgcactgtttttttaattattattattagcagcatcattggtttggtgatgttacctacttttggagtggagctagatatgagagctgcatgtcccttgaactttatttggggtaaatagtgaaaacaatatctatgatgagttaatggctgcagcacaacaacatggcacatgtatacatatgcaacaaacctgcgtgttgtgctcatgtaccctagaacttaaagtataataaaaaaagaaagaaaaccatatctaaataaaaaagaaaacattccagaggtgcagaattcaagctagaagaattgtgtccttggatgtcccaaggtcaaattttaatatgtcattgaatgaaggttccaatgtttggaataatgaaaacagtcatattgaattttgtctttgctctcctccctccccagtgtctaccaaaaaggctgagtaaacattcatgcaagtcaatacactgtcacagccacaattcatcctagcagtctttcctggaatagtcacttaagacgtatctggtgaggacccactggcacttttagagcaatcagaaaatacctcaaattgctcacatctagtgtaggagaaggctaatccatccctgtttcatgaagcatcacttcaatatcctggaacagtcattctacccaaatcttctgtccctagagcccaagactctccgcatcttcatccattcttcacggggcttgatttccaagactctctaccatcttggccacacaccatgttacgcattcactatggacactgcaccactgcggatgctgcaccaagggttctgaatccaagggcagattgttatgaacagcccctttaaaagtcttaaacgtgatacactggtctgtcagcagatgtgcagagcctcttatgggagacacagtttttgactcatgtgattcaatgtccataaatctgcatccaaaagatgcccatagagacaaagagcagagtaaagtccttgcagcagtgtttctcaaacttagccacccaccagaactgcctggggaactttgaaagatacccatgctgaatcccacccaccaagattctgatgtaatgctatggggtgagatctggacatcaggatgtttggaatctccccaggctcatttaacgtgcaaccaagactgaagcccactgtcctcagcaatgtgcccagcccagccttcctgacatccccccatgggtacaggatgacagtttctcactctgaccctttcctttattcaatacagcacagcacaatccaacagggtgagcactgttatgacagagaacctggagtcggatctgattaaatgtcttcaacaaaaccagtgccaagccttggccattcagctatcaattactattttcaacccaggttctaaaggctcttcattagaaacttctcgggttgataatgattgggcaaatgtgccctttggatttgattgctaccatgattattaattaactgaattgtagagatatcgagtacctttctgcctcttgtttttaagaacccatgagagacaaggccaattgcagacaatgaggacgtcctcatgatagtgagatgaactgcctagctatcttccgatatcgttacttcccaccagttttgttgcttgcaaaacaacagaatcttctctccatgaaatcatggttatcagttaggaagtagcccacttggttctggatttcgtttagagatttaagatagtaacagagggtgcaggatgacaaacagaatttgtacactgtgtctggtagtggaaaatacccaacattgtactgtatgctgactctgtcatttcctgccttctctcctccttttctccctccctcactccctccctctctccctccctccttccttccctcatgaaagcatagcttgtttgccattctttcctccagtcaccagccatttacttatgcacatcaccatgctcatgccattaccaggggactttctatcagcatgaagacaagaaaatgcctggggcagaaagggtgtggggagcaggcagcacccctgcaactgcccggtagcatttatacattgctctcccaccttggtttctatccatagctttcctcgtcagagcatgttcactttaacatcctctagagcaatttcttggatccttcaagggctcaagaactaaacataagttcaaaagaaactgagtaggcacctaccttctggaaacaacatccatagaaaagacttgattgctatggtctgatttatgaacctgtggctcatatcaaggttagcatttgcactagcattaaggtattttcattgagataatttatgttttgaaagaaatactacaagatcaagaaactgtatcagttggagaatagaagtgtgtatgatttgtgtatataaatatgcacatcaaagcatttatttatttcagagagttgtataacaccatcagagtaaaaattgagtgattctcttctatttctgaccctacttccaatgtcttctctgtccctctgggcaaaaccatttaaaccttttatcttggtttcctttgtgagaaaatggggataatagatacccctgagccattctggagacatgtttggatgccagcccagttatatgattataggagaaaaaagctttgagcttttggcacttaggtgccacataaagattattagcaagctgctgaggttttatctttggaaactaataagcatttctcctctaaagcctcaaatctttagcccctggacacatgttcctgatagctctctctttacaaagatccccttggctccacaaggatacagatagtgctttgctgagagagtcactaccgcacattcagatgaaaggtattcattccgcttggcagagtcatggttagagtagctgctgatcccagcaaggcagggtgggtgatgggaagggattagattaggaagaaaagggatcctctcattctctcactgagaggactttaaacctgcagaagcacaacagtgagtggactacgtgtatgtgccaacgtgcaaagtcgatggtgcacacgttacaggttggctcgagacgatgccactcagacctgagtgcaccgtggaactctcttgaattctctctgcaaatgggttgccctggatgtatagagttattctacaggagtcctgctcctaactcatcagaaacgtaatgtcctctgttgatctcaaaggcattttcttctgttaaaagtattgtccattcagcaatatggagaaagatcatttgtgagaataaaatagaagtgtctgatggtagtggggggggtgtaatttcctccctatgtgagtagcattaagttcactcttaatttttttcttcatttctgtaattggagactgatttatcaagaggatatagaattcagtgactaattccattaaatgctgaaagaataaaataaaagtagaattcaaaaggcttactcctgattagttttcaagatgtgtctaggtacaggaagttaaaaataataccacagtgaatgctctgacccagtgctaacaaaagcttcctttttttggtgagacttggcatagaaaatcacacatgtcattcagtggtcctgaaaaatgatgactgagatttggactggttttccagggaataaaattgagtgactttttaaaaagttctactcctagaatctgggatctaatcaatccaatatcaacttcaagggaatagaccaacaaccagagatgaaattagaagaaaaataattagaatagcaagcataggctggttttccatgctatgattctgcagcaaatgtggtaatttgggaatactgatttgggggatctcttgtcatgggaataagttgtgttttgtcagctttgctgagtgtctccggtgagctaaaagtgattaaaacagagtgctggccctggtatgtaagctgtaatctatactccatatctaccactagccattttgaaggaggagagttccctgatccatctcacatgatgtgcaacaggcgtgtggctcgcccgcttggttgctcaaacccctgatgggagatggagcacacagatgggcaggtgcaggggctggagtgagtgctttgggctccagcctggcagtagtgtctggggagagggtgttcctgcagcccaagtctctttagtcttgctgtctgcaaatggcttaagtgttaaccggctcaatagaccctctgccttttcacaagggcagagggccagtgtgacagctttctgtattcccagcttttgcccagtgttctagaagaatcgggtcacacacacaggcttgaaggatgaatgtgggattttattgaatggtggaggtggctctcagcaggatggatggggagctggaagggggaatggagtgagaagatgatcttcccctggagtttggtcatccagcagccaaactcccctctgaccacccccagtttaactcctggcattcacacgttccttcccttctctctttctctgctgtgtcatctgttgtttgtctgcttgtctcctcatctcctcatctgcttctggagcctggggtttggggtttatatgggtacaggatagagggacatggcaggcaagaaggcaacttttcccacttagggccacgggtctccaggcttgagggtggggcctttgctggggaactaccttctttacccagtatttccctgtctcctgtccatatcaatttcatgaatgtgtggtcacaacatgaacccagaatttggaggttggaaagtaggagtgaatgcactcaatctaatagggtgccaattcgtagcatctaatttggtaatgatgaatgagtaatagaatcttttggtaggggcagacttggtgaatcttcaaatgtagcaggattttaaaatgaatcgaatactatctctcagtcaatacaattacctccaccactcctcagttcctaattcaagggttatattttcagtaactttatgtattcaaaactgtattagatgctggaaatacaaagatgagtcagacattattaatctctgtccctaaaacgatgaaaactagtgtggaagacagccaaaaaattagagattaatcttatctagaaaattctagaaacaggatgaagcacaacagaggagtattttaggcaacctcaaggcatttaacacaacctggagcctttagttaggttagaatatggccaggaaccggaagtcaagattcaacaaattgcaacactgcaataataactaacatcactttctaatagtgtttatagtgttttctaatatgaaatcaaaatctgtctttggataacttttactcactccctggtcttgtttctgttctctgggatgacacagaatatatggaattcactcttactctgcttagtactgagaaagcaaaaattaaataaggcattcaaaattcttgtctgtatatgggccaagggaaagcttccccttcaccctctgaaggtttgctgataaccaactgacaaaaggaagattcacaggagaaaaagcttaaatatttatttgatcacagttgtatatgacatgagagcctttagaatgaagacccaaagatacagaggaaaccgtccatttttatgcctaggttcaacaaagtatggacagccatgtagaaatagggttggattcttcttggcctctctgagcagtgcttcttccttctgggtgtgggaaaaattcaccatattccttaggtcccttcaaagtcccctctattcactctatttcaggaagggtgagaggaccaatgaataaccaactttctggaaagggggtcttaggatctacagtcaaacaaagtaggtcaggtcatttcttcttttgttttctcttttcaagaggcagggtctgattctgtcacccagggtgaagtgcagtggcctgatccatggttcaccacagcctcaaattcctggactcaagcaatctgccagtctcagcctctgaagtaggtatgactacaggtgtgtgccaacataccagactaatttttaaaaatttttgcagagatggagtcttgcagtattacccaggatggtcttaaactcctgggctcaagcaatcctcctgcctttgcctcccaaagtgttgaaattacagatttgagccaccacacccaacccagataatttctgtatggccagtttttacacagaaaggtagagggaaatttagagtccgatttttaggttttatggctttggggaaaaggggttctggtttctaggacccgtcatggggaagagggattctagtttctaaggtgcctccagggagaatgggactcagagacaggaaggcagaagaagctcagagagaaagttttgcttctgaggctctttcagaaggattccttgagctcaggagttccagaccagcctgggtaacatttcaagactccatctctgcaaaaaattttgaaaaaatagcctggtatgtggcatgaacctgcagtcctaactacttgagaggctgaggcgggaggattgcttgaggccaggagtttaaggtgtggtgaacttctgaggctttgattttggggtactgctttctgagccttagacctagaaccagtattcaggtcatgggggaagttcatataagaatctctattttttaactatcaaactgtgacttccacatgggccacttgggaatgctctcacccatagacctgtcatacacctttgttgggtagggacaggaaaagagattgagtagcataagataaagtcctcccgaccccacccatttcaataatgggatccgcatttatcatatgcagatctgagacccttcctgaacttcaggattcatacagtattagagagtggtctatacctttccccatgacctccagcccacacgaggttcagtgaccctaatgccacggaggccaggatgctgtgattaagatgagagcaggggtaagaagggtcttttctctgctcatggagcactggaaggaagtatctttttgggtgctggacagtggggaggtcaagactgtgggcagaggaacactggagccaatgttgggaataattctcatgcaagcaaagacgtggtgtttagctggtcacaaccccagaccttgagactccagttccacaggggtccaggatattgtttccatgtacaagatccatctgtgagaatccagtactttccaccacctgccgtggtatggctgtggtcccatgcaccatcaccttgcgcttcaacttctgcaatgaccccctaattgataacctggctcttgacttgaccttacagcaaacattctttttgaagaaaagtcacagagcttcaccccactggccgaaaccctccactattagctgccactgcacacagagtcgaagcctaaggcattgcacttacacattttcatgttatattgttgcatagatgttgttagtttctgagtagccaggagagcattttttctgcaattaaacatatcgaatgcaccacattctttaggtcccctcaaaggcccttctattcactctatttcaggaagggtgagggaaccggtgaataaacaaaggtccttgctttaaaggctgttatgaccataaagtctgtgtatttcacagctcatgacagcagcatcctgagatattatttattgtcaaacttctcttctcaggccacacatcccattgcaatggggaatgggacagagcaaattgcaagttcttggttctatgttccagttgcaatgttgctttcagttttcctgctgttaaaacagcttttgctggtaggactgtgggaagtgagaatagatttcattttacctgctgtgcatcagcagaaaaaacaagtctttcttttctcctagcagctgagatttctcagagttcttcctagaattggatgttatatatgatctactttactcatgccaaccggcatacacaccaaagcctgatgagtggtacaaacccacccaatgttttcccccaaaacagaagtaacataagcccatgtggaattgtcagaggtgtttgaaccagagcaactgcatcttgaataggagcagggtaaaatgaggctgagacctactgcgctgcattcccagacagttaaggccttctaagtcacaggatgagataggagatcggcacaagatacaggtcataaagaccttgctgataaaacagtttgcagtaaagaagctggctaaaacccaccaaaaccaagatggccacaagagtgacctctgggggtcctcattgctacactctcaccagcaccatgacagtttacaaatgccgtggcaacgtcagaaagttaccttatatggtctaaaaaggggaggcatgaataatccaccccttgtttagcatattgtcaggaaataaccataaaatgggcaagcagcagcccttggggctcctctgtctatggagtagccattcttttattcctttgctttcttaataaacttgctttcactttatggactcgacctgaattctttcttggtgagatccaagaaccctctcttggggtctggatctggacccctttcctgtaaaagaactattcattttatcttttggtcgtcaccaagcaaacacaattataaataaggaaaataatatatgattgtaattttactcataatcccgaatgtctctcatgaccagcacacctttggtgtattgggtctaaatcaaagaaaaattcgaggagttgaatgaacgacgttttgatatcttaatgcattttggagaaaaccaactgttgcaaaaagctaaagaaaacaaaaattcattgtttatagatcaggtcacgtgtttttcatttctgcaatggcgatgtggttgattcccatggaacacaatgagagtgtggtctcctttgagattgtatttattgataaatgcaaaaatgctaatgaatgctaacttgctggttctccatggccttccttcctccctccctttccaagaaggatgttgtatctgtcagaggcatttgaaccagagtggctccatcttgagtgagggctaggaaaacgaggcttgaacttgctggtcggcattcccagaaagttaggtgttcctagcctctagatgtttacagttaagggaatagattgataacattcactaaacagacccagaattgggagtgtcctgatatcccgatatcttgagaacagaagcattcctaattttgctttaaagataataacgttgattcttgaaaaatatagtaatttaaaaaattaatcctttatcacaaacccttgtagcagagcacatctccccatgatctttttaaattctctatataaacaagcactgtacctaggggttggtgtgttccttctcttactttctggaatgccctactctgtctatggagtcgctgtactttcaccactttactcttttaataaacttgctttcactttgcactgtggacttgccctgaattttcttgcccaagacctaagaaccctctcttggggtctggatcgggacccctttcctgtaacatatccacctggtcaatttaggaggcagctgttatgtttatcaggatgaagaaaataaaactcttttacttcaaaatgtatttctatgatatagtttgagatggctgttcagaaagccagcaaacaggaggggccctgcaaagctgtcttgtatggggcgatttgcatctgcagataaattctgcacggatgcagccaggctttctcagaggccatcctccctcgtcctactgtaggaaagatggacagagagtctgacatctttaaaggtctgaaagaaacattcgccatctattctctctgaggcctgctacccgggaggtttcatctatatgacaagaccacctcggctagcttggcctcttcttctctttctcccatagcctgtgttgccacaatgcgagcctccattcttcaacctcaagatggtgtgaaatcttctgcactccatccggggcatggggttgggtaatcaccctatgagttaccctacgatgctccctgtgttcaggagagtatatttgtttgacttttctccaattaattttgcctttcatgagtttattttccagcaaaacttcagagcaaaaaggaaggttttaccttggcctctgcaatgataatgagttcagatgtaacatgaaaaatttaggaaagattgggagaattttttttaaagatccaggaatttatcttaggggaaaaaaaaggaatagtactggaaggaggatgcaggaagaatgagagagagagagagaaagggagattggggcaagtgaggaggaaggagggtttgtggacgtctgacatgctggagagataatgaggagaccagttgggggaatatgagcttaagaggttctagtgtgtgcctattcgagacactggagaaacaatggaattattttttagagcttctctggatatagaagatggtttccatttgaatgggatgccaccatgttgagccaggaaataaggctttccttaaaggggctgcttaccacagacattgattctctcgcagtcctggaggctggaaatctgagacaaggtgtgagcggggctggttcctcctgaggcctctctcctgggcttggagatgctgtcttctccctgtgttctcccatggtggttcctctctgtgtaggtctatgtcctcatctcctcttcttataaggacaccagtcctgttggattagggcccactctagtgacctcgttttaccttaatccaatcttgtccattctgcagccctagggccacatgcagcccaggacagctttgaatgttgcccaacacaaatacgtacttttttaaaacatgagatttatacacggacctgttttttcgctcatcagctattgttagtgtattttatgtttggcccacaacaattcttcttcttccattgtggcccagggaagccaaaagattggactcctttgccttaatcacttctttaaaggccctacctacaaatacagtcacattctgaggtcttgggggctaggacttccatggatggattgggtgagggggcctcgactcagctcataacagcagagttctaatggtggttctcagtctttgttttgaggaaagtggtcgcttaaataacgacatatggaaaagatacaatttaagtaatagagacttcccaggcaaaccccatgtaaggggaggaatcgaacgtatcaagggcattccccaagcccaaggtgatagaggtgagaaatgctcacttattagtgcctatttcagtctcctgatagattttcatttagtatgctgtaaacaaaaatatccctgcagacactggcacttgagggattacagtggtgaggagaaattcccttatttatttgtggaattcagtgaagcatttcacagtccaccttctggggataatctgttcattgccatggagtaaatcaatagccttcatttagattcttaactggcaatttgatctcattcactttacccaacactcattggctggagggatgttggagactgggagcaggctcctaaaaagggtcttgaaaatgttatttcaacaaagattaattttgaggcattgagagtttcagaaaggttgacttttttttctgaagctcttctaagccaatcttaaatgaatcctcagaggactatttctgtgggtgtgtgtctgcttgtgtgtgtgtgtgtgtgtgtgtgtgtgcatgtgtgtgtcttgccccattccaattctccatccccatgctgaggaggctggaggattcagaatgcagaatcaggtgtatttttaaaaaatcattatgtctgtcctcaccaaaacactggctatttctatctttccttctcattttactctgctataggaatctaagtaaatcatctttaggaaataccaagacctaccaggggttttagattgatggcggccgacacaacctagtattgatagcccatgtaaatgtttgccatccagatgacaaggataacgacaaaactaacatgacctgccccatggtgtgctagacccacatctcttggggaatgttttgaagcaagttaatgcaagctacttgataaaaggcttctgtgatgaaatgagaatggggaagctgagttaaacaaaatcaaacagtgttctgtgttggaagcttctcaaatccttaaccatgctgaaaagcttagagtatttccaggagaatggcatggcaccccgcatcccagacctgcacagcccctgctcaggccatcttgtgggatgaacagtatgcaaaacacacattctggaacatgcttgaagagaggggaggccactctctagcttgggcacagttctggctctggcacacactgacaacgtgacaccgggtgacagtccctctgtaaactgcgcttcctcatatgcgagaggccatggaacgttggcctctcagacgttactggctctaacattattttgccaaaaataaaataattagggtggatgtgttacaggaaagtggtccagatccagaccccaagagagggttcttggatttcaccaagaaagaattcaggtcgagtccataaaatgaaagcaagtttatgaagaaagtaaaggaataaaagaatggctactccatagacagagcagccgtgagggctgctgcttacccatttttatggttatttcttgatgatatgctaaacgaggggtgtattattcatacctcccctttttagtccatatagggtaacttcctgatgttgccatggcatttgtaaactgtcatggcgctggtgggaaggtagtagtgaggatgactagaggtcactcttgttgtcatcttggctttggtggagtttcactggcttctgtgcaacctgttttatcagcaaggtctttatgacctgtatattgtgccgacctcctgtctcatcctgtgacttagaacgccttaagtgtctgggaatgcaacccagtgggtctcagcctcattttacccagcctttattcaagatggagttgttcttgttcaaatgtctctgacagatgtaataggtaacgctcagacactgacatcagaggcaatgcaaccttaacagaattggctgacatatatctctgggtataaataaagtctcagctttcccctgagacgtaatgatgagtgtccctaaagtttgcttcacccttccacgctaaactcgctccactgttccatcatctgctttaaagccacaaggacagccagttaggcctttgtcatcatcacttttaacttttgtttaacttttaacaaagattggcctttttaaaggctcagttatattaaaaaaaacaactgcctgccacttacgcagtccatggattttaaacaaagctggcaatgcaagtcaatgggaaaagaatagtctttttcaacacatggaattggaaaaactggatacctatatggataaaaatgaactttgatcccttactccatactctgcacaagcattaaattaagattaactgagatttgatctgaatgtaaaatctaaaattgtgaagcttttacaataaaacaaagctagacaaagactccttctacaaatacctggcactaaacattaaaaaatcataaattgtgctcatcaaaaatacatctgctcttcaagatagatgaaaaggcaattcactgactttgagaccaagtgtttctgttcagaatatgtaaaggaattctaaaactcaacataaaaagacaaaaataaaacaaaaacacatgcaaaaaataaaaaaagatagaaaataagcaaattatttggacaaaaggctcccaaaaaaggaaatgcaaatagctagcaatcacaggaaaagatgctcaatattattagttatcaaggaaataaaaagtaaaaccatgagatactcatacccattagaatggctacagttaaaacgactgacagtactaagttttgctgaggatgtggagcaattggaatgctcatgtattgaggtgagaatataaaatggtgcaaacacttttaataactaccctatggctcaacaattccacttatagatatataccaaagagatatgaaagcatatattcatccacacaaagacctgtacacagatattcattgtagcgttattcatgataacttcaatcggagcagaacccaaatgcttaccaaaggatgaatggataaacatactgttacatattcatataatgacataatactaacagataataaaaggaataactattgttacctgcaatggaaacacatataaatgtcagaaatagtacgttgttaaataggccagatacgaaagagaatatgttgcatgattccatttatataaagttctagaagagacaacgtgaaagtcatggtaataagaacagcagttgcctgaagttttgtggtttggcgatatgaggaaattttctggagtgatggaaatattctatatttttattcggatgatgttttcacaggtgaatatatttgtgtaaactcatcagaatatataaaaagattctacaactcaaaataaaattttaaaaaaccacaaaaagttattgtgatggttaatattgagtgtcaacttgattggattgaaaggatataagtattgctcctgggtgtgtctacaagggtattgtcaaaggagattaatatttgagtcagtggactgggagaggcagccccttcctcaatttgggtgtgcaccatctaatcagctgccagcgtggtaggataaaagcaggcagaggaacgtgagaggactagatgggcttagtcttctggcctacatctttctcccagctggatgcttcctgccctcgaaaatcagactccaagttcttcaactttgggactcggacctttgaacacagactgaagcctgcactgtcggcttccctagttttgaggctttgggacttggactgacttcctggatcctcagcttgcagatgacttattgtgggacctcaccttgtgatcatgtgagtcaatgctccttaacaaactcccctttatatatacatctatgctactacttctgtccatctagagaaccttgagtaatagagttatgcatttttattaaatgtaaattatgccttaattaaaaataaatatcttctcaacctccaaaaagagactttctgtctgaaacttgagaataagtctaaagttttcatttaataatgaatttgtaaaagacaggaaaattgattttggcattaatttgttcaacaaatatctgttgagcatgtcctatgtggcaggggctgagtgtggggtgtggattgggtgaatgtaaggaacatatagttcctggctccctagagctcatggtctaggggttggagagaattggtacattgggattttaaagggggtgccaaaagtggtgatgacaaagctcagggaagaacaactggagtggagggagggcatcaacatggatgctgaaccaagccaatgtactgctaagagtgaggtggaaagtatcatgtgaaccccagagcttcaattgtcaataagtattggggtgtgaccagcagattgatagaagacagcaaagagagaggggtgaatgccaatagagcagaatagcatgacttgtcaagagacaggacttttcaaggtgaaaggaagggagatggtcctgaagcagcagtcatgtctatgacccacctaagccctaagcaatgacagataggaacagagtcagggtcctcagaggacaacctagttttaattaaggacagaagttgagaagaatattttaagaaacatttgaggacatattacagtttgctggctatgggttagggtagggtggaagagagatatttggaataaagggtatggatgggacaagacaaagcagggcaccagccctaccttggacctttccttaacttgagacagccatgtccatgttgattcagccaatctgactcaggtattatgtaacttgaagttgaaccatcccaactgatataagtggtgatactgagtaacacaaatgtgctttctggattcacacatgtactttttttacatgaaaagttcaaacttctatgtggagaattttttcttttttttgtttctttttttgtttttttttttttgttgttgttttgtttttttttttgagatggaatctcgctctgtcgcccaggctggagtgcagtggtgcaatcttggctcactgcaagctctgcctcccggattcacgccattctcctgactcagcttcccgagtagctgggactataggcgcctgccaccacgcctggctaattttttgtatttttagtagagacagggtttcaccattttagccaggatggtctcgatctgctgacctcgtgatccgcccgcctcggcctcccaaagtgctgggattacacgtgtgagccactgcacccggccgatttttttcaacagtatcctcaagaagtattcatcattcaactctttctaggaaaggtatttaaaaaagaagaaaaatatcatttctggcctggaatgtcaagacatacatctcttagagatttagttctaataattattgtagagtcttgtggatgtttcttataattttaatttttacaaaaacaaatctgtccatccatgcatctacgtatgtatgtatatatgtatgtatctatctatcttcatcatcataattatgcatctaggatctatctattgtgtatctatctaataatctatctatgcagaactgcaacatttacatgactggcccataccgccctctgctccccactttttctaatcttcaaaatcaagtttctggactcagggctatgaaatgcaaagtgaaacagctcatgtccaatggtctgacactctgctgctcatgaaaacctgcaacatccaactgagtttttcatttttaacatcagcagatctagttctctatcttcatagagagttatttttaattttattaggggataaattcttttttaataaagaaattattaggtatcaaaataccacaatctctttttggatacaactagattatgtgtatgggtgaagtattttcaacttaagaataacattcctgttccttgaacactattttggaagtttgggttaagggatattaacttccttaagacaaaacagactcacagttgaaaactactcaccttctctatagaagttgcttaatatcaataatttttattgtattggaacaaaatagactataactttttataagatacatataggtttactactaaatattcttaaaatgaatataatgctataatattcttattttgaggtaatatatatatagtctgcaaaaattaggtttcctggtgtcattaaccacttatgcaattatttttctgaaatgaatacacatgctgtacgtgcagttttgcctgatacaagttttaaaacaacgtatattggaatcttggaactaaaaatgagaaaatcagtgtccccttgatgtcaatttcagttcaaactgcacttgctattttatttttaattggttacttacattatctgtacattgtcacagttgatggtatttgtttacttctctgtgaccataatttgcacagatttaaccataatacatccttaaagattacaagaaatcttttagacacagctcctctcagttgctgaggatccaacttttactcatttgttttcttcatgaatatgtatttcctgagttgtatgtttgtacatagctatttgtagcctttgaagtttatggaagtttgtttggttgcattcttggggcacattttctttccctgatgactgttaaggttaggatatttgacccttccaaagctcatgttgaaatttagtccccaatattggaggctgggcctaatacaaggtgtttgggtcatggggacagatcccccccattgaatagattaatgtcctctcctgatggtgaatgaattcttcctctattagttcctgcaagacctggttgttaaaagagcgggccacctccccggtttctctcttgcttcctcgctcatgtaatctctgcacatgctggcttccccttctcttctgccatgagtgggagcagactgtggccatcaccagacgaagatgcccaattttgaactttccagccaccagaatcataagccaaatcatccctttgcctttataaattatccagcctcgggtattctttatagcaacacaaaagggacaggactttttatatcttgccccactgtcttctagcatttcatgtgtcccataaagaaatcttagtctcctaggtttttttttttttctgaatatccacagaattctttccataacttcaaataccaggaatttattggggtatttgttaattattcaatataaacacagccttgtaattcttgggctatttctgtctgcagattcaaatttcactgtatttcaggaatttcaccttgaattgtatctttgaaaatttgttttcatgttccattcattttttaacccatgcaaggcatttagtgttaatgatatttgatctcttccctaccactccctcccatccccctctttttctctatctctgtcttccatcttttacttttcgttcttttccatctcacatgctcattttttcttctcaaaaccatccttcgaattccttcagtggtgtctcatctcccttttgctgcttctatcatgacctttgattttggtctctttttgtgtgtctctctctctctgagattctgaggctctgcctattccgtttttattctcatttgtttctaattgtttctaagactctgtatactcctttttcattctcatttattactaatttatttctgaggctttatccactcacttttcattcccatataacctaatgtattatcagttcttccttaaagccttatattgcttctttaaattctcatttcagagaaacaatattgtctttaattgattccttagaaataaccttgttcatggtttttggctgcgttgtggtatataatctttccgtttctcatcttcataaatcatgttctgttcttcttttttcatttcagcatcattataaggcccccggctggctccaccctttttaagtagcattgttcctcatctttttggactagaattttgggcaaagttctggggaaaggggaagaagaatgtgccaaacaagtgggaagattgggtttcagtctgttatctctaggatgtttctcagctggacttggcctgtgggttatctgttctagcatagcaggatatcttccaggctcacaaggaggctgtgcattttacagaacattttaatgtgattattttaccttgacttatcttcaccaggcagctttgggcaaagacggccaggtagcttttatcttattgactcttccttctatcctatgccatgattgaaacatgatgtaggcttccaaaaccaggccatgaaccttgatcttaactttctaagcatgggatagacacatttcctttcaatgtgtgccacccatccactttggataactatgagctgggtccactctgcctgagtcagacatagaaagataccttctcttggagttcccaaatacctccatccacttctcatacacttggctttcttcctgcatctactgtaatccagtgttataggggatctgtagcttcatccaagataacatttgtttgtttcttcttctcttgtttgctttggattggtttcataaaggaaatcagacaaaaatatatttatactaccatttgaaaagaaaagataaattccttctttcaaattcattcctttttgtttctttccagtgaatctcatggggtgaggggagcactgaagggaatgtccaatctactcaaatccaaaaagtcacaggtataaggcacagaaaattttaccagtctaatgatggcagttttaatgctatataaggacagagtatgcaaaaatgctattaatgaggatgaggagctgggagttcgcaaaatgttggcccagatgagtgcagcagacatttggcccaggtgagcctagcagatatttacatgaaatattagggagcatccatctgggctatgtgacttaggctggcgatacacgacagaggattccaatttgttgtataaatcaccctcagagcccccagcagtgaacacatagggggttcttttcattttcatgatgcttaatatagtctttaaaaataattaaaattaggtgaagtgtgtagatttctgagaaattacagaaagacattagttttgatacctcttgcttgtagcatttgaccaacataaacaaactaaaaggtttaaaaagaacagggattcttcccagtggtatagtgtaatgggtagggaaaaaaagttcaaaattgataaatagaccaatattattctcaaaactcataccactgtcattgggaagaaatgaatacatattacttagtcacttcatgttaccatatacttatattaacacaacaaaaaggaaattatacgaaaaaaagtcatacatttaaaggatggaagaaaatcctaggtttactcggagctcaagatcccattgagatgaatattgttctttcctcagattgttccttcatttcattcattcacttatgtatgcatttatttatttagagatggggtctatttctgtatttatttatttatttattgatggagtattgctctgatgcccaggctggagtatagtggcacaatcatagctcactgcagccttgaactcctgggctcaagtgatgctcctgcgtcagtctcctgagtagctgggactgtaggtgtttgccaccacgccccgctaatttttaagttttttttgtattgattgggtttccctatgtttcccatgctggcctttaacttttcagctcagcgatcttctgccctggcctcccaaagtgctgggattacaggtgtgtcccttcatttctaatgaaggaaggttttcctttgaatattcacaacagatatttttaaaagaaaggcagatttgaagcaaccatcaacaagctttacctgaaaattaatctgatatttacaattgcattatataaaagaaatgttacagactgaattgtgccacacctaccccaaaactcttatgttgaaatcctaacacccagtacctggaatgtgattgtatttggagatgggtcattaaggagtaaattaaagtaaaatgaggtcacatgggtgggccctaatccaataggactggtgtccttataagaagaggagatgaggacacagacacacacagatagatgaccctgtgaggatacagggagaagacaccatctacaagcccaggagagaggcctcaggaggcaccatccctgctgacaccttgatctcagacctctagcttctagaactgtaagaacaattgttgctgtttaagcattcccatatgtgggactttgttatggctgcctgagcagcctaatgggagtgcaaagactttctttaaataatgtataacaatgctggtttggaaatgactatccagtgttgagttcaaaactttatctttatggatgctgctatgagtgagtgtctaatttgggggcataatattgacattcttcgggagaaatgcagactccaatcagtgcagaaaatggcacagaataatgtttaaatatgccctccaggccataacatggttgggttaggaggaggaatattaaccattcccatcctaaaacacagaattttgggtttctttctgtgagttcaccacctctgaccttcacagttaagggaccatcacacagacatctgccattttcatataactgtctatccaaacaaaggctgaaaattcagcatggaggaactctcccagcacccgtggtcagccccttggcctgcatccccaccctgggcactggtgtgggggtgggattctttatgaacttgggccccaattctgcttcccctggaaagctggacccacacaacatcaccctcatatgcagaccctcatgtctgggcacctgtgcctacccggagctgggggtctgctctaggagctggttcaggacaggatactcccatccaatctgtgcccaccatagaaaagagccagccaagtgcctgctactacagggctcttcacacatggaaaagctgccctggggaagtgtcccaggaaagggcagggggacaaaaaaaggtcacagtgatttgcctccagacactggacactcttccctggagagtacagggcatgctcctctccaaacctgatcttgctacatttgtgctgcccacagtagtggtgccactgagttttcaaagaagacagcaggccctgaattgtgcaaggaaaataagtgcttgaattttgtagcatgcatgcagtgttctacttttaagaatggtaccaggctcctctgatattcaagaaaggcccccaacagctcagatggtagttttctaatcctgtcttcccacatgcacatttacctcctccacccaagaactgaataacagacatgagtgctcaggacgtcatgctgtctactgtcatccccttcctaagaccccctctccccatctcttgacacccctgttcttagctccctctttctttctggcctgttacactcaacctctccagcatcctaacaagtacccactcaaacctatttcctcccctgctgtgctgcttcttcaaaagtgctttgcttctcatcctcaccttctttccttgccctcttccctgcttccctcttcaaagcacttctcagctacaaatgagaaggaagggatctgattaaacaggctatgagcagagtcatgttctgaggagatttgcatttttaagaggagattaatgaccacatctgacaatgtgaccctggaatcttatgcagagtgataggggatttgggatgagctccgttcagggtaggaagcgagagtttggatctgaaatacttttcagatgctgaagtcataggagcttgcagttgcttcctgggcagagccataaacaaacatctcttctgcagagtgggggctgagaagatggaacagtgacccaggagctatggaattatctggccatgttacacttgcaggactacacacatttaagtgaaaaaacatgcttttcgtccgcctggctgacctcttagcctgctctcctcttattgttcccttgaaggcatcattttttgaaagagaaatttaaaccctgtccatctcatcttctttggaagaaagttaagattcctttctgaggtctttcatcatctggagtttaaaagcttcctctcctctatcaactctctttgaatccctcatgtcacaccaaacttcaaaagagacaaatacttttgcatgattccctgcaggctctgttttgccctgtagtgacagccccatgtcttcgctttcctgactggaaaaacttctcaagctttctacattcatgatctccacttcttcagtgcaaccttctccagtttgtctctgatctccaatggtccctgcattaatcttgtccgagccacaggtgaccctcgtatcatctcagcttctacttcccagtctctctctgttttttttttttttttttttgagacaggggtctcactctgttacctaggtttgtctcaaactgttgggctcaaaagatcctccgacctcatcttcctgagtagctggggtaggggtgtgagcccttctgcttggtctccagtctttgcttttcttttttgacctatacgtttggtggttgatgtccatgttcatgtaattgtcttctctggcttctcagggccaccatgcattcccttctccctcttttcatttattatcttttcatctagtaaaacccatcttcccctaaagatgtatattttcctcaaagcaaggattggcgtaccttcacaaactgagtctccaatgacaacacaaactgaaatgcaatataaatcatggacagatgtgagctcctcttctacttcctgtgtcctctgctggttcttctcaccaacatcacgtattgctaagtaagccagtgatgtcaagttagaaaatggactgagtccattaattcatttggcacgctccaaagtcctcacctgagatctatctactctccaaataattacacttcttagaaatacaggaagatccttttcacatgagctaattagggcgaatacatgtaagtgttggtaagaagtactagaaatactggaatttgtgagatttcattgaagaaccaacttccacccagcccttcacattgttctctttcggtagtttcttgtcatttcctccttttactatcaatagggctgctgtgaacatgcatgtacaagtttctgggtggacatatgttttcattttttgggggggagtagatatcaaagagtagaattgctgggttgtatgatgaatgtgtgttctaacttttcagaaactgggcttctactgcttcctaatttcaccttccacgccatttctgtagtgaggcccactccttggccttacaagacctgaattaagttaggtgccagagtcgttctgtcattgactctgttctttcccttgctagcctgtgtaataattggcagtcagacctttacataagcaagggtttcatatgtctccccagttatattacaagttccacaggggcagggctatgtctatctccttgacctctgaatctgcgatgcctggcagagggctgtggacaccggtcaccctccataaacactgggagacaaacaagggagtcagtagagttatttttttgcttttctacccccagaactgttagaatatgatttgagctattccttcaaggaagtcctggggcaggtgatcattcatagatgatgtgagggagtgcacagcacatgagtttgcaggaaaatgcaaaccccacgttgaaatttgatccccagtgttggagatggggatttacaagggggtgtttgggtcatgggggtggctccctcatgaatggcttggtgctgccctcatggtaatgagtgggttctctactcaatcctgcaagagctgattgttagaaagagcctggcaccttcctctcctctttctctttctcctgcttcttctctcaccatgtcatctgtgcacacaacagctccccttctcattccaccatgagtgcaagctccctgaggcctcaccagaagcagatgctggtgcaatgcttcttgtacagcctgcagagctgtgagccaaataaacctcctttctttataaattatccagcctcactcaggtattcctttatagcaatgcaaaactgactaagacagggtatcaggagacctagatttgcctgcatctgagaacgtcatcaggactcttggaacaatttagcccacagttccaaggttgatttttgtcacagcgaagttcaggtagtaagaattctcactggtggctgttgagggtggtggtggtggggatgggtcatatggagaattagcagtgggagactagaaattaaagtggagaaagggaagaattaaaagtcaaaaacagtgtgagggaggaaagcaatggatataacacctcggatctttatccttgagaggccttaaaaatctacttaataatcagatggtattctataagaactttgagactagacatgtgatgacttttaggaaactgccctggagctgaaaatgcatgcaaatctagctgactcagctccagccttaactggctcataacttgtttcataaacatgactgtatgttagcaaggaaatgagagagaataacagcacatcacataggcatgaaaagtatttgcaaagcagcagttctcaaaaatgacattttgcagagttttccagaagcagattcagaaaactgaagaccaaagtaatgagggagctgtctcatgcctagatgagcagaagcataccaaaggcttagtatttccccaagtaataggcacctgaaacttatttaaggaaaatactcttcttgatgaaacaggcactgcagttgaagcaggaatgtgtttggtgtgctgccttaaatagcatgggtagatgttcaaacatgttaggactcactggccctaggaaagacccgcaagtatctggtctacaccaggaaattgacaatgaaacaccaaacaccttttctcctctaattaccaagaaaagtatttctttcccaatggtggaagacaataatgttgggaatgatgaagttttctggagtgtgaagtggatatgtcttataagtttaatccacagcttcaccacttcataagtggataatcgaattgtgcctcagtttcctcagacttggggatattaagagtaccctcagtcaccacaaggtgggtaccaacataagaaaagggtatagcaaaagcccaggggtgcatgttcttaaagtgcctagtgtgggattagaatgacaagtggtagatgacttacttgtgcagaaatttagagttattttgtgattttcaaatgatcatgggtgctttccatatgctgtccagactgggggtgctgcagctagaaagggaagaaggtttccgtatttcctgagactggagtcacatcctctcaccaatgcactcacctgctgactaaccagtgtacttctgggaattgcaaatgcatgaaatggcacccattctagactagtcacagcagtgtttttgatggccacagaccaggaacgaccctgatgtttatccgtagggaactaggtaatgagccatgatcctcatcatggatactgtgcagctgtggcaaagaatgaggtatccttctgtctgtgcaccgggaaaggtttccaagatacactgcacagtgagaaaaacaagaagcagaacaatgcacggtgtgctacctcttgcattacaaaggaggaaatgtaaaactaatttacaaatggccaataagcacatgaaacgatgctcaacatcactaatcattaggaaaataaaaatcacaactacagtgggataccaccttacatccattatgatggttgttctcaaaaaaaaaaaaaaaaagaaaaacagaaaagaaaaatgttgacaaggaggagttggaacgcttgtgtagtgtttgtgggtatgtaatatggcgcacccactgtcatcgtttctcaaaaaattaatcatagacttaccacaaaatgcagcaattcagcttttggtgtattccaaaaagaatggaaagcagggaccccagcagatatttgcctgtgtttgttcatagcagcattatttataatagctaaaagttggaaacaagcccagtgtccatccatcgtgaatgaataaacaaaatgtggtctatacgtgcaaatgaatgggattcagctgtaacaagaagggtggttctgacgcgtgcttcaacatgatcaagccttgagttctttctgctaagtgaaataatcagactcagaaagacaaatattacatgattccacttgacagaggtgcctaacgtcatgaaatgcatagacggaaaatgaacaggtggttgtcagtggctggagggagggggaaagaggagttggcgtttaatgggtatagaattccagttcgggaatatgaaaaagttctgggtggggatggacagtggtggtggttgaacaacaacctaaatgtacttcctgccattggatgtacacttaaaagtggttaaaatgggccgggcgaggtggcttacatctaatcccagcactttgggaggtcgaggtgggcagatcacaaggtcaggagatcgagaccatcctggataacaagatgaaatccactctctactaaaaatacaaaaaattagctgggtgtggtcgcatgcacctgtagtcccagctactcaggaggctgaagcaagagaagcggttgaacccgggaggtgaaggttgcagtgagctgagatcacggcattgcattccagcctgggtgacagaatgagaccccttctcaaaaaaaaataataataaaaaaaagaaaaaagaaaagaaaaattggttaaaatggtgaattatatgttatatatattttatcagaatttacaataattcctattgttttgcataaaacagctgtagaaagctttgcaggtcatgaacagcacagctggccactggggctggtgtggggctaggacctggttgcacagggaacagggatgagacacaggctcttcatgcctgcacatatatacggatacacacagatgcaaatttctaagccatctaaatacaacacctattcaaaaaatcaaacagaaaaaggaaatgttatggaggtgaaggatgagggtaggtggggtggctgctcaggacagtggaggccacatcacgcaaccttcgaggcctctcttagctgctggagcacatcccagggacttgggagctctggaaagaggagcaggagagggccatggccggaggaggcctgaaaaagatcatctctgccacagagaagaagctggctcagatgcttgtggccactgtggagacagggagacccagggagacaacagtattcactcaaggaggaatgggtggtgatgcaaacttgggtggaggccacagggtgcagaagacaggacacagcagagagtgatgtaggacatggaagggacagaaaggagtgaccaccggacataaaggggcaaggaaagtggaagcatgagaacatctgctgggcatctggtggagggatcaggttcccagggtgcccatccctaagggagaacccaggataggagcagattcagagaaaaccacccagctcactccagcaagaagcagaaaagggactggttaaaggacagggtaggaaggtcaccaagctccaagggccctcatgaatccagcttgtaggccacagggcccagggcaaggaccaaaccacaggcacaggacagctccggccaagatcttctggctactgcaggaggcagaaaccacaccctacaccctgcactgctgaggctagccctggagtccagaagcttctgcaccagaacctttggtcccccatccccctcaaaaaattaaaaacaaaaagcaaatcggtgccatgcacactctgtttcctggtgctgttctggatcctgagtctttcatgggagcacctgatggggaaagcctggacctgtgttggtgtccctcctgcaaggagtgctgggacaatgaaatttctggcttcctccttgggaaggcagaacattccccatgtgtactggtggcatttaaaaactgcagggcagccagagaacatgcaccgtgttccaccaggagagtttctggcgggttgtcccggtgcagacacccgtcccaaggtgggtatttgagctgaggaactgagaagccggtttctgcctagagttagagatccgaaaggcatcaccacatggaagggaggaaagctacgatgccttgagggtgggagatcagatgaaccaggagaggcagggcccgggaggaaccccggggagcagccgcctttaaagcctgggggaagtagcttcagagaaggtggggtaggtttgtgtggggggtgctggaaaaatataattaagaaagaaatttctgctcagtccagaaacccctgtcacatccgtagaagtaaaagaaacctgtgttatgattgagtaaccattaagccaaaatgtgatgcaatctgctaagagatgacaaagacagaaagaaatcccacctttgtatccagccaagcaggtgcaacccgttacacatatggtctccagatagatggtgactagttcccagttgagaggactcaatggccccatttgtcacacatagttcatcctaaattcacccagtaactgtgttggttctctgtgaggttaattggctttatccacaggaaaaacaaacctctcttatctatgacaggaggtagttttgcaactgggaatgagatgcccccagaactgaggttccttccttctcacagaaactgggagacaggggcgctttctggccagatgcctgcctttcaaagagatggctcctatggccttgaggaggatagttctgggttgtgaggcaggcaagatgcttatgtatgtttagaaagctttacatacatcttcaagggacagagaaagaattttcaattacacctcttctaaaaaaaaaaatgctctcaaagtccagcctaggcaacatagcaagatcttatctccacacacacaataataataataaatttgctgggcatagtggggtgtgcatgtagtcccagctactcaggaggctaaggagggaggatcacctgagcccaggaagttaaggctgcagtaagcttggatggcaccactgcactccagcctgggtgacagggatggcaccactgccctccagcctgggtgacagagggaggctctgtcaataaatgaatgaatgaatagaaaatgctctgagtgaaaagaggagagtctctttatctttttgcaacaggctaaacaaaatttttagaatgtatatttgcctcacagagattattccaggaaaagaagtggccctcagtgtcaaaggatgcaaaactaacctgtgagttcctggcaggtttagcaataaagcaggatgtttctgatctcagtacaagcaatgttagagaaaggggaggatggaagtggacgtggaccagtgagtggaaggtgacaaatggaagcaaaggaacgtatccagaccattgaagatgcttgaccgagaggaaaggggcggtggagggaacggaagcccgaggaagtcatttgttgcaataagaggcctcagagcacgtgtagggtgcggggcagagcccatgcagaggggctgtggaaggctggcagggtgcaggtggccccactctctgtcaccctgaggagtatgtggtcagagttaaagctcagtctgtttctgggatcaggtaagaggtcagcgtccggagaagggaggtggatcttcagatcctgcagacctccaccgcgccctctgtccctcttgactgctttttctccatctctattgtctggctcacattcctgtcacgtcttcctttctccctacccctcttttctcttttctcctctctttttcttaacccttgtacctttggaagtcccactaatagaatttaaacagcttttcaagttggttttttgttcccagaaattgacattagactctccatgaataatgtagaaatcaagagtataagctggttcatgtctctgcaaataaacaaataaaatctacattccaatgctttcttcttccagagtagcccacatttgatatttgtttttaattactgtcacttgcgatagatttttaaatcttgtaacctggttacacaaataccatggggcaaaagccttacttcctgtgagaggaaaccaggcttgactagcctcatgctggctttgaagaagtaaaatcaggggttgatgaatttgcatagggtaaatatcaaaggtcgaaagtcaacaataggtgatagagggaataccccaaattacaaaagaacaaactgtttaagccacaacagaattatcgtagaaataaaccacggtccttcctgctaaaatattccacttagaattgtaaaatattcttctcaataactcctggaagagcctattaagaaattagtgaggctgggtgcggtggctcacacctctaattccagcactttgggaggcctagacgggcagatcacctgaggttaggagtttcagagcagcctggccaatatggtgaaacactgtctctactaaaaatacaaaaattacccaggcatggtggcaggcgcctgtaatcccagctattcggtaggctgagggaggagaatcgcttgaacccaggaggtggagattgcagtgagccaagatggcgccactgcactccattctggacgacagagtgaaactccgtctcaaccaaaaaaaaaaaaaaaaaaaaaataagaaatcaacgaatgtaagagcatctatgttccaaatgcagtgtattattttatgcaggttttcacaagctccaaaagattcactgtgcagaactggaggttctagagaaagaccacgcctcctcctgcaggtaactcttcattcaggaagcagctcttggcttatccctgggcttagtggaattcgaatacctgaccataggacaccaagggctttgggacctgagtggcacatcatgtcctggtgacatctgagttacctggggcgtgcacagcagcctccagcatcccagggagagctgtgtacggggtcaggctcaagcgggtcccagggcaccagtgacccaatgggtgactcagactcccatggcacctgctccttctgtttctccctccgccgtatatatgagctcatgggaagtgctgtgacctcttacagaggaggaaagtgcatggacttccagcttctagaactgggatacaataaactcctcttgcttgtctattcctctgcagtattttgtcatggcagccctagcaaactactacagggactgtgggggttaggatgacaccaagcatcaaatgccactccctgttccaacactgagaccattccacagcccctgaatgacaagacaggccttcaagctcaagactacttggctaggtaagtactttagtcacaccacttctgaactttcttgcctacctgcagggcaggaatttttaccattttcaaatgaggacactgaagctcagagaagtgatgctatttcctgatggataagaggtgatatatttcagtcctcagaccaactctgaagtagcaagcttctagtcttaagagtcaaacttggctgggcatggtggctgaagcccataatcccagcactttgggaggccgaggtgggtggatcacctgaggtcaggagttagagaccagcctggccaacatagtgaaaccccgtctctactaaaaatacaaaaattagccgggcgtggtggtgtgtgcctgtaatcccagctactcaggaggctgaggcaggagaatggcttgaacccgggaggtagaagttgcagtgagccaagattgtgccatttcactccagcctggggaacaagagtgagacatcatctcaaaaacaaaacaaaacaaaaaagagtcaacctcgagccaggcacggtggctcatgcctgtaatctcagcactttgggaagccgatgaagtcaggagttcgagaccagcctgggcaacatgctaataccctgtctctaccaaaaatttaaaaattagctgtgtatggtggctcatgcctgtaatcccagctatttgggaggcggaggcacaaggatggtgtgaactcaagaggtggagcttgcagttagccaagattgcaccattgcactccagtctggagtgccaaaaaaaaaaatccatctcaaaaaaaaaaacacaaaaagaataaatatggggcctcatgactgtatattactgggcttctgacctagactgaaagatcagggaagagtttcctgaagagaaagtgagctatgatgggcccactgtactccagcctgggcaacataatgaggctctgcctcaagaaaaacatgcagaataaaaccacaaaaagataccactacagaactattagaatggctaagattaaaaagaatgaccacgccaagttttggcaaggatgtggaggcactggaatgctcacgctgctggtgggaatgtaagatggtacaatatctatggaaagcagtctggcagcttctaaaaatttcagcatacacccaccatgccactcggcaattccattccattcccacattatttttatttaaaggaaaatcaagtggaatgatctttaaagcatttttgcctgacaaatacatgaaatgtgggtagcagcccaacactccctggtcagtcttcacagggcatatgtggcctcgtggcccccaggaaatatggctctttccacaagtgctaagtccagtctctccatcaatcctaagatgttagttccacagcactgccagcatggggctttgtctatttctttctttctttgtcttttttgagaggggtcttgctctgtcatccaggctgaagtgcagtgatgcaatgttcgttgtaatagctcccatttcatttctaattgatcttatttggctcttctctcttcttttcttggttaatcttgccaatggtttatcaactttatttattattcccaaaaatcagctttacattttatttatattttgtattattttgtttcaatttcatttagttctactctgatgttggttattttctttcttctgctgggtttgggtttggtgcattcttgtttcttgagtttctagaaatgtaaccttagattgtctatttgtgctctttcagtctttttgatgtaggcatttaatgctataaacttttagcacactctttgctgtattccagatgttttgatagggtgcgtcactattgttcagttcgaagaatttttaaacttccatcttgatttcatatttgacccaatgatcattcaggagcaagttatttaatttccatgtgtttgcatggttttgaaagttccttttggagttgatttccagttttattctaccgttgtctgagagagtacttcatataatttcaattttcttaaatttattgagacttgttttgtggcctatcatatggcctatcttgaagaaagttccatgtgctgatgaatagaatgtatattttgtggttgttgggtagaatagtctgtaaatatctcaagtctattttctctaggacatagtttaaacccattgtttcttccttgactttctgtcttgatgaccagtctagtgctgtcagtggagtactgaagtccctcacaattattgtgttactgtctatctcatttcttaggtctagtagtaatagctatataaatttgggagctccagtgttaggtgcatatatatttaggattgtgatattttcctgttggataaatccttttattataatattttattattatataatgtccctctttgtcttttttaactgctgttgctttaaagttagtttttttgatataagaatagttactcctgctcacttttgtggccatttgcatggggtgtctttttcttaccctttaaccctttaaagtgtttatgtgacactttagggttaggggagtctcttgagggcagcagatacttgcttggtgaattattatcaattctgcaattctatatcttttaagtggagcatttagaccacttacattcaatgttagtattgagatgtgaggtactgttccattcatcctgctatttgttgcctaaataccttggttttattcatttatttattgtatttttgttttataggtcctgtgagattcatgctcaaagaggttctgttttgatgtgtttccaggatttgtttcaagatttgggttccttttagcagttattgtagtgctggcttggtagtggcaaattctctgagcatttgtttgtctgaaaaagactgttatctttcctttatttatgaactttagttttgctggatacaaaattcttggctgataatttttttttttttctgagatggagtcttgctttgtcacccaggctggagtgcagtggtgcgatctcggctcactgcaacctccacctcctggattcacaccattctcctacctcagcctcaccagtagctgggactacatgcgcctgctaccaggcccggctaatttttttttgtatttttagtagagacggggtttcaccttgttagccagcatggtctcgatctcctgaccttgtgatccacccgccttggcctcctaaagtgctgggactacaggcgtgagccactgcacccggcctgataatttttttttaaggaggctgcagatgggtatgcatgctcattggaggtgagcattcttcccttattgaagattactaaaatcacatgtattgaaaagcatttgggattatttacttaattgatgagtactcatttatttttacatttatttgataccacgtataaaaaagtatggacatatacatatgtgatatgcgatacaccatagaacatatacatgtgcacataaagatagagggagacagaaatacttcagattttttcttttaaaactttttgcatgaacccataaaactcactgttaaaaaaaacagctggatttaaattgtgcttttgcaaaaagcaaaagttaacatttaattgaggaagcccttgctgagttttagagaaagtaggtagtaaatttacatctcaaagcacacacacacacacacacacacacacacacacagagagagatagagagagagagagaaggaatttgggtgtgttcaaggaagattaaaagtagttgccaaggtaacacaaaaatgatagaaatttataacaggattttataaggagaccaattttatttacatatatagcttttattttggtctctgttttccaactgtactccaggaaacacactacacaggctcccttcttaagtgctggtgggccactgcacatgcagacagcccactttaagggaagaatcaggggagaagagatgcagaccccagaattatgccaacatacaaaagcctaagtcaaaggtcaaaccacacacttgaaatctcatcgcctgtttggccctgttttaagtgtactttactttctttaatttctgctctaaagcttttaaataaactttcactcttgctctaaaatttgcctgtctcttcttctgctttatgacacttagttgaattctttcttctgaagaagcaagaattgaggctgcagcaggcttgtacagatttgctgccattaatatagtttagtgccattctacatgatagaatatatatattcttatatttatatatatatatatatataaaatttatgtattcatagaggccttgaatctacattcttgctgcactttatgtaaacaatccaggtataagactaaaacttattttggaaatacattggtcccatatgatttctatttcataaaaatgggagacaggagggggaaaattatttttcagaagaaaacaacagaacaatggttattgaattttagatctgttcatttttttttaaattttgttatttacctacaatttggactgaatcctaaattttttcctggctcaaatttcaaaactaatggtttcagaattttcttccatttttcttccattttggtatattataaattaaaactgtgatttttaaatttttatcttttttattacacttttaagttctgggatacatgtgcagaatgtgcaggtttgttacataggtgtacatgtgccatggtgttttgctgaacccattaacccatcatctaccttaggtatttctcctaatgctatctcttccctagtcccccacccctcaacaggccccagtgtgtgatgttcccctccctgtgtccatgtgttctcattgttcaactcccacttatgagtgagaacatgcagtgtttggttttctgttcctgtgttagtttgctgagaatggtgtttccagcttcatccatgtccctgcaaaggatatgaactcatccttttttatggctgcattgaattccatggtgtatatgtaccacattttctttatccagtctatcattaataggcatttgtgttggttccaagtctttgctattgtgaatagtgctgcaataaacatatgtgtgcatgtgtctttatggtagaatgttctataatcctttgggtatatacccagtaatgggattactgggtcaaatgatatttcttgttctggatccttgaggaatcgccacactgtctttcacaatggttaaactaatttacattcccaccaacagtgtaaaagcgttcctatttctccacatcctctctggcatctgttgtttcctgaccttttaatggtcaccattctaactggcatgagatggtatctcattgtggttttgatttgcatttctctaatgaccagtgatgatgagctttttttcgtatgtttgttggtcacataaatttcttattttgagaagtgtctgttcatgtgctttgcccactttttgatgggcttgtttgttttttttttcttgtaaatttgtttaagtttcttgtagattctggatattagccttttgtcagatggatagattaaaccttgcaagctgaaacttgacgacttatgtaaacttctggagaaatcatagcaacttatatataaacaacctttgtgcctgctgatgtgtggactacacaaaaggtacacatgaacactgtattcagactgcaattcagaaaaatgtgtcagattgccattgcaattggaagacacttcagaaactctagaaaacctagtctatacagttagagcgatgtttgccaaatgaattcctctaattgaagcagcagttgtgtgactttaataaggttccaggattatactgtcccttttttgctgtgacttccctttgcccttttctgaattgtcttcatccccttttccacggggcatgacttcttaagaatgagccttcctagtgatgtaggatcagatggaacatacagtcacaaagtcatgtcttctacaatgatttctctgaaagcttttgaggaattgaggggccaggtgtgctggcagaggcctgtaatcccagcactttgagagtccaaggcaggaggatcacttgaaaccaggagtttaagaccagcctgagcaacaaagggagaccatgtctctacaaaacataaaataaatcaaattagccaggtgcagcggtgcctgcctctagtctcagatacttgggaggctaaggctggaggaccgcttcagcccaggagttcaagactgtagtgagtacactccagtctgggtgacagagcaaggttttttctctaaaagaaaaaaaaaaaaggaaaggaaaagaatagggtaaacaggaaagccaaagatcttgggcatctccagatgtttgcctgaacaaattgttttttcttggcttcaaaacctttcaagatgcatatttctttgtaaaagaaggacatacgaatcgtaactttaagtgagcaatcaaaatctaggtcctaaaactgaagtattttaactctcattctgataatatttattttctgaggcaaagaagaaagacaagattagatcaattgtttctctgcccactccatctcttccaacttgccttgtcccctttaatcaaatgtataaatactaagcctcctgaaacgtcttcagagaaaacacaagccacagaggttttttgcaactcatgtattcccagggtgcactgtcaagctctggctcaataaaactcaattggtcaagacccttgcctcagtcagtcattctggataaccaccatgagtcctgcaaagcccttcagtaatctattgcctgcctaggtgatgtgtacctaggtgagtcagatcttcatgagtccaacactcgtcttccttttctgtctttcccaaccctaccactcagtgctgtgtgctctgatctgaccccagctcccaggttgtttgtattggtctaagaaagcaagaccaggaggggcaggttgagaaggaagtaagaggccaactgccatggaaagtggcaggtggggctgtcattgctcaaagccacacactctgggtgcattttatgaatttttctggattcataatcttctccctctgtgtctatctagaaactcaccctcctcctactttcttctcattactctttctgtttctagtgcactcatttatggccagagaatggccatgcaaatagttgacaatagaataaaaaatgacattttgtgagacttggaagctggcctttcttttttctaaaagagattgaggtttctaaaagctagcttttatggagggctgtgcagttatgattgtagttttacagaacaggtgcataagtgaagggtgagacagaaaacaaaatgctggctgtttgtcaaatcctgaaagtgaatgggacaaaaatcatgtttgaaggaggatgtcattcaggagaccttgtacatcttagagtgtcctcttaccagatgaagtggaggatgaggttgaattgtggggttaggtgacagtgggtacatacttctctgcctcagtttttgttttttttaatctgtaaaaatggggattgtggcacttgggatcttttggtgaggagtgtagttacctggaaagctcttaggatagtgcctggtacatagtgattcctgcatcagtgtgagctattataattatgggaatagaaaaaggtgccaccctggacatccagagtggggagatgttttccagtcagggtccaggcaggccagctggagacgaagctgattagtggggaagcttaacttccaggagtggaagaatttaggaggagtaaacagaatgcacaacatactgtaaacattcctttacccaacagtaggaatactcagagtgggtgtgtcttccgtggcaatcattatctcctgggaatctaagaatgtgtcctagagtcaaatggctttgatgtaagccaaacccagaaatgggcttcagggctgccttgcacatagcattcattcatcttgaaaaaggaaagcattcatcttgctaaaggaatcccctcttctggcccagaccattatttttgtttttttactatcctaattttaagatgtaaggagaaagactgaagaacaaaataatgaagtacatgaatgaaataacagggtagaattgagactggtatgtgtaagttaagagaaattgtgtataaattttgtgtgaacagaaaattgatttcttgttgcaaacagacctctctacataaataatacctcctgccttgagtggatagcagacctcatcacaagaacattccagcagagtcatgagagaatgggtagtgtggcttctttaattggcaggttagactgagtaagttactgaagagaaagaagttgaaggagaagatgggtgagggcaagaaaaatgggaaggtgaaaggaaaggactgaaaggaatgtttaccaagggctcatcaggtaccaggctctgtgactaatgtcttacacatgttaatttactcttccactgtcattttctgatgcggtaagagtcagtcttacactacaggtgaggaaagaggctgagggaggtcaaatgagtggcccagggtcatccagccacttcatagcagagctagtgtgtttcactgtggtttgtgcagacagaaaagtgagacatggaaggaaggcaaaacatttttgttgtgggtgatgtttatgaaagtgacccatatgaggcagaataatggcctcttaaaaatgtccacatccgggccgggtgcaggggctctcacctgtaatcccagcctttggaaggctgatacgggtggatcatgaggtcaggggttcgaaaccagcctggccaacatggtgaaaccccatttctactaaaaatgcaaaaattggctgggcgtggtggcacatgcctctaatgccagctacttgggaggctgaggcaggaaagtcatttgaacctgcaagggggagattgcagtgagcccagattgtgccactgcactccagctggggcaacatgagggaaactctgtctcaaaaaaaaaaaaatccacattctaactcttggaacacatgcatttacttttcttggcaaaaacactgtacaaaggtgatgaagttgagtatcttgagatggaaagcttattctggcttatctatgtggctcccagtgtcatcataagagtccttgtaagtgaaagggaaaggcaggaggggccgggtgagaatgatgaggcctgagagactccactggccgttgcttgctgtgaacatgtgtgataagacaaaattacaactaatttagttatagatgtaattggcttttatttgtgatttatgatttggggcagctctccctctacagatgcctcagcatcccaagtagctgggactatattgcaggatctgaccagaagcctgcaatgcaatggggctctttctttgttcccaggcagatcggcaggttgagaaataaaaggcacacacaagatagtgaaagccatatcgagaggggtcaccgccttctggtcctgcaatgctgccaatgcactggatataccagcatttattattaagtttagtgagagtggggataggttactgagggatttagggttatttataggctctccacaagggtcacattccattcccagagctatggacatctgcttttctgggataggaatcttggtaatgtgaaacctccctgactgcatgtccgttcataggctctctgcaggggtaagcacatcatgtgctgttagctcattctggcagcccaacctggcatttgtctttacacaatcctgcatgcagtttcatatttacaataatgaggagcatttcatcttttattccgtagcaatagtttcagggggtctccctacatctcccccttttctctgatttcaatgaaccatagcaatcatagcttggcactgatcacgattggattgaagaatattttttccaattttacacatgaacaataaaccaatagcacaaactgtctaaaacttcagcactgggtaaaacagttaagagtgcttgagaagcttcaaaaatctgttcttttagcttccttatgtctaaacttaaattatcttcacttccttgtaaatggcattttacgattcccaattgtgaacagactcattatattggaatggagttatacaaaaatcagaagtattccaatcacgttgcatttgtaatctatgttctaatctcataattctatctcccatccatataacagaagcacatcacgcgctgtaggctcattctggcagcccaacctggcattgtctttacacaatcctgcatgcaattttgtatttatcataatcaggagcatttcatcatttattctatagcaatagtttcggtgggtctccctacaggactacaggtgtgcaccaccatgcccaggtaatttttgtattttaactagagacagggattcaccatattgaccaggctgatcttgagctcctgaccttgtgatccacctgccttggcttcccaaagtgctgggattacagatgtgagccactgtgcctcgcccataaatcacacatttctttgagtttttgtaattccagcacaagagaaaccatttgatgtttgaagaatggctgcacacaaataaaaacatctgtggattgcgccacacgagggagactaccagtatgactatcaggaggaaaatatcgagtttggtatatacaccttaggcaagatgcaaaccaactacaataggatagatcaaagaagaagccagaagggtctagtcattttaaccaggcagcacatttaatgatttttacaactgactgtgtaatacccaatgtatttatccatatgcaataagaagtgtcagaaactgcacaggctccccccgttcagctgatagagagcaattctattatctagcattgcatgtctatgttaaattaaaacagggagtgagaataggcaagtatagaagtggaagcctaaaaaaatctccatacatttgaggaaaaagttgtgttacagatgcagctaatgtcagcctttgggtggattaaaggatctcttggtatgtaaaaatgtgtgggctgggtgtggtggctcacgcctgtaatcccagcactttgggaggctgaggcatgcggatcacctgaggttgggagttcaagaccagcctgaccaacatggagaaaccctgtctctactgaaaatacaaaattagctgggcttggtggcacatgcctgtaatcccagctactggggaggctgaagcaggagaatcacttgaacccaggaggcggaggttgctgtgagccaagattgtgccattgcagtccagcatgggcaacaagagtgaaactccatcttataaaaaaaaaaaaagtgtggttgacatgatatatctgacactgttaacttactctcagaagctacttcttgtgaaatcctaagtacagcattattctgggaagcaaaggagacaggcataagcaaggagaaattcagagaggtaagagtctcatcatgattgatagtcttgttctgacatcttgagaaaagctgtccacagtgtaaagtcatcaacttgttgtcgtggtttgcagtttgagtgtctctaagttatggtgttggacatttggtgagctcttagtggcccacacctcagacatgagggttttcccatgaaatttacattgagttgtccacctccaacttatatggcttcaggaacagagccactcttgttcttaatgatttcattggagaaaattgaattggaagaactaaaagaattcagggtccagtccagtctaccagtggattataaatactcaatgataatgaacagtggttcaatctggtaacaggtgtactacagtttttcttttcaacatagtttttctgtctataggagtctctatttttaccaaagataattccagtaggatgaatttgtttgcaaaataggttgagtctcaccgaacttgcccagattttttagctaagtgcggcaagagtagcaagggaccatagaggctctttttaaacttctctttgctagaagtttttaataagaatctcagattaaacttccaaaaacctcttgagactaggaagccaacccaaggcccgcttcagactttgcctgcattccctatgggtttattctatgtatattctcaaatataacatcccagtcaaagccttggtaatataaccaatgttttcaaatgtgtcctgttataaagagagcagattcttactaaacttgtgcaaataactttattaccataaacatatgaatattcatgaatagattcccaattctggggcactcagagagcaaaagcaaatgtttcaatttttgtttacaaaagtatactttaccaattgctgaagaaaaaaattcataaatctggaggataaaacattcaaaaaatcagcacattttccaataaaaaattatgaaaacattatccttttgttatttagtccaatgaaatggagttcttttcttctttgtcttgaatttcatgaaggtatcagcctgttcatcaaaattttgaaagttcttagtccagtggtatgatcttgaagttatcaggaacttgtattcaagagtccttttcatagtcttttccataaatctccttgaagaaaaagcaattttggactgtagctgattttaaatactttgaggaagaatcaaagcaactttctgggaatgacaaagatttaaaatgactatgtttaaaaatctaatgagaatttattatggtaaagacacagctcacatagaaatctagttacttctgtggcttatgacactatggtaacatatttgatttccagaaatttcatataatttttagaacactcatttttttaaattttttttgagatggagtctcactctgtcatccagactggagtgcagtggtgcaatctcagttcactgcaagctctgcctcccgggttcatgccattcttctgcctcagcctcctgagtagctgggactacaggtgcctgccaccacacccagctaattttgtttttgcgtttttggtagagatggggtttcactgtgttagccaggaaggtctggatctcctgaccttatgatccacccacctcagtctcccaaagtgctgggattacaggcatgagccatcgcacccagcctagaatactcatattattaacattcccataaatattatttagagaaggtttagcatcacttatcccttatttgaaaatgctttctatataatgtaatatataaaataaggtggcttttccattcagcttctgtttctcaagaggattactgagttcttggtgtagcccattcataaatagggccaaaaaggtatagtcttatgtatgttgaaaaagatccttaggtaattccagtacttctagctgaaaatcattcatttagttttaagttctacctattgcaacaagagttctccatccttgttacatgttagtagtgtcagggaagacttaaaaattaccaatgcctgggtccgtctccagacctttaaactggaactaatgggtggggcttgagcatcctcttttaaaaatgttttccagtgattccaatgtgtagctctatttcccatcagatttctctgatttcttgtggcattcaattttttctattttggtatcatgattattttcaggtctcatttcctgtcttaggctttgtgtctcctggggtggggcccttgccttcttcatttctgtatgttttttgaacacatgaactgatcatcaggaaaagatctcaaccacacataggttgtgtcctgagtctcaggttcacatgttaatcctaaagtctttgttctccacgaggtcagatgttgcttgtgatgaagggtgtggttaagtctgcagtgcagatggtggaagggatttcactctgtttttagacatagcattggaactaagaattttatgtctatatgggtgaaggggcagggatgtgtaggaagacagttctaattaggatggaggaattatactaggaagtagaggtaaaggaagtgagaaggcttagtaaatagaagaaatgtgaacttatcaaataggctagtgtatacccctggagattcttgattaagtgaattaactagattttagaaaggtaatgaggcagttatatgcaaggaacatttcaaagtctggagacaagaagtcaagcaatactttgagaagtggttgagctttatgggaatggagagaattacactattgagatatgttaaaaataatgaagaaggtttcaccatgtgaaattgtgtttctcatttgaatctgagaaacaaatgagcagaggctggagataattatgtctaaaagacagtggggtacagggagcataaaggccagggagaaagggaactgcaggaattagtgctgagaagcaggagttagtggatgaaggaggagatccaggcccagatacaggcaaataagtcatttccctctcccaagcatggcagtcagccctgcaggaaccaggataagagaaaaggtcatcatacctgccagtcttcctgaaatacaaaaatgacatcacggctgctacgttggattattgaaagcaaaagttcctaatcctggaggagctgtcatggaaagaaaagaaaagaaggaatgaaggtgatgttattttacatgggggagcgtcaggaacaagcatgtaacatgagatactgtataattgtttcttcaaggactacattatttctgttggaaaattgatgggagatgattatattcttgcagttttttttccctctcaccatgtttctcagttggtgatcagtcctctgtcaattctctactgcactcaggtattttggaaggctttcagacgtgagaaaggctgattgctattttctatgtcattggaacttgtcacctttgcaccttttcatggttgcatctttttctcagtgtctctgttgtggcagtcatgaatgagactctgtcagatctccatggcagggacctgattgacagaaggcccaggtcagtgcatttcaaattcaccacctcctttgcacagaaagcttctttcctacaggctcccaggaagggtgtgaaagcaagcctagttctctgaggctctctttaacgctaatgggtgactggttggaggattcctcatcagccttgcaaaaactcttagaattgcattggtacctaaaacttctttctctttctttttcacaggaatcagctctgcatagtggtctgtgggttctcctgtactaccttcatgcctgccccacattccctcacaggtgtcttccgtgataaattatcgtttaggtctaatcccgtcttggatgcatctcagttggtaaaaactaacataccaggcttgattctttgcagttagctctttatctttctctcccacaagtagtcagtagccttgttctagtgttttatgtgttacctctttttccatatatatatatatatatatatatggaaaaaggaaggtactgttgaggggcacttcctatgtgccaggccctgtgctaaatactttacctgtatctcatttaatccacacaataaccctgtgaggtagacattatttccattttgccaatgaaaagacagaagcttagcgtgctgtaaaaactttcctggtgtcatatggctagtgacaggtggatctgagatttgattctaggactatttgacctcaaggttaatgatgatgatagtaatatagtagctgacattggttcctctgtatgtggcatcttgtttcattgactgcatgaaacctttaaaagaatggtacgaagaaaacactctcattgcaattttcaggtgaggaatcagaggttcagagaagttgagtcttgtgcaagaaatttataactgtaaactcttacattaaaaaagaagaaagatctcaggtcaacaacctactttaacacttcaggatatgaaagaagaacaaactaaacccaagcacagtgaatgagggaaataataaggattagagttgatataaataaaatggagaatggaaaaagaatagagaaattaatgaaaccaaaagttgattcttcaaaataaaatcaacaaaattgacaaccattaactagattgactaagaaaaaaagagaaaagtttaaaattactcaaatcagaaatgaaaatggactctgagcatggtgggtcatgttttaatcctagcactttgggaggtcacagcagaaggatttcttgagaccaggtgttttgaccagcataggtaacctggggagatactgtctctacaaaaaaattaaaaagccaactagctgcgcatggtgacatgcacctgtagtcctagcatcttgggaggctgaagaaggagaattgcttgagcccaggaggttgaggctgcagtgagccataatcacaccactgtattccatcctgggctggcctacagagtgagagtctgtctctctctcttaaaaaaaaaaaaagaaagaaaaatgaagcgattactaccaattataataaaataatgattatgaaagtactataaataattgtatgccaataaattggataacctagatgaaatagacaaactcctagaaacacacaaaaatatgaataaaactataatcagtaacaagattcaatccataaaagcatttgatgaaattcaatattttttcataagaaaaacattctaagaatggaaggaaaccacctcaacataaaggcaatatgtgaaaaacccaatgctaacatcatactcaatggagaaagactgaaagcttcccctctatgagcaggaacaagacaaggatgcctgcttttgacacttttattcaacatagtattgaaaggtctagtcaaaaaaattaggcaagaattttaaaaaagacattcaaattggaaggaaggagtaaaattatttctgtttacagataacttgaacttatatgtagaaaatcctaaaggtggaacaaacttattagaattaataaataaattcagtaatgttgcacaatacaaaatcaacattcaaacatcagttgtatttcaatacactaaccatgaacaatctgaagggaagttaagaaaaataatttcaatttatattaacctcaaaaagaataaaatatttaagaataaccaaagaggtgaaatgattatacctgaaatctgcaaaatattgctgaaagaaatgaaagacaatatcaataaatggaaagacattttgttttcatgaattggaagactcaatattgttaggaggacagtgctacccaaagtgagctgtggattcaatgcaattccttcagaatctcagtgacatttttgcagaaaaagaaaaatctgtcctaaaatttatattgaatctcatgactctaaatagacacacagctttgaagaggaagaatgaagctggaggactcagacttcctgatttcagcatttactacaaagccccagtaatcaatacagtgtggtactggcataaaggaggacatagaaattaatgaaatatcatagcccagaaagaaatgcttgcatatatggccaaatgattttcatcgagtgtgccaagatcattcaatggggaagggacagtgttctcaccaaatggtattgggaaagctggatatccaagggcaagaagagtggaacctttacctaacaccatgtacaaaaattaacccacaataaatcatagatctaaatgtgagagcaaaaactatacaactcttagaagaaaagcttcatgatactggatttcacaataattccttggttgtaacaacaaaagcataggcaacaaataaaatcaataaatcggacttcacaaaaatcaaaaccttttatatatcaaagaacattatcaagaaagtaaaaaggcaacccatgaaatgataaaaatatttgcaaattatatgtgtgataagaaattaatttccagaatacatgaaaagctacaagtcaacaacagcagacatccaaaaacccaattaaaaaatgaacaaaggattaaaatggagttttatccaaggaaggaacacaaatatccaataagcccatgcaaagttcctcagcatcatgaatacttagagatatacaaatcaaaaccacaatgttacaccacctcacaaaatttaggatggttttgataaacaataacaatgacagcaacacaaaacaacaggtgttttcaagtagatggaaaaattggagctctagtgcattgctgatgggaatgggaaatgttacagccactgtaaaaattggtgtgctgtttctcaaaaaattaaacaatgaattaccatttgatccagcaattccacttctggacatactccccatagaattgaaagaaatttgaacaaatatttgtacactgatgtttagagaagcattactcacactagccaaaaaatggaaacaactgaaaagtccattgaaagataagtgtgtaggcaaaggaggtgtatctatacattgaaatgttattcaaacttaacaaggaataaaattccaatatatcgtgcaaaatggatgaaccttgaagatattatgctaactgaaataagccagacacaaaaggtaattattatataattccatttataaaagatagagtagccagttacatagagacagaaagtagaatggtgggtgctaagtgttagggggagaaggagtgagagttactgtttattgggtacagaggtttaatatggtaagaggaaaaagttctggaaatggatagtgtgatggttacataacactaaattgcacacttagaaacagttaatggtaagccttatattagatatatatagtgtctggtagtcttaccctctctataattacacactttttggcactgcccctttcctgccatgcagagccccaggggtgaatcttcctatttctccagctctgcatcagtcactgtactcagtgctgtgtcccacgtgctgtgcccacagcctcatacagccagtgacttcagagccaggacgcagctcaggagtctgccctgaggttgcttctcttcttatttccttgcagcctggcccgggggaggcttggcttgaactggcagctcaatttagccaaattcaggacaggccaccaggactctttctccacacatgctggtcccaccccaggttgagtgaggcagggccagtcaccagaggagcccggagcagagcaggaagcagagtctgagctgctcctccctcacccaaggggcttcctcctctcatttgggggaaaagtgtgagcttgtttcaaagcctcagatgttccttgtagttcatggaagaggtacaagaaaacaaagacgtgacagaaggggatgagttggtgacagtgagaagcaactcgatgttcagcactctccttcttgtccctctgtgaagcctcttctaccacatagggctcagggctgataaagccccctccctacctttctcaggccagacacaaggtcagtcatgagaaaacagaaaaaaaaggagaagagagtctgtagagacaaattgggagggttcaggaggagaatttgggatttgcctgtgcccatgggacacaggctgggaataaaaatgttttcctgactcttctctgaaagctagatagactccacctaaaaccctattgccaaggatgctgggatccacttaccaatgactctgattgtcaaggatgtggagctttcctcgccagtggctgagttacgagcagagcaagcatagagcccattatgctttggagtaatctgagggataaagagcttttgtcctgatagctgaaacttcccattaattgtccaagaatactgtgctggtgggttagagtttgcgaagcaggacaagtcgaggttctctcctgaatagtaagaggtgactgaagggaaaattctggggaggtctggaccatctggaggaaagagaataaagccacagttgatgtcatctgagggaaggggaagctccttgtctcttaaagggacacagtgaccctctgagccaagacacaccctcaagtcccagccaaaccccctctatgttcactgagctgaagcctgaagtattcacctgtttctcccaccacaagctgtgggccccaagtctcccatgacaagagcatcccctctccttatattcttggttaaggctgtgtctacccaagttttcccagggcagggagtcatggccacctcggatgtccaaaagtaaaggtgtctgtacttggaccggagagagactgagaggcctggcccctggtcgtttggatttaagctggtgtcctggcccacagaggaacaaaagatacagaggacattcagggtgactgagtcactgcggatgccaccatatcggtcccgtatttcacattgatagggtcctgtttcatttctcgtgacactgggtagaatgaggatcctgttttcaatgggtcgctttaccctgggactgaccgggaggctctgacaatttagccaccaaatgtaggcatagttctcactcttaggttcacaggtgaaggttaagacatccttattctccctggggtttaagttgttgatggtgatgtagggcatgggcagctttgctgtgtggataacagagagaagattgtcctgtgtggcacctttgattcctccacaggcatccttcaatcagagttggcatctcccacctctcagcccacccgagtccttgaaagccaatagctggtgcgtgtgtcacaagacagatgcatgatgatctaagggctcaaagactgtgaggccgcctgcttcatcttaggaaagcacagactttctgaagtgtcaattgagcagcagtgttgggtcatggacagatacgtcagtgggagtcacagcccctggtacccctcccagtccctccataatcagttgactggctggctcaccttgggttccttacctggaatgtgcaactgctgggccccttccaaattccatcctactttgcccccctagatgtgatttctctgcagcttccatttccaaggacattctagagatcagtaataatgggacttcccattgtcctgaaaccctgaagatactgagcagcctggcctgggactggatgtttcagcagaaataacacaggggagaccagagtcaagcctggaggtcagttcagtcatcaggcagtggaggcagaaagtggggcagtgttttgcaggtgtttcatgatgacttacttgaaccagtgacctctaaagatagagcagagcgcaaggaatgatctaggaagagtgaaggggataggcaagagctggtggctttggagcagaaccatgttccctgtcctgggtcctttaagtttcctttccttctgcagagggcaggtgaggaccatgtggatctttccagaaatacatgtggacatttgcaaatgcagaactgactggtggaaagggtgggaatgaactgctggaaatctggtcctcatggaccatatgtgtttgatggatatgagacaaatttggagaaaagttttgcaagtagtttctttcattggatattctactctctgatcccctgggttcgactactctagggacctcatgtaaatggattccagagtgaatatgagaagagactgctggttgccaggagctgggagtggggagaatcagaagttgttcatgggtgtgcagtttccgttatacaagttggggagtttctagagatctgctgtagagcttgatgcgtattgttcacacagattatttcttatgcataagacttaggacaaaaagtgttttggatttctgacattttttgattctgaaatatttgtcatatacttactggtttagcatcccaaatctgaaagattcaaaatctaaaatgcttcagtgagaatttcttttcagcatcagattagtagacaaaagtgggaagtgataagccaaatatattcttgcccttttttttctctcaccacatttctagcttggtgattagttttcggtgaattccatactggccatgctgcactcatatatatttgaaggctttgggatgtgagaaaggctgattgctattttctatgtcatcaaaactttccaccttttcatggttgcatctttttcacagtgtttctgttgtggcagtcattaataagtgcctgtcaggtcagatttaggacagagttttctaattctgcaaaaaatgttactgggattctagtaggggttgcattgaatctgcaactcactttgggtagtattgtctttctaacaatattgattcttccagtccatgaaaatgaagtgtctttccatataatgatattgtctttaatttctttcagcaatgttttgtagttttcaaggtataatcatttgacctttttggttaaacttattccaaaatattttattccttttcatgttaatgtgaattgaaattctttccttaatttcctttcagattgttcattgttagtgtatagtctaaagaatgatctagaaagagtgaaggggacaggcaaatgctggtggttttggagcagaaacatattccctgtcctgggtttttgattttccctctccctttgcagagggcaggtggctcttccctgatagctagatagacttccctggaaaacatagtgccaatgctccagggatccacttaccagggactatgatcctcttgattatgagatttgttccaccagtggctgagttatggatgaaacagacatagacccctctatatgttttagtgatttggggtatgaagaacacttgtgctgattgctggaacttcccaccaatcagccaagaatgctctgccagtgggtgagtgtctatgagacaggagagcttggggacttcccctgtatggtaataggtgtatgaggaagaaatggtgagggcatccaggccatctggagcaaagagaataaagtcacaggtgacattgtcagagggaagggaaaatcctggtctgtggaagggccacagtgaccctgtgagccaagtcgcaagactgaagtcccagccaaatcctcgctgtgttcactgatctggagcctgagacattcacctgtttctcccatcacaatctgtggaccctgagcctcccatgacaggagcagcctcttttctcccactgtggatcaagcctaggcctactgtggtttgtctggggcagaaagtcatggccagctttgatgtccagtggtaaaggtctctgtacttggacctgagagggactgagaggcctggcctctggccatgtgtatttgggatggcagcctggctcacagaggaacagaagatactcacggaggagattcagggtgactgggtcactgcggctggcactccctgagttccatatttcacattcatagggtcctgcagtatactttgtgacaccaaatagaaagagggtcctgttggtttcagacagctgcatcctatgagtcatagggaggctctgaccattcatccaccacaggtagcttgcgtccggagtctcaggattacaggttaagatcacagtctccatggcctccctggggtttaagttgctgctggagatggagggcttgggagtctccactgtgcagaaaacagagagaagattgccctgtgtggcacctttgattcctccaaaggcatttttcaatcagaattggcatttgccacctctcagcccacccgagtccctaaaagcccatggcaggtgtgtgtgttacaacacagatgcatggcattctgaaggctaagagattgtgaggctgcctgctttatgtgggagaagcacagactttctcaggtgtgaattgagcagcagcattgggtcatggaaagacacaggaccagcagtcatagcccctggtgcctctctgagtccctccatctccaactgcctgcctggcccaccttttggtcctgacttggagcatgcagtgctggaatcttcttagtttcagtcttacttttccccccaaggtatgttttctctgcagcttcccttgccaaggacatcctagagatggatgatggaacttcccattgtccttaaaccctttgggtactggaaagcctggcctgggactgggtacttcagcagaaataacacaggggagaccagagtcaagcctggaggtcagttcagtcatcaggcagtgcagccacaaggtggggcagttttcccaggtgtctcatagtgactgacttgagccagtgacctctaaagatagagcagagtccaaggaatgacctacaaagagtgaaggggacaggcaagagctgatagctttgaaccaagaccatgttccctgttgtgggtctatgatgctcccttcccccagtagagggcaggtgaggaccatgtggatctttctggaaatacatgtggatgtttgcaaatgcagaactgactggtggaaagggcaaacatgaactgatgatggaagtctggccctcatggaccatatgtgtttggtagatattagaccaatatttgggaagaagtcttgcagatactttctctcattagacattctaccctctgattctgagtttgactactctatgtacctgatatcagtggattccagagtgaatcagagtgtagaatagtagtttccaggagctgggatcaggggaattgggtgttgttccgtgggtgtgcggtttcagttatgcaggacgaggaggttctagagatctcctgtacagattcatgcctatagttcatacagataaagtgcttcttatgcagaaaggttaaaacaaagtgttttggaattctaattttttttattttggaatatttgcagtacatgtactggtttagcatcccaaatctgaaaaatttaaaatccacaatgcgccagtgagcacttctttttagcatcacatcagtggtcagaagtgtaaagttttggagcatttcagattgtggatttctggatttgggatgctccatatttaatactgtaattatcccataaaaagttgtcaggagattagacctcatgttgtgttctgactctagtaacaaaaaaaaaatttggaggaaacattaaaatgttttcataagtggaaatttttactgatggtctaaacatctaagatcaattgctggtagtagtatttctcttgagaccaacataaggtttaggtgtgccatgaattccagcaggatcacattatgctcaaagaaagatgccaaaggtgatttgaaattagcagctccttaagtagagagagtcccgttaaaaggacagaactggtcagtgcatcaattacataaaaggaggaaggatgccaaattaaaagaagtgatgtgtgttatgttagtaaatatagaaagaacttcctgcttctaatttctgtgcagttaggaaaaatggggaggaccccaaaacaggtatgtgaaatgctttcttcattttctgttaagctcaggaaacaccactagagtttaagtttgtgtgaattagaaggagtctaagtgagatgccaatggctcatgtgtctccccacacgaagaactccaacttatgaaaacggcatcatcatgaggaaacagttgtatgtggcacaggcagtaaaaccatcagatagcacccacctggccacctccaactagtccccaaaaccaccagtattcctcttaagtatgtgttacagcctttgtagttgtcccacagctacaaaattttaaaaatgctattgtcaaaacaaaatattaaatatgaagttgaatatgttgatccactttttttccctactctttttggactttcctgtttcagttttggaaatttctattgacacatcctcaagctagggattccttcctcagctgtgtgcagtctaccagtaagcatcaaaagaattcttcatttctcttacagcatttttattttttctgagagagactcttgctctgccaggctggagtgcagtggcatgatctcagctcactgcaagctccacctcccgggttcacaccattctcctgcctcgacctcccaagtagctggtactacaggtgcccaccaccatgcccagctaattttttgtatttttagcacagatgggctttaaccatgttagccaggatggtctccatctcctgaccttgtgcctgccccagtctcccaaagtgctgcgattataggcatcagccactgtgcccagccatctcaaagggattttaatgagttgttgacttttgagtttgttcagctttttacttagtgttagaaccgagtgacaaatttcaagcttgtcatatgcctgacacgaagccagaagtctctaggaagtgatcagagaatgtaagctccatagcacgttgacgatggagtcatgagtgaaacaggtgaaatgagctcatgggctttggagactgcaggcctgtccagcctctgacaccctggtgagtcagtgcagagattacaacagtgacagcaaactagcatggctgactccatctggcatctagtctcaggctggctgtcctcactcattcctgcacatagacaaggctaaccttgggagaaatttagtttatggtttaactttgaagcaagaatgataatagttcctccataaaactaacacccttactttgcccagggactgcctttgtcaaactagtgaaagaccatgagatttagattataagagggaactgaattctgctaaaatgtatgcacagtttctataatccctgactgctgcaatgtcatttggcaagggtttacaaaatttgtaactaattgctcctatagataacatcactattgtagaacgtgagattggtcttttgagatgcttctcattcttttgcattctggcaaccagctgacctcatccatacctatgactaatggctcagcccgtcatgtggtccctacctagaggcagattcaagcacaaacagatcatttccctccgcccgcatgattccatcaccaacaatcagcagtactcattttttagtcctgtgcccctgaaactatccttgaaaatctctaagccctgatccactggggaggctgatttcagtaataataaacctctgtcctcctgtttggcagacttggagtcattaaaatctttctttactaaaaatcaccatttcaataaatttgtgtgtttgtgtgtgtgtgtgcaggaggccagaagaacttgtctgacaatgataagagtggttggagggacttcctatccctgtcccatggtcttgtccacaggtcagcctcacaaaggggaagagcccttgatgggaatacagtggaagctcattctcttagtgacctggggacattggctcgagatgaagcctggcaggagtggcaactccaggtgatttctgcacctttcctatttcctgggaggtgggccaggccacagtgttagcgggaagggaatagaacagccagcctagttagagggagtgtctggggaaggcctaggggtgggggaagaagctgtgcaggacagggcttgccagtcagaatgaagtgggaggaagatgagggacacagagaagcagagagaggcagagacaccatggcagtgagcagtgagggagacactgacttcagagcccccaggaaccagctgcccccagttccacagtccaggaccaaggagccccgagaaccctctggtggccaaagagcttcagagttacatgaggtggggtggctttaggggcaagaggtagtggggggatgaaacatgggtgtcagcctctgaaggacaagggacaggtgtggctagaacctcctaggattctgcattcaagatccagtctctaaagaggttttggatcattcatttcttcattccattccttcatttgttatgtgagagctcctgagtgtgtgtctctcgctgggcctgtgctggtgtagggagtgagtggggaaagaaaacaaggtcctctccttgatcctctcatgacagtgacatggacactttgggaaacacagagtttcaggttcagtgatgggggttaagatctgagggggaggcctggacattttttttgcactgactttgatggttgaagcaggtgatttagttctggagtatagactaatcagctgaccatttgctctcactcctctgaggtttggatgcctaagaagagaggatttgagccaataaatgactatggggtgcttggaacccagtaagccctcacttctggtggaggagaggatgggcctgtggctgcagacagacctcatgtgaccctgatctcccctttgcgtttgtgtgactctgattcagtgactgtgccttcctgtgcctcagttttctctcaatcagataagttaaatggcaaatggactgtggcttttcatgctatctgtgaataaatgttaaattattcacagtcacctgacctaatgcttggcacagtggaggtgttcacacaagcagcatttattattaatttgcttccatgagaaagcacctttacgtcagatccctgtggacaagctgctaccaggtacatcttctctcttctgtttctgcttctgaggacattagactttctatggactgtcctaagcctcctaaggcagttggctgatgacctacaaagcttgtctttctgtcctctccactctgagtgtcaggtgaagaaagctctgtccttgcccagatgaggctctgagggctgagccctggctggtgaacagctccaggagacacagtcctcagacagctggtaaattcttggtcccagtaagccctgcccaagaagccacaacccagccctggaacaggctcctcagctttatctggaacaaggatttaggtacagagttctgggtttgaggcttctagggctgagcttctctgagagtatctcaggggcccctcaggtcaaattctactcagttctccagggtctttctcagggtcaaatttatgaagagggcatgaggtgcttggctgagactgatctcctcctgctgagtccccccatcagactgtccttcctctgcagcgagtgtctgcagggtctggatgcgggaaaggaattctgatctgttgaaatttgtctcctctgtgtgtgtcctgcactaaatgcccaaaccccagcatgggacataatgcagagagggacacaggcaatgtccaggcctgacaatcctgtgtgtgtgatgtagaagtgacccctgtcccccaacacccagggatcatgtggaatcacttacggtataaggtgaaggtgaaatatccagttactcctctagtcccatcacctcgctttatgatgtgtaaggtgtaggatcctgcgtcctcccgggtgacattctggatcagcagggatgcattggaatatactgtttctcgtccactgtatgccggtccatatataattatttgaccgtctactacatatgatgtaatgtaatggtagaggtccctgatttgccctttgtaccagatgtagccagtaagattctggggcaaattgtggacaagtagaagaacatccttcccctcggacactttgggtggctgggcttcaatcatgacttgggcagtggtaggcaagttccagaagtttaaaagtaatgctaggaggtggagagagcatcagtcaatattgagacctatgtattggggtgaaaagatggggccctgagtcctgagaaggtctcttcaatcctcagccttgaagacacacacacacacacacacacacatacaaacatacacacacagaaaaggggcatgtgtgtttgtgtatgtgtatgtgtgtgtgttctactgtcctactaggtcaaggtcagcagcatgacccccattccttcaacacttctgaccttggcatttttctgtttggaatcctcttccccaggggtccgcatggccccctccacactgccctcaggtcctgctcacatcagggcatccttagacttctttcctgacacctccttcagggactctgggtcttccctttctgacctttccctgctctgctccctccagggttcttgtcaacacctgacctcacattctagatctctttgcatgtctgacttcctccccatggcagcatgagctccgtgaggacagggacttttgtgatcttggttgcaccccagtgcctggaacaggctgcagactcctgtagatgtgagagttctcagggccgtccacgccctgggtgtttttttttttttccccaattgttgaggttttttattgaggacagtgtttcatgccctgtttatttttatttgtagtgtcatctgatatagttattattatcatttttcaaaatgtggtggcccctgatgattaatcaggaaaacagaacacctgtttcctacctcttaccaattccggttcaatgtgactttcctgttttgacccctgtccctcttgggtgtattttcccctatccaggcatcaacagggccttctttcctttttttttttttttttctctttttttttttttttttttttttgagatggagtctcgtactgtcacccagcctggcgtgcagtggcactatctcagctcactgcaacttccgccaccctggttcacgtgattctcctgccttggcctcctgagtagctaggattacaggagcacaccaccatacctggttaattttttgtacttttagaagagacagggcttcactctgttggctggactgatcttgaactcctgatctcgtgatccacccacctcagcctccctaaatgctggcttttttattttttagaaccccaggagcctctccaggagaccccatccagtcactctgcttcctcctcctgtcctctcccaggaagttctctcctcacctgtgagcaggagccccttccatttgatgtgctctgtgcagggaggggctgagaggggccccatgatctctgctgcgtgcatgttctcctctgtggagatgagcctaggatccagaagcttccagagcacggctgtcagctgtgctgtccttcctccttctgcgctgagactcttcccggtggaaggagcacttctcaagctcatgggcagggtcaggccgaggacacctctctgtcccctcctctctcagccctgcctccttgtccctccttctgtttttccttttgtctgtgtttcaggtccctgggaattgtggaggcctctgcctttttcagcagtgattctttcaccaaacctcaatacacactttgtgcggacacacacatacacacacacacagaagagacacacacagacccacacagtcagacacataccctgcaggttgggcaagcagagtcctgggcctcagcctcctgctgtccccattgctcttggtcggggtgcacattcacaccctttgccctctttcatccccgtctggctctccccttcagtgcaggaggctggagctgcaccaggtccctgtcagagtgacaccccattgtgctgtgggtgagctgtgtgttgcctggtgagagggacccttcttttctccaatcgtgtctagcttggctgcagcttccaaggatggacattgaggacctgggtttcccagaggaaactgtccttcctggaggtgtgcagggtgaatctttcatgcctcctgggaggagaggcctgtgctggttgctcagtgggggctgtgagtcccatagtcaaagggaaagttctcggtcactctgtgactccatggggtctggcagctgagctggagctcttggtttctcatgttcttcctgacaatctttgatgtcctttcttctctgccgagctgattgtcctgtggtcaccacaccttccccgtggtggtgcaggaggaagtggggagttacccaggaatcccgcgggacatgacttattgagacgcaggaggaggagcctgggacagagcaggggttcagagctggagagattcatcccgacttactccgtggccatgatgggctcagccctccatgtgctgagatacccaggggtctgtcctgagggttttgacctggccaagctgctgtgtgtagaggaggaacaggcagtggccagagatcctgtctggagggacgtagctcacacctgagagggcgggtgggggtgagttgtgttctgggagcaaagagcaataacaccccccttctccccgcaagcacacgggagacgtctgtcttcccaagagacagctgggggtaggtggccacatcccggatggtgcctgtgtgtgaccatcacacgcgctctgagccctccggggttcagtgagcaggcaggtcacagggtgcctggctgattcccggtgaggctgtgggccctcaggcagccgctattctgtgtcagcgctaagcttggcctgggatgccccagtgaacaggacagatggagcaggggtgggcatttagggagcagtgacagaaagagttgatgttgatggagggaggtcacgaggggaaagcgcccagtgtggcatcgcgtgcaccagcgctgccctgggagatgcctttagctgggcccagggaaggagcaggtgtgtggggcaggaactacctgtagggggagtggtgttaggttggtggcccccaggtcagggaggagctgacagagaccctgtggggagcatggagggcgctgaggacttagtccgaagtgaccctggtgagggtggaccctgctgggctgtgggttccgctgagggcggttggcatcccttgggaagactccaggccgggagggactctgtcgccttctggtggacagggagggaagtgtgaacggcagcaatcccaggccaggctgcatgttttattctacgtggatctgcacacttcacacaaggtcacacatatgttatgttatagctccttcaccttccagccccgtgagtcccagtctgtgtggctctacgttcactgttctccctctttcacgatcagatatcccaaacgcagatgtttgtcactttctgtgagtttgtgtttgtgtgcagtaggcggcactgtgtataccctgggggcagtgatgtctggggctgagcgctgcacttgggcttgggagaagaagacggagcagcagggtgggaagatcaatgtcaggggggcagggacatcattttcattttctcccagggaccagaacccacgattttgactccagggcacagtaccacaccctgctggtgtccctggatgtcatgatgctcatagtgtcatgttgccttggcattcattttttaagttgtaagtttatttgcctcaaatcagaggcagggcttggtcaccatggcagttttcaatactgtatctggttcaggtggctccagttggtgtccagagataaaatcttagaggcatctctcctgcttggtgtgctggactcccctctctccagctgctttctttaaactgataattctgacattcgccctcatatttaaagtgaccacctctcagtcacagcgtgagctcctggtcccagtgtttgctgctttctttgaacacatccattaaagctccctgctggaaatctgtcatataacaccctggacttaataaagccattggcttaccagtctcttctctcctccctgcctgggctcactgaactctgtgtctgcggtctccaggtgtgccgagtgctccctagtgtctgtaagtagtaaaaatactgacattttcactttgtggttgtatcattgtagcctcacatgccatccagaggctgacattgaggctgccctatgggacctgtgctggttgagcctctgctggagctcttgttttggggcctctggtactcctggggacaggagcttccaggtaacttgattgaaaaactcatgcctttcattgaaacactgggtcagatgatgtattcatgggcttcagctgccataacaaatgccttagcctgggtgaattacataacagaaatctatttttcacagttctgtgaataatgtgctattctaaccactttaagatgcacaatcaagtgaaattaaccacatacacagtgttaaattaccatcaccactatttttcctagaaaatttttatcactttaaactgaaactttgtatctttcaaacaatacctccctgtatgttccaccctagactttgatcatctctactctgtctctatgaatttgcctattcttgatgtttcatataaatggaattatacaatgatgttattttgtttctgacatatttcacttagcataatgtttccatagtccatgcatgttccagtgggtgtcagagcttcattcctctttatggcagattaacattctgttgtatgtgtcaccatatttatttattcatgcattgatgagcacttggattgttttcatatttaatcttttgtgaataatgctgcaatcaacactatcatgcaagtacctgtttgagtcctggatttaattctttgggtatatacctaggaatggatgttgtttcaaatgagaattatatgattagctttttgaggaacagcaaaactgtttctcctagaggctgtacctttttatattctcacgagcaatatatgaggattccaaattctacataatactgctacttgttatttaacattttaaaagaatggtaaccagttttgtagatgtgatgtggtgtctcattgcagctttgactttgtgttttcctgatgactaatgatgttgagtatcttttcatgtccttcttgactctttgtatatcttctttgaagaaatgtctatttgactcttttgcccatttataaattggatgatttgtcctttctttattgagttgtagctagttctttatattatctgaacatgaaaactgcctatatgtggtttgcaaatattttctctcattctgtgtctattaattactttcttgataatttcctttgatgtacaaaatgctcacatcttgataaagcccaatatatcttgtttttcttctttctcatgcttttgtatcatatctaagaatccattgcacatttgaggtcatcaatatttacctctatgtctactttgagatgtttttatggttataggtcttatatttaactcactgatcaattttttagggaattgtttgatacggtgtgaggtagagttatctaaattcactgttttgcatgtggttatctagttgtttctgcactatcattagaaaggagaattgttcctccattaagttgtcttgacactctcttcaaagactaattgaccataagtgtgagggtttgcttctagactctcaattctatcccatttgtctttatgttcattcttttgccagcagcttgttttaataattgtactcctttgtgagatttcaaataagaaagttcaagtcctacaatttattttggcaagattcttttggctattcagggatccttttttgaaaggtggggaggcgaatgtttcaccattgggaaagccttttctgtcttcttcatggggaaatttgggagagccttttaaaaaactttatctaagtaggtaaactgtcaccactttatttgctgaagtgctatgttaaagtgtgccttgcctcttgtggaagaattgtgagaccctggaagcacttgcccacgtggtgagagacagtgagttccacgatgaggggcagagaggacattgttttgggatacaatgttgttgggggaggtgtatacatctcaacttctttatgtctctgtgcagtgggtgtagggagcagccccacagggtcggtgggtttttctccccatgtgcagagatgagagattgtagaaacaaagacacaagacaaagagataaaagaaaagacaactgggcccgggggaccactaccaccaagacgcggagaccggtagtggccccaaatgccaggctgtggtgatatttattggatacaagacaaagtgtcaggataaggagtgtgagccatctccaattataggtaaggtcacatgggtcacatgtccactggacagggggcccttccctgcctggcagccaaggcagagagagaaagaagaaagagagagagagcttacagcattatttctgcttattacagacttttagtactttcactaatttgctactgctaactaaacggcagaggcaagtgtacaggatggaacatgaaggcggactaggagcgtgaccactgaagcacagcatcatagggagatggtgaggcctctggataactgcaggtggacctgagtaatgtcaggccctccacaagaggtggaggggtagagtcttctctaaactcccccagggaaagggagactccctttcccagtctgctaagtagtgggtgtgtttccttgacactgaggctaccactagaccaaggtctgcttggcaacaggcatcttcccagattctggcgttacctctagaccaaggagccctctagtgcccctgtctgggcataacagaaggctcgcactcttgtcttctggtcacttctcactgtgtctcctcagctcctatctctgtatggcctggcttttcctaggttatgattacagagtgatgattactctaatgttggaataaaaagtaattcctaccaactaatgattaatgatattcacatataatcatatctaagatctgtatctggtataactattcttttatattttatgatactggaacagctcatgccctgagtctcttgcctcagcacctgggtggcttgccgcccacaagtgggcacctccattggacacagtaggttttgaaatccttgtttatcctctggggtctgggtcttggcttacctgttagctgcagctgaaagaggtgtctgctaaggcaatgacacctgtggggagaagaagggttcagcagagtgaaagcagctggggctcagaaaagccaggaaagtctgactcttagaaactgtgggttagcagatgggtgtcctcaggggtaaatgggccatgccagtagccactgcagtggactggaagaaggtaagtgatgctgggtatcccatgttctgtctcagctctgcagctgaagatttgggccctatgctggtacggccctgcagcaggggaagggtacacaggaatggctgcatatcaggaccaagtccatgtcatcttcttaggcattgttactgcagatggaggattctgttcagagacctggcctggacacatgggagggcccaccccattcttttaaaattattttaagagaacagtattagcaaatgtggtacatgttttattctgctagaatcagcattactgtcacgttttacaacgtatctcttaggaaatcatgagagccatccacacaatgtggatttaaaggggactctactataatttcagctttcctactctttatagaaaccatcttctctgcaaacacacaggcaatatctctgtgttcatttctattgggagccctgtatgcaaggtggagagagccacatttccccgtgagatgttatgtaaaagtttgaggttgagatgacatatctgacactctgttgttaccctcagaagctactacatgtgaaattctaatgactgcattatcctgccaaatgaaagaggcatgcatgagcaaggacagttaagaggggcgagagcctcatcatgatggggagtcttattttgacatcttggggagaactgtccacagtgtgaagtcatcaacttgttgtcctggtttacagtttgagcatctgttgttatgctgtccaacattttggtgagttctgagtggctcacacttcaggtacaagaattttcccatgaaatttacattgagttgtcctcctcccacttatagggcttctggaacagagtgggtcttggtcttagtgattccatgggagaaaatggaattggaggaactagtagaattcagggtaatgtccagtctacaggtgaataataaaaacacagaaacaatgaacagagctgcaatctcataaccggtatactacagtttttattttccacataatttttctctctatgggcatctctagttttaccaatgataatttcagtagaataagtttgtttgcaaaataagttgagtttcttcaaacatagtctgattctttacataagtgcagcaagagtagcaatgagccagataggctctcttttaaaattttctttgctctaagtttttataaggaatctgagattagacttttacaaacctcttgagaataggaagccaaaccaaggctgacttcagactttgcctgcagttcatattggttcattctaaatatattcttaaatataacaacccagtcaaagccttggtaatataacaaatgatttcaaatatgtcctgttaaaaatagagcagattgttactgtacttgtgcaaatatgtgtattaccttaaacatatcaacactcatgaatagttgcccaattctggggcagtcagctagacagcaaaagtaagtgtttcaattattgttcccagaagtatagtttattgaactgctataagctatagatagattaaaaaaattccatgaatctagaaaataaaacatttaaagaatcagcaaattttcaaataaaaatcttaaaaacattatcctcattatgatcaattatttcaatgaaatcaatgtttttcctgcttggtaggcttagaattttctgaagatatcagcctgtttgttaaaggtttgtaagttcttagacagtccagtggtataatctgaaagttatcagaaacttgtattaaagtctacttgtcagcatcttttccataaatctccttgaaaaggaagcaattttggactgtagctgattggaaatgctttgaggaagaataaaaacaacgtgtgtgaatgacaaagattttaaatgactatggttaaaactctgatgagaattcattatgataacacagctcacataaaaagttcgttacttctgtggtacatgacattatggctgataacataattaatttctaggaatctcatacaatttctggaacaatcatatcagtaacatatccataaatataacatagagaaggtttagcttcctttactacttatgatttgaaaatgcttttcagataattttacatgtcaaataaagtggcttttccatgtagcttgtgtttctcaacaggattattgagtacttggtggaggacattaatgaatagggccaagaaagtataggcttatgtatgctgaaaaatttccctagataattccaatactcccagctaataatcatgaaattaggtctaagttttacctattagaacagctgttctttatcctggttacacattagtagcatctaggaagacttaaaaattaccaatgtctgagtctcactttagaccattaaattggatcctatgggtggggcttgggcatccatttaaaaaaacgttttccagtgattccaatgtgtagctgtatttcccctcagatttctctgatttcttttggcattcacttttttctattttggtattataattatttttctggtcttatcatctatcttaggctttatgttccttggggtagaaaccttgcttcttcgtttctgtatctttcatgaacgtatgagagggtcatcaggaaaatgttttcagtcacatgtaggttgtgttctgagtctcaggttttcacattaatgctggagtcattgttctctgggaggtcagaggttgcttgtgatgaagggtatgggtaagcccataatgcagatggtagatgggagatcaccctgtttttagccatagcactggaactaagcattctatgtgtatatcaggtggaggggaagggatgtgtagaaagagagatttagttacaatggggaattactctagggaatagaggtaatggaagcaatacaaattagtaaagagaagaaatgtgaacttatcaaataggcaagagtagatccctgaagatttttgaataggggagttaactagaatttaggaaggtaataaggcagtcatacacaaggaaggtttcaaaaactggagataagtcaagcagtacctctagcagttgttgaggttgtgggaatggagagaatgacacaagtgagagatgttaaaaaaaggatcaagagggtgttataaggtattgaatctgggagacaaatgagcagaggctgaggataatcatttgtaggagacagtggggtacagggagcatgaagaacaggggagaagagacctgcaggaatgagtgctgagaagcaggagtttagtgggaggaggaggagatccagtcccagatatgggcaaagaagtcctttccctctcccaagcatggcagtcagccctgcaggaaacaggacaaaaggaaaggccatcatacctgctagtcttcctgaaataaactacaccagggctggtagatcagagccacactggccagtactccaatcatgatgctgacagtggctctacctgaaaggccaggacaacttcctttcactgaagtatctgtcatggaaagaaaagaagagaaggaataaaggtgatgttattttacagtgtggtaccttaggaaccatcactaagtatgaagtagtttctacttgttcctttggggattacattaattttgtgggagggttgctggtagatgattagccaactatattcttgcagattttttctctctcaatgtgtttctaggttagtgatcagtcttctgtcaatttcatcctgaccttgctcactcagatatttttgaaacctttatgatgtgagaaaggctgactgctattttctgtgtcattagaactttctacccttccatggttgcatctttttctcagtgtgtcagttgtggtaggcatgaataagactctgtcaggtctccatggcagcttgtgtttctcaagaggattactgagttcttggtggagcacattaatgaatagggccgagaaagtataggcttatgtatgttgaaaaatgtccctaggtaattccagcactcccagctaaaaattgattaattaataatcaattgacttgattgacagaaggcccagatcagtgcatcccaaaatgacaacctactttacatagagtcctcactttcctgaagctcccagcagggaaatgaaagcaagcccagttctatgagcctctgttttattctcctgggtgactggtgggaagactccccatcagtcttctcatgctctgtttgaactgtagctaaatcttctttctcttttgccttcacaggaatcagatttgcctagtggtcccaaagctccccaggcttttttcatgcctgccccactttccctcacaggcatttttcctaatacattatcctgcatgtctaatctcatcttggatgcatctcagtgggcataaactaacataccaggtttgatttttttgcacttagcttttttctctctctcccacatgtagccagtaaccatgtcctagtgttttatgtgttacctcttttttcatgtgtatagaaaaaaatgtatatttccatatacttatttatacataatatatataataaaatatgtaatataaaatgtataataatttaaaacatatacatattttctatatatgtatatggaaaaagaggtaacacatgaaaaaccaggacatttacatataataaaattgacatatgttatatatgtatgtagtgtctggtagtcttaccctctctataaatacacaatttttgtcactgccccttccttccttcccatgcacagctcccatggccaaatgtccctatttctcaaagtgtgtgtcactcactgtcgtctgtgctgtgtcccatgtgctgtgtccacagcctcctagtgttttatgtgttctctttttctatatatatggaaaaagcatatacatatttctctctatagatttatatacaatatataataatctaaaaatatagaataacaatttaaaatatgtacatatttccatatctatgaaaaaaggtaacacataaacactaggccatttatatataaaatccacatatgtaatataaatgccaattttatcatatataaataagtatatacaagatacacttaacatatataaggtaaatttggaatgccctgaccagggccctctgtcagtcaagtccctgccatggaggccattcatggctgccacaactgagacactgagagaaagatgcaactatgaaaaggtgaaaagttctaaagtcatagaaaatagcaatcagcctttctcacatcccaaaaccttcaaaaatatctgagtgcagcatgtccaagatggaattaaaaacttcaatcttcaaaaggaaaaaggtagctggaggactcacactttcagatttcagcatctactgcaaagctacagtaatcaatacagtgtggtactggcataaaggaggacatagaaatgaatgacagggaatagagagcccagaaaaaaagcttgcatatatggccaaatgatttttgtcaagagtgccaagaccattccatggggaaaggacagtctttttaacaagtgatactgggaaagctggctatccatggacaagtatgagttgaacctttacctcacaccatatacaaaaaaatgaacccacaatggatcaaagacctaaatggaatagtgaagactaccagactcttagaagaaaacataaggaaaaagcttcatgatattgaatttcagaatgatttattagttacaactacaaaagcataggcaacaaaaaagggattaattgggcttcatgaaaattataaatatttatatgtcaaaggccattatcaagaatgtaaaaaggcaaactatgacatagggaaaatatctgcaaatcatatatctgataagggattaatttccagaatacatgaagaacactacaaatcaaaaacagcaaaaacacaaaagcccaattaaaaaatggacaaaggactaaaatagagattttattaaagaagatatacaaatggccaatgaggacatgcaaggattctcaatattactaatatttagagatatgcaaagcaaaaccagagtgatacacgacctcacacacattaggatggctttgataaaaacaacatgaacaacaacatcacgaaacaagtgttttcaagtacgtggaaaaattgaagctctttgagtattgctgatgggaatgggaaatgttatagccattgtagaaaaagtggcatggcacggccggctcatgcctgtaatcccagcactttgggagccgagatgggtggatctcttgaggtcaggagtttgagaacagcccggcaggcatggtgaaaccccatctctactaaaaatgcaaaaattagctgggtatggtggcatgtgcctgtaatcccagctactcaggatgctgaggcatgagaatcacttgaacctgggacgtggaggttgcagtgagccaagattgcaccattgcactccagtctgggtgacagagcaagatcctgtctcaacatcatcaacagaaaagaaaacggtatgtcagtttcttaaaaaaattaaagcattaccacttaaaccagcaattctacttctggacatacagccaaaagtattgaaaaatatttgaacagatatttgtacactgatgttcacagcagcattattcacaatagccaatgggtggaaacaaccgaaaagtctattgaaagataagtggatgaacaaaaacatatatccatactttggaatgttcttcaatcttagcaagggataaaattttgacacatggtgcaaaatggatgaaccgtgaagacattatgcgaagtgaaataagccagacacaaaaggataattattatatacttccatttatgtaagatagttagaatagtcagttacttagagacagaaattagaatggtgattaccaggggttaaggggagaaggaatgagagttatcatttattgggttcagaggtttagtatagtaggataaaaacagctctggaaatagatagtgttgatagtaacacaacagtaaattgcactcttagaaacagttaatagtaagtcttagatacatagtgtctggtactcttaccctctctgtaagtacacactttttgtcactgttccttccctgccatagagagcttctgtgagttaatctccctatttctccaagtgtgcatcactcactgtcctctgtgctgtgttccaggagctgtgtccacaaactcagacaggcagtgacttcagagccaggacacagccctattcccattttttaaagccttacccatgggaggcttggcttctactggccgctcgatttagccagattcagaacaggccacccaggcaccttatccacatgccctagtcccagcccgggtggagtcagggcagggtcggtcacttggcgagcccacagcaatgcagggagcagagtctgggctgcttctccctcaacaaggggcttcctcctctcatttgggaaaagggtgggcttgttttgaagactctgatgttcatcgcagctcatggagtacacacacacagacacagacacacacaaaggagacagaagggatgttttggtgacagaaacagcttgaccatgaggaccctcctctttctccctccatgaaggcccttatactgcatagtgcttggggctgataaagccatttccctacatttctcaggctggacccaaggtcatccaccagaaatttggaaaacaaagggaagagaatctgtagatatgaattgggagtgttcaggagaaaaatttgggatttacttttgtgcatgggacacaggctgagaataagaatgttttcctggctctttcttggaaagccagataggcttcacctgaaagcgtattgccaatgctccagcgattcacttaccagggactgtgattttcttggttgcgaagtttttgccattagtgactgggttatggacataacacagatagtccccactattctctgtagtgactagggggataaagagctcttgtcctgtttgctggttattcccattcagcagccaagaatactctgctgatgggttagagcccatgaggcaggagaggttgaggtttgaccctggatagtaataggtgtctgaagaataagttgtgggttcatctgggccatctggagcaaagagaataatgccacaggtaatgttatcagagggaatgggaagctcctggtctgtgaaagggacacaatgttcctttttgccaagtcacaaccccgaagtcccagccaaacttcctctgtgttcactgaactggaggagtctaagacattcacctgtttctcccatcacaagtgtggaacctgagtctcctaagaccagagaagctcctcccttcctgggcctacccaggtttgcctggggcaggaagtcatggccagcttgggggtccaggggtaagtgtcttcatacttggacctgagagggactgagaggcctggcctcgagttatgtggatttgggctggcagccttgtccatgaaggaaaagaggatactcacagagaacatccaggtgactgggtcaatttggctggtactcactacattcttgctttgacattcatagagtcctgtgtcactccgagtagagcaaggaccctgttgtcattggacatctgcagcctggaaatgactgtgagtctatgaccatttacccaccacatgtagattgtgccatgaatctcaggttcacaggttaagaccacagcctcctcatcctccacggggttgctggcaacatagggcttgagcagatttgctgtgcagataacagagaagattcccctgtgtggcaccgttgatttctccatgagcattttccaatcagagttgacatctcccacctctcagccaatccaagtccttaaaagcccacagcaggactgtgtgtcaaaagacagatggatgcatgattatctgagggctcagagaccacggggccacctgctctgtgtgggagatgcacagacttctgaagtgtgactcgagcagcaatattggtgaagtgtgaattgagcagggtcaaacaattagagtttgattaactttgtttaaattgagcagagtccaagtgaggcagcagtggctcatgcatctccccacccgaaggacctcaccttatgacaatgttgttattatgaatacacaggtgtgcaagaaacaggcagtaaatcaggcagcacccacctggccagctccacctggtcctaggaaccaccagtattcccattatgtgtatgttacagctttttaggctacaaaatataaaatacaatcacagaatataaaatatgctattgtcaacacaaaatattgaatatgaagctgaatatgttgttccactttttctcactcttgttaaactttgctgattcagttttggaagtttctattgacacacacttaagctagagattctttcctcagctgtgtgcagcctaccagtaagcccatggagagcattctttatttctcttaaagtgtttttaatctctagtatttcatttgcttctttcttagaatagtcatctctgtttaaatcacccatccattcctgaaaggtgtctcctttttccatcataatccttaaccagagttgttttaaatttccagtctgataatttcagcatccctaccacatctgtgtctggttctgatccttgctctgtctttcaaactgcattttttttttttttgccatagtctgtcttgtatttttttgaaaaccacacatgatgtactgtgtaaaagggacttgagtgagcaggcattcagtgacatggtggtgagtgtggggagggaagtgttctgtggttctggatgaggtctgtgtcctgggctgtgaatgtcacaagtgcctctcaggtttttctttccattaggtgggatatgatgacttgaggctggagttggatatttcccctccccctggccagttaagctcccatcaaaccccagctaattcggctgcagtaaaatagtttctcttaaatgtaggtcttaccaagaagaacataattcactgacaactttccaagtgtttttttcccttcttcctacaagaaggatgtggattctttttgaatattgactgtgagaacctggtagagctccaggagctaagagtcataaaactgtccccctactcccaggactaatccatccactgttgtgtttatctctgcgctgtgtccacactgagcctccagaatttcctcaattagagttcaggttttctgaccccagcactggttcccgctggggtttctgtgcctgtgtttctgctcaggtacggtgcgctgctctgtatttgcctgtgggtctctccaatatgtgggccagttagcactgagatcttgcttcctgagaaatctaaacgagttgttgatttttcagtttgttcagctttttacttgttgttagaactgcgtgaaaatttttaagctacttacatgcctgatggaaattcgaagtctctagggcatgacaggaggatatgagccccacagcaggttgaggagggagtcatgagtgaaatgggtgaaatgagcccgtgggctttggaaactgcagatctgtccttctgcctctgaccccctggtgagtccatgtagaaagtgaaaccaccattgcaaagcatatgatggagagaggaagctagcttggctgcccgcatctcacctctagcctcaaactggctctcttctctgattcctgggcataggccagggtaagcatgggaggaatttatagtttaactttgaagcaaggatgataatagtccctccctaaaattagctcctccttgtcgggggctaccttggtaaatctaagaaaagaccatgaattatgggaggggcccaaattctgctaaaatgcaggcatagtttctataatcccttactgctcaggagtcatgtgtccagaggtcacaagatttgtgactttcctagttgctcctatagatagcaagactactgtagaatctgagatttatcttttgagatgtttctcagacttttgcattctggcaaccagctgacctcatctagactcatgaccaatggctcaaccagtcatgtagtccccactcagaggcagattcaacaaatacataccattttcctacctgcatcatttcatctccagccagtcaacagtacttattccttagacctttgccccttcaaagtttttgaaaaaatctaacctctgagccattggggaagctgatttgagtcatgataaacttctgtcctcctgtttggcagccttgggctaagtaaaactattctttactacacatcaccttcacaataaattggctttgcctgtgcagagggcaagaacctgtcaggtgattgtaagaatggatggaggagtcactgatctctttcaggtggcctgtttcatgagtcagcctctcagagagaaagagccctggtctgggacacagtggaagctcattctcctgttggcccggggacattgcctcattatggatcctggcaggggtggctactctggctgattttggtgcatttttcatttcccagaaggcaggacaggcctcagtgtgagcaggaaggaaatggaaccatcagtcttgttagagaggatgtctggggaagtcctcagggtggaggaagctgtgcaggacagggttcatcaggtagaatgaaagggggatgcacttttttcactgaacacctttcagatgtctcactaactctggcctcactgggctctgcctttccttctgagccctgagccctgagctctgagccctgattcctgggagggagggagggaggaagggtgaagctgggatgtgtgctgtccaggtttcttccatctctggaatcttgaaagcgagggaccctaatgtgttaccacagaggagaccatgggaaaaagctgtttctcaggggtgcctggcttatgaattgaggggaattcagaccaggttggactcgtgaactgcagggaccctgttccatgtcagcaaccagctcctctagctcagtgtttctctctgtggctaattcttttgtgtgatttctgagcccatgctagagtcctcctcacgatgcctgatggtcagacctgtgtggggagacctaatgatggggtgggggtggtcttgtgtgtcacacagagtgtccagggaacacactttgtgactttctctaccccagccccacaacaagatctggatagtgggcttggtcagataaagtcagaatccatgggggagggtatgtgtcctggcagtgctgaggttcgtacctccagcttagttctcagtctctgcaaatacatttatgttgtgcatgtgctgttttctggactgtacttcttgaacctgtctgcagataatgtcatgagagatctgcatggaagtatatgagggctatcagattagggtgggtgtgttttacatagtgggtttttttttcaccaaacacttttcaaaaaattgtggttgagtgtgtatatagaaacacatacatacttatatttgttagatgtgtatatacgtatatgtgtatatatgtgtgtgtgtgtgtgtgtgtgtgtgtgtgtgtgtatatatatatatataaaatgtgccattttaaccgcttcacttaaggggagagagagagagagagaagagagtttctactaataccaaatctgggttaaataagggtggtcctatttcctggggttggccctcttccttaatgggctgtatcttgagcacagtgattcagttgaagaacagagaccaaattaaaagctacattgctaaagaaacaacaggtgctggagaagatgtggagaaataggaacacttttacactgttggtgggattgtaaactagttcaaccattgtggaagtcagtgtggcgattcctcagggatctagaactagaaataccatttgacccagccatcccattactgggtatatagccaaaggattataaatcaagctgctataaagacacttgcacacgtatgtttattgtggcagtattcacaataacaaagacttggaggcaacccaaatgtccaacaatgatagactggattaagaaaatgtggcatatatacaccatggaacacttatgcagccataaaaaatgatgagttcatgtcctttgtagggacatggatgaagctggaaaccattattctcagcaaactatcgcaaggacaaaaaatcaaacaccacatgttctcactcataggtgggagttgaacggtgagaacacatggacacaggaaggggaacattacacaccagggcctgttgtggggtgggaggaggggaaagggatagcattaggagatatacctaatgttaaatgacgggttaatgggtgcagcacaccaacatggcacatgtatacgtatgtaactaacctgcacattgcctgcatgtaccctaaaacttaaagtctaataaaaaataaataaataaaaccccatggtgaatttctattatttttgtgttaccttggcatctttttaatcttccttgaacataccaaattttttcttgaaaaagattaagttctctctctctctctttgctttgagatgtaaatgtgctatgtgttttctctaaaactcagtaaagccttcctcaggtaagcgttaacctttaccatttacaagaaagcaatttgaatccaactatcttttaaaatggtgggttttaccgatctcatgcctaaagccctaaaatcaaaattctaaaatctttttgtctctctctatctttatatgaacatacataagttatatgttttatcacatacatgtatatgtcacacatttatatactgttgacacatagtatcaaattaatgtaaaaataaatgagtactcagaaattaagtgaataagcccaaatgcttttctatacatgcgattttagtaaactttggtgaatatagttttaaaattgttggtaaaataaagtaagaatgtcttcataatttaatttatacgtttttgcctatgtctgttggcaggcaggtttatattgtctttactagatgttttaaggtcagcaaacacttgtttccatatatatacattttcttaatttgtctgtgagcttatgtctttatatttgaagctttaaattctgagttctagataagtgaccatagtaagaactggggacaaaacccatcccatcctccagctgtgccttttagccatgctgggagagatgagattatccaggcattttcttcatagctctgttctttgtcttgggctttgcatctggtacatagttagaacggtttactccctagttttttttctactgaaaataaggctgtttaagtctgtttttacattgctacagacaaatacatgaacccgaataatttataaagaaaaaaggttgaatggtctcatgattcagcaggttgtagagtaagcatgattctgacatctgctcagcttttgaggaggcctcagaaaacttacaatcacggagaaagccaatggtggaggaagacatcttatataatgggagctggaggaagagaacaagggttgcacactggtaaacaaccagataaaactcactgttgctataacagcaccaaggaaaatggtattaaaatatgagaaagcacctccatgatccaatcacatccaaccaggctccacctccaactttggagattacaatttgacatgagatttgggtggggataaaggtgcaaaaaaatattattctccccatcgtccctcccaaatctcatgtctttctcacattgaataatataagaatggcttcccaacagtctctagagtcttaactcattccagcattaactcaaaagtccgaaatagcaagtttcatctgagacaaggcaagttccctttacctatgagcctgtaaattcaaacacaagttagttactttcaagacacaatggaagtataggcattgggtaaatactcccattccaaagggaagaaataggccaaaggaaataggatacaggtcccatgaaagtctgaaaccttgcagcacagtctttaaaacttaaagctccaaaataatctcctttgaccccatatctcatattcagggcacactgatgtaaggcttaggcttccaaggttctgggcatcacaggaacattccaagagagtcacaaaagaatttgtagtgaggcttttgatgctaaagagcatattagaccgagtaagtcactgaagaaaaaaaagtcagaggagaagatgggtgagggtgacagaaatggaatggtgaaaggaaagttctgataaaaatgtttacctgctggacatggtggctcatgcctgtaatcccagcactttgggaggccgaggtgtgcagatcatgaggtcaggagtttgagaccagcctgaccaacatggtgaaaccccatctctactaaaaatacaaaaattagccaggcatggtggcatggacctgtaatcccagctactcaggaggctgaaggcaggagaatcacttgaacttgggatgcggaggttgcagtgagctgaaatcgcagcattgcactccagcctgggtgacacagtgagtctccatcacaaaaagaaaaaaaaactttacccaagggctcatctggtaccttgctctgtgactaatatcttacacattttgatttactcttccactttcattttctgatgcgcaaagggtcacccttctgctgaagatgagaaaagaggctgagggagctcaaatgagtggtctagagtcatccagctacttcatagagcttgtgtgtttcaccttgacatttgtgcacagacagaaaagtgagacaaagaaggaaggcaaagcaagtttttgttgtgggtgacatttatgaaagttacctgtgttggcagaataacggactcctaaaatgtttgcaacctagctctagaacctgtgcatttacttttctttgtaaaaacacggtgcaggggtgataaaattaaaatcgtaagatgtggacgttgttctagattatctgggtgggcccattgtaatcagaagtgtccttgtaagtgacaaagaaaagcaggggcatcagtctgagaatgatgagcctgtgaaactccactggccaatgctgggtgtgagcatgcatcaaaagacaaaattacaactaatgtagttatagattttattttttgtttattatttgaggcagctcttactctacaaatatagtgatagcacttcctgggctatacaataacaaaacagtgggttttgtcaagtgggaactggtaaacaaagccatataaataaataaatcagttaacattagggtacttcaggtcgcttttctgtaaaagttaaagcagaggaaacttttattatgctgtctcaggtagagtggaatctcctgttttcaacaaaaaacaaaggtctgttctggtatctctttgcttcattaaaatttcagttgtagactgtagcatttagcatgagtggttctattttggagtctctaggctctcacttaggtgggagtgtgaccaaaatttaaagcattggcattcatctcagtaaccatcatattgggcttccatcgtttataggtttatgatgtcttcctgatcacacatttctttgagtttttgtcatttcagccaaagagagaccctttggtatttgtagatggctgcacacaaaactttttaaaaacttttgtagaattcaccacaccaaaatgtagaattaaaaaacctgtagaatttatcacaccagagatgctactagtatgactattggaaggataacaccaaaagtttggagtatgcactttaggcaagatgcaaaccaactaaaatagaatagatcaaagaatgagccagaagagtctagcaattttaaccaagtagtatgtttggtaacttctgtgattgagtcattattatactcaatatatttgtttatgtgcaacagttggtgtcagaatctgcacaggctcctccctgttcagctggtagggaacaattttattatgtagcattcgacggctcattaaattaaaacagggaatgagaacaatgagtctgaaaatgtaactttaaaagcgccactgtacatttgaacaaacaattgtgttaaatatgctgctaatgtcagccgttgggtggactaaatgatatcttatgtaaaaatttgagggtgacatgatatatctgtcactctattacgctgctctcagaaactacttcatgtgaaattctgatgataccatcatcctgccaagtgaaagaggcaggcataagcatggacaaattaagaggggtaagagcctgattttgatgtggaaacgtgttctgacaacttgagaaaagcttttcacagtgtgaagttgtcaacttcttatcctggttttcaacttgagtgtctgtagttatggtgtcaaacatattggtgagctctgagtgactcatacttcagatacgagggttttcccgtgaaatttaccttgagctttccacctccagcttataaggcttcaggaacagagcagattttattcttactgattcaataagagaaaactggatgggaggaactagaagaattcagggtctagtccagactaccggtgaaaaataaaaactcaaaaacaataaacagagcagcaatttcatagcaggtatactacactttttattttcaacattattttgctctctataggcatatctatttttaccaaagataaacccagtaggacaaatttgtttacaaagtaggtttagtcttaccaagctttgccaggattctttacataagtgcatcaagagtagcaatggaccacagaggctcttcctaaagtttgcttcgctagaaatttttataagtagtctcagattaaatttttacaaacctctggagacgaggaagccaaatgtaggccatcttcagactttgcctgcagtacatatgtgtccattctatgtatattctcaaatataacttctcagtcaaaccttggtaatataaccaatgttttgaaacgtgtccttttataaagagagaagactcttactaaacttgtgcaaataactgtattagcataaacatatgaatactcatgaatagtttcccaatcctgggacagttaggtaaagagcaaaaataaatgggcttcaattattgcttccaaaagtatactttaccaaattgctttagatatagctagcttaaaagaaggaaaattccataaatctggaaaaaatcatttaaagaatcagcaaattttcaaataaaaattataaaaacattatccactttatcatttatttcaaggaaattatttttgttctgcttggtctaggttggcatatttcatgaaggcatcaacctgtttgttaaagttttggaagtctatagacagttcagtgatataatcttgaactgctcagaaacttgtatgcaagagtacttgtcagcatcttttccataaatcttttgaaatagaagcaattttgaactgtagctgattgcagatgctttcaggaagaatcaaaacaactatctgtgaatgaccatcatgtaaaatgactattgttaaaactctgataaagagcccgcatcgccaagtcaatcctaagccaaaagaacaaagctggaggtatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctgatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccactgtggaagtcagtgtggcgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatgtcacatgtatacatatgtaactaacctgcacatggtgcacatgtaccctaaaacttagagtataataaaaaaaataaaaataaaaaaaaaaagatgaaaaaaaaaaaaaaaaaaaaaaactctgataagagtttggtataataaagagagtaactccagccagtactccagtcatgatgctggcagtggccccaactgagagaccaaaagaactttcttgtcctgaagcagctgtcatggaaaaaaaaagaggagaaggaataaataataaagacagcaagggttttagccaattattttttgagatagggtctcactctgttgcctaggctggagtgcagtggtgcaatctcagctcactgcaacctgtgcctcccagtctcaagcagtcctcccacctcgctctcctgagtagttgggactataggcacacaccaccacacatgcttaatttttgtattttttgtagagatggggttttaccatgttgttgagggtggttttgaactcctggactcaagttatccacccgccttggcttcccaaagtgcagggattacaggtatgagccaccgctcctcccggtttcatgctttttataataagaatcaactctttatgtaataataaataaataaacagaaattatttgctttagatgtagcatatgtagatttagattgtccagagtcaggagctaagcctcatatttttttttttttgttttagctcagtgtagagtgcattgaaggtgttgtaaaaataattccatatagtaagccaactttaaaccctgctcacagccagatctgccaagtatgagccaggtaaaattaccaaaaacggtggttctgactgactccttaacaataacgtggcttacaaacaaagactgatatgaaatagttgatccaacccaaacactttgctcatttcccaaaattttctatacaaatatatacaacttaccacaacataaagatcataatgaaagatttgccttttattcctttaaatgaccatatgttcagatctgatgtactgacagcaataattctccattaagcagaaaactaataaaatttgaaaaatagtgattttatatttagatgatactcagatcttctgctacatatgtggaaaatggaattattgctagaaacattgtttaaagattagggtatgaaaggagtattaggaagtcaggtggttctttccttaggaagcagcttatctggattcattcaaagagctttaggtgagtttgaggtctttctgcaaaatgtaaattgctatctgagaaaccatatatagtccaatgatgaaagaatgcaaagccttagaagcaccggagacaattccagtatcttccctaaagttctgacaaaaaggaaaataactatcaaattattcaactcgaatgcttattatgtatgtataagtcagtcgtcagatgaagagaggctggaaatatgacttctacccctagggaactcacagtcttgtgggggccactaggggtggtggtgtgacctgcctggagcagggctaagtatggacttgtgagtcaagggctatcaaaacctaagtgaactgatggccgttcagagaaggtagagttccattccacagtttgcaagaaggacaatttcatggaggaggccacgttggactagacctttaaaagttggtagaatttaaaagcaaggatatggaagcaggaagagtgaaagtgagcagaggtacaggagtgaggcaagggtgagcagtgttaattttttaatggtggtattataaaacacacatcaaaatttgccatattattattattattattttggagacagtgtctggctctgttgcccaggctggagtgcagtagctcaatcatggctcactgtagcctccacctcctgggctcaagcaatcctcgtacctcagcctcctgagtagctgggaccacaaacatataccaccacgcccaactaatttttatatttttgggagtgacaagatcttcctatgttgcccaggctggtctcgaactcctggactcaaataatcctcctgccttaaccccaaagtgctgggactacaggtatgagccactgcacctgaccccatcttaaaaatttttaagtgcacagttgagaaatacatttgcattgtgcaaccatcagcgccacccatattcagagagtatttttcatcttgtaacagggaaaattcatatccatgaaacactaactcctcattcttcctcctccccaccccaggtaacaactatttcagtgtctctatgattttgactgctctagggacttacataaatgagatcatacactgtgtatctttttgtgactggcttatttcacttagcataatgtcctcaaggttcatccatgttgtaatatatgtgagaatttttttccttttgaaggctgaataatatttcattgtatggatagaccacattttgtttatccattcatctatccatggacacttgggttgccttcactttttggctactgtaaatagtgctgctataaacatggaggtaccaatatctgttggggtctctgttttcaattattttgagtttatgcccaggagtggaatggccaagtcatgcagtatctctaattttagttttctgaggaaccaccataatgtttttcacagtggctgcaccattttaattcttatgaatagggcacaagggttccaatttttccacagtctcattaacacttattattttctgggatttttgctttgcgtttgagagtagccatttaaattggcataaggtataatttcattgtggtttacattttcatttccttaatgattagtgatattgatcaatattttctatgcttgctggccatttgtatatcttctttggagaaatgtttatgcaggtcatctgcttatttttttaaattgggttgattttttttttttgctgttgtttaggtagagaaagcaatctttggataccagtgatgtttcactaattctgggccattgatttcacaagttgtatgaggtattagtatgtgagtttggtttcaatcatggctgaggttgaatgccttttccaaaattcagtgtgaatttcaccagaagccagaaagggtccaggagcaagaacatggtgtgactgctctgtgctaaagaatttcagcctgatgacagtgagcaggctacacatgagactgacacaagaacaggtggagagggagactttccactggaagaaggtgattctaacatgcagaatcaccttcaaggagcaagtaagcagaaaaatagacaatggcacagtggccaggcaagaagacactaggtccagaatctgaggttcaaatcctggctctgtgagataaaaacatgccttggtttccccatgctactgaaacaccaggggttgggtctaggtcccattgctcactgcacagaaagccaaccactgagacaatgagcattgccagggaagaaggctttatttgggtgctgcagccaaggaggtgggagatcagtcttaaattcatctctccagcccactcaaattggagggtttatatagctgggaagggaggtaactactagcagggaaaacagcaattaaggaggggtaaggaagcaatcatgataaatgaggagtctggtgtctcattgtctgatagtgatgtggtgagtttcagtctcttgcctgaaggtcggtttcctaactcagatgactgacaaatgttaagtttcaagttataagaccggatgggtcaatttctatgtttattcaaaaaccctgtaaatatcagttctatgtggaacttgagctggtttccccccagttatcacagttagggttaaatgatgcaatataagtaaaacaccagcagtttctgacacacacacacagagtgtgtgtcatttttttattacactttttattacacttttcattctgggatacatttgcagaacctgcaggtttgttacataggtatacaagtgccatggtgttttgctgcacccattaacccatcatgtacattaggtatttctcctaatgctgtccctcccctagtcccccacccctcaacaggccccagtgtgtgatgttcccctccctgtgcccatgtgttctcattgttcaactcccacttatgagtgagaacatgcagtgtttggttttctgttcctgtgttagtttgctgagaatgatggtttccagcttcattcatgtccctgcaaaggacatgaactcatccttttttatggctgcattgaattccatggtgtatatgtaccacattttctttattcagtctatcattgataggcatttgggttggttccaagtctttgctattgtgaatagtgctgcaataaacatatgtgtgtgtgtctttatagtagaatgatctataatctttgggtatatacccagtaatgggatcactgggtcaaatgatatttcttgttctagatccttgaggaatcgccacactgtctttcacaatggttgaattaatttacattcccaccaacagtgtaaaagcattcctatttctccacatcatctccagcatctgttgtttcctgaccttttaatgttcaccattctaactagcatgagacggtatgtcattgtggttttcatttgcatttctctaatgaccagtgatgatgagcttttttttgtatgtttgttggtcacaaaaatgtcctattttgagaagtgtctgttcatgtgcttcacccactttttgatgggcttttttttttcttgtaaatttgtttaagtttcttgtagattttggatattagccttttgtcagatggatagattaaaccttgcaagctgaaactcaatgacttatgtaaacttctggagaaatcatagcaacttatatataaacaacctttgtggctgctgatgtgtggactatacaaaaggtacacatgaacactggattcagactgcaattcagagaaatgtgtcagattgccattgcaattggaagatacttcacaaactctggaaaacctagtctatagggttagaacgatgtttgccaaacgaattgctctaattgaagcagcagttgtgtgactttaataaggttccaggattatactgtcccttttttgctgtgacttccctttgcccttttctgatttgtcttcatccccttttccatgcatgacttcttaagaatgagccttcctagtgatgtaggatcagatgaaacttacagtcacaaagtcatgtcttctacaatgctttctctgaaagcttttgaagaattggggggccaggtgtgctggcagaggcctgtaatcccagcactttgagactctaaggcaggaggatcacttgaaaccaggagtttaagaccagcctgagcaagaaagggagaccacgtctctacaaaacataaaataaatcaaattagccaggtgcagttgtgcatgcctatagtctcagatacttgggaggctaaggctggaggaccgcttcagcccaggagttcaaggctgtagtgagtacactccagtctgcgtgagtgagcaaggttgtgtctctaaaagaaaaaaaaaaaaaggaaaggaaaagaacggggtaaacaggaaagccaaagatctcgggcatctccagatgattgtctgaacaaattgttttttcttggcttcaaaacctttcaagatgtatatttctttgtaaaagaaagacatgccaattgtaactttaagtgagcaatcaaaatctaggtcctaaaactgaagtattttaactctcattctgataatatttattttctgaggcaaagaagaaagacaacgttagatcaattgtttctctgcccactccatctcttccaacctgccttctcccctttaatcaaatgtataaatactaagcctcctgaaacgtcttcagagaaaacacaagccacagaggttttttgcaactcatatattcccagggtgcactgtcaggctctggctcaataaaactcaattggtcaagacccttgcctcagtcaatcattctggataaccaccatgagtcctgcaaagcccttcagtaatctattgcctgcttaggtgatgtgtacctagatgagtcagatcttcatgagtccaacactcgtcttccttttctgtctttcccaaccctaccactcagtgctgtgtgctctgatctgaccccagctcccaggttgtttgtattggtctaagaaagcaagaccaggaggggcaggttgagaaggaagtaagaggccaactgccagggaaagtggcaggtagggctgtcattgctcaacgccacacacactgggtccattttgtgaaattttctggattcataatcttttccctgtgtgtctatcaagaatctcaccctcctccaactttcttctcattacactttctgtttctagtgcactcgtttatgtccagagaatggccatgcaaatagttgacaatagaataaaaaatgacgatttgtcagacttagaagctggcctttcttttttccaaaagagattgaggtttctaaaagctggcttttatgcagggctgtgcagttgtgagtgtagttttagggaacaggtgcataagtgaagggtgagacagaaaacaaaattctggctatttgtcaaatcctgaaagtgaatgggacaaaaatcatttttgaaggaggatgtcattcaggagaccttgtaaatcttagagtgtcctcttaccagatgaagtggaggatgaggttgaattatggagttaggtgacagtgggtacatacttctctgcctcagttttttttttaatctgtaaaaatggggattgtggtacttgggattttttggtgaggactgtagtttcctggaaagctctcaggatagtacctggtacatagtgagtgctgcatcagtgtgagctattataattatgggaatagacaaaggtgccaccctggccatccagagtggggaggtattttccagtcagggtccaggcaggccagctgtagatgaagctgattagtggggaagcttaacttccaggagtggaagaatttaggaggagtaaacagaatgcacaacattctgcaaacattcctttacccaacagtaggaatactcagagttggcgtggattccgtggcaatcattatctcctgggaatctaagaatgtgtcctagagtcaaatggctttgatgtaagccaaacccagaaatgggcttcagggctgccttgcacatagcattcattcatcttgaaaaaggaaagcattcatcttgctaaaggaatcccctcttctggcccaggccattatttttgtttttgtactctcctaatttttaaggtgtaaggagaaagaccgaagaataaaataatggagtacatgtatgaaatgacagggtagaattgagactgctacatgtaagttaagagaaattgtgtataaattttgtgtgagcataagaaggatttcttgttgcaaacagacctctccatataaataatacccattgcctttagtggatagcagaccgcatcagaagaacattccaacagagtcatgagacaatgggtagtgtggcttctttaattggcaggttagactgagtaagttactgaagagaaaggagttgaaggagaagatgggtgagggcaagaaaaatgggaaggtgaaaggaaaggactgaaaggaatgtttaccaagggctcatcaggtaccaggctctgtgactaatgtcttacacatgttaatttactcttccactgtcattttctgatgcagtaagagtcagccttatactgcagatgaggaaagaggctgagggaggtcaaatgagtggcccagggtcatccagccacttcatagcagagctagtgtgcttcactgtggtttgtgcagacagaaaagtgagacgtggaaggaaggcaaaacatttttgttgtgggtgatgtttatgaaagtgacccatatgaggcagaataatggcctcttaaaaatgtccacatccaggccgggtgcaggggcacatgcctgtaatcctagcactttgggaggctgatacgggtggatcacaaggtcaggagttcgagaccatcctggccaacatggtgaaaccacatttctactaaaaatgcaaaaattagctgggcgtggcggtgggcaactgtaatgccagctacttgggaggctgaggcaggagaatcatttgaacctgggaggcggagattgcagtgagcccagattgtgccactgcactccagctggggcaacatgagtgaaactgtctcaaaaaaaaaaaaaaaaatccacatcctaactcttggaacacatgcatttacttttcttggcaaaaacactgttcaaaggtgatgaagttgagtatcttgagaaggaaagcttattctgacttatctgggtggctcccagtgtcatcataagggtccttgtaagtgaaagagaaaggcaggagggtcagggtgagaatgatgcagcctgagagactccactggccattacttcctgtgaacatgtgtgataagacaaaattacaactaatttagttattgatgtaattggcttttatttttgatttatgatttggggcagctctccctctacagatgcttcagcatcccaagtagctgggactatattgcgggatctggccagcagcttgcaatgcaacagggctctttctttgttcccaggcagatcggcaggttgagaaataaaagacacacacaagatagtgaaaactgggtccagaggggtcactgccttctggtcctgcgatgctaccaatgcactggatataccagcatttattattaagtttagtgagagtgttggtaggttagtgagggatttaaggtcatttgtaagctgtccacaagggtcgcattccattcccagagctatggacatctgcttttctgggataggaatcttggttatgtgaaacctccctgactgcatgtccattcataggctctctgcaggcggaagcacatcacatgctgttggctcattctggcagcccaacctggcatttgtctttacacaatcctgtatgcaattttgtatttacaataatcaggagcatttcatcttttattccatagcaatagtttcagggggtctccctacatctcccccttttctctgatttcaatgaaccatagcaatcataggttggcactgatcacgattggattgaagaatattttttccaattttacacacgaacagtaaaccaatagcacaaattatacacagaacaaaattaacgatagtggatcctcccaaagattttacctattgaaaggggttgagattagataacccctcagagatactgtctaaaacttcagcactaggtaaagcagataagtgtgcttgagaggcttcaaaaatctgttctttcagcttgtttatgtctaaacttaaattatcttcacttccttgtaaatggcattttactgattcccaattgtgaaaagactctttatattggaacggagttatacaaaaatcagaagtattccaatcacgttgcatttgtaatctgtgttctaaactcataattctatctcccatccatataacagaagcacatcacgcgctgtaggctcattctggcagcccaacctggcattgtctttacacaatcctgcatgcaattttgtatttacaataatcaggagcatttcatcttttattctgtagcaatagtttcagggggtctccctacaggactacaggtgcgcgccaccatgccctgctaatttttgtatttttagtagagacagggtttcaccatattgaccaggctgatctcaaactcctgaccttgtgatctgcctgccttgtcctcccaaaatgctgggattacagatgtgagccacagcgcccagcccataaatcacacatttctttgagtttttgtaattccagcccaagagaaaccatttgatatttgaagaatggctgcacaccaataaaaacatctgtagattgcaccacacgagggagactaccagtatgactatcaggaggaaaatatcaagagtttggaatatgcaccttaggcaagatgcaaaccaactgcaataggatagatcaaggaagaagccagaagagtctagtcattttaaccaggcagcacatttcatgatttttacagctgagtctctataaaacccgatgtatttatccatgtgcaacaagaagggtgagaaactgcacaggctcccccctgttcagctgatagagagcaattctattatctagcattgcatgtgtatgttaaattaaaacagggagtgagaataggcaagtatagaagtggaagcctaaaaaaatctccatacatttgaggaaaaagttgtgttacaggtgcagctaacgtcagcctttgggtggattaaaggatctctcggtatgtaaaaatgggtgggctgggtgtggtggctcacgcctgtaatcgcagcactttgggaggctgaggcgtgcggataacctgaggtcggagttcaagaccagcctgaccaacatggagaaaccctgtctctactgaaaatacaaaattagctgggcgtggtggtgcatgcctgtaatcccagctacttgggaggctgaagcaggagaagcacttgaacccaggaggcagaggttgccgtgagccaggattgtgccgttgcactccagcatgggcaacaagagcgaaactccatcttataaaaaaaaaaaaaagtatggttgacatgatatacctgacactgttaacttactctcagaagctacttcttgtgaaatcctaagtacagcattattctgggaagcaaaggagacaggcataagcaaggacaaattaagagaggtaagagtctcatcatgattgatagtcttgttctgacatcttgagaaaagctgtccacagtgtaaagtcatcaacttgtcgtggtttgcagtttgagtgtctctaagttatggtgttgaacatgtggtgagctcttagtggcccccacctcagacacgagggttttcccatgaaatttacattgagttgtccacctccaccttatatggcttcaggaacagagccactcttgttcttaatgatttcattggagaaaattgaattggaagaactaaaagaattcagggtccagtccagtctaccagtggattataaatactcaaagataatgaacagtggttcaatctggtaacaggtgtactacagtttttcttttcaacatagtttttctctctataggagtctctatttttaccaaagataattccagtaggatgaatttgtttgcaaatttggttgagtctcaccgaacttgcccagattttttacctaagtgcggcaagagtagcaatggactgtagaggccatttttaaactttgctttgctagaagtttttaataagaatctcagattaaacttccaaaaacctcttgagactaggaagccaaaccaaggcccacttcagactttgcctgcattccctatgggtttattctatgtatattctcaaatataacatcccagtcaaagccttgataatataatcaatgttttcaaatgtgtcctgttataaagagagcagattcttactgaacttgtgcaaatagctttattaccataaacatatgaatactcatgaatagattcccaattctggggcactcagatagagagcaaaaggaaatgtttcaatttttgtttacaaaagtatactttaccaattgctcaagaaaaaatgttcataaatctggagaatgaaacattccaagaatcagcacattttcaaatagaaaattatgaaatcattatccttttgattatttagtccaataacattgagtatttttcttctttgtcttgaatttcatgaaggtatcagcctgttcattaaaattttgaaagttcttagtccagtggtatgatcttgaagttatcaggagcttgtattcaagagtccttgtaagagacctttccataaatctccttgaagaaaaagcaattttggactgtaggtgattgtaagtagtttgaggaagaatcaaagcaactgtctgggaatgacagagatttaaactgactatggttaaaaatctaatgagaatttattatggtaaagacacagctcacatagaaatctagttacttctgtggcatatgacactatgataacatatttgattttcagaaatttcatataatttttagaatactcattaaaaaaatttttttttcagatggagtctcactctgtcacccagactggagtgcagtggtgccatctgagttcactgcaagctccgcctccgcggttcatgccattctcctgcctcagcctcctgagtagctgggactacaggtgcctgccaccacacccggctaattttgtttttgcatttttagtagagatggggtttcaccgtgttaaccaggatggtctcgatctcctgacctcgtgatctacccacctcggcctcccaaactcctgggattgcaggcgtgagccatcgcgctcagcctagaatactcatattattaacattcccataaatattatttagagaaggtttagcatcacttatcccttatttgaaaatgctttctataaatttaatatataaaataaggtggcttttccgttcagcttctgtttctcaagaggattactgagttcttggtgtagcccattcataaatagggccaaaaatgtatagtcttatgtatgttgaaaaaggtccttaggtaattccagtacttttagctgaaaatcattgatttagttttaagttctacctattgcaacaggagttctccatccttgttacgtgttagtagtgtcagggaagacttaaaaattaccagtgcctgggtccctctccagacctttgaactggaactaatgggtggggcttgagcatccacttttagaaatgttttccagtgattccaatgtgtagctctatttcccatcagatttctctgatttcttgtggcattcaattttttctattttggtatcatgattattttcaggtctcatttcctgtcttaggctttatgtctcctggggtagggaccttgccttcttcatttctgtatgttttttgaacacatgaactgatcatcaggaaaagatctcaaccacacataggttgtgttctgagtctcaggttcacatgttaatcctaaagtctttgttctccacgaggtcacatgttgcttgtgatgaagggtgtggttaagtctgcagtgcagatggttgaagggatttcactctgtttttagacatagcattggaactaagaattttatgtctatatgggtgaaggggcagggatgtgtaggaagacagttctaattaggatggaggatttatactaggaagtagaggtaaaggaagtgagaagccttagtaaatagaagaaatgtgaacttatcaaataggctagagtagacccctgcagattcttgattaaatcaattaaccagattttagaaaggtaatgaggcaatcatatgcaaggaagatttcaaagtctggagacaagaagtcaagcaatactttgagaagtggttgagctttatgggaatggagagaattacactattgagagatgttaaaaataatgaagagggtttcaccatgtgaaattgtgtttctcatttgaatctgagaaacaaatgagcagaggctggagataattatgtctaaaagacagtggggtacagggagcataaaggccagggagaaagggaactgcaggaattagtgctgagaagcaggagtttagtggaggaaggaggagatgcagtcccagatacaggcaaataagtcttttccctctcccaagcatggcagtcagctctgcaggaaccaggataagagaaaaggccatcatacctgccagtcttcctgaaatacagaaatgacatcacagctgctatgttggattaaggagaggaagaagtcctattcttgtagaagctgtcatggaaagaaaagtaaagaaggaatgaaggtgatgttattttacatgggggagcatcaggaacaagcatgtaacatgaggtactctataattgtttcttcaaggaccacattatttctcttggaatattgatgggagatgattatattcttgcagttttttttccctctcaccatgtgtctcggttggtgatcagtcctctgtcaattctctactgcactcagatattttggaaggctttcagatgtgagaaaggctgattgctattttctatgtcattagaacttgccacattttcaccttttcatggttgcatctttttctcggtgtttctgttgtggcagtcatgaatgagactctgtcaggtctccatggcagggacctgattggcagaaggcccaggtcagtgcatttcaaattcaccacctcttgtgcacagaaagcttctttcctacaggctcccagcaagggtgtgaaagcaagcctagttctccgaggctctctttaactctaatgggtgactggttggaggattcctcatcagccttgcaaaaactcttagaactgcattggtacctaaaacttctttctctttgtttttcataggaatcagctctgcatagtggtctgtgggttctcccatactaccttcatgcctgccccacattccctcacagatgtcttccctgataaattatcttgtatgtctaatcccatcttggatgcatctcagttggtaaatactaacataccaggcttgattctttgcccttagctttttttctttctctcccacaagcagtcagtaaccatgtcctagtgttttatgtgttacctctttttccatatatatatatatggaaaaaggtagatactgttgaggggcacttgctatgtgccaggccctgtgctaaatacttccctgtatctcatttaatccacacaataaccctgtcaggtagacattatttccattttggcaatgaaaagacagaagcttagcgtggtgtaaaaactttcctggtgtcatatggctagtgacagggggatctgagatttcattctaggactatttgacctcaaggttgatgatgatgatagtaatatagtagctgacattggttcctctgtgtgtggcatcttgtttcattgactgcattaaatctttaaaagaatggtatgaagaaagcactgtcattgcaatattcaggtaaggaatcagaggttcagagaagttgagtcttgtgcaagaaatttataactgtaaactcttacattaaaaaagaagaaagatctcagatcaacaacctactttaatacttcaggatatgaaagaagaacaaactaaacccaagcacagtgaatgagggaaataataaggattagagtggacataaataaaatggagaacggaaacagaatagaggaaattactgaaaccaaaagttgattcttcaaaataaaatcaacaaaattgacaaccattaactagattgactaagaaaaaaagagaaaagtttaaaattcctaaaatcagaaatgaaaatggactctgagcatggtgggtcatgttttaatcctagcactttgggaggtcacagcagaaggatttcttgagaccaggtgtttggaccagcataggtaacctggggagacgctgtgtgtacaaaaaaataaaaaaccaattagctgggcatgttgacatgcacctgtagtcctagcatcttgagaggctgaagaaggagaattgcttgagcccaggaggttgaggctgcagtgagccataatcacacaactgtattccatcctgggctggcctacagagtgacagcctgtctctctcttttcaacaaaaaaaaaaaaaagaaagaaagaaagaaagaaagaaaaatgaagcgattactaccaattctaataaaataatgattatgaaagtactataaataattgtatgccaataaattggataacctagatgaaatagacaaactcctagaaacacacaaaaatatgaataaaactataatcactaataagattgaatcaataaaagcatttgatgaaattccatattttttcataagaaaaacattgtaagaatggaaggaaaccacttcaacataaaggcaatatgtgaaaaacccaatggtaacatcatacttaacggagaaagactgaaagctttccctgtatgagcaggaataagacaaggatgcccacttttgacacttttattcaacatagtgttgaaaggtctagtcagaaaaattaggcaagaatttaaaaaaagacattcaaattggaaggaaggagtaaaattatttctgtttatagataacttgaacttatatgtagaaaatcctaaaggtggaacaaacctattagaattaataaataaattcagtaacgttgcacaatagaaaatcagcattcaaacgtcagttgtatttcaatacactaaccatgaacagtctgaagggaaattaggaaaaaaatttcaatttatattaacatcaaaaagaataaaatatttaggaataagtttaaccaaagaggtgaaatgattatacctgaaatctacaaaatatggctgaaagaaatgaaagatgacatcaataaattgaaggacattttgttttcatgaattggaagactcaatattgttaggaggacagtgctacccaaagtgagctgcggattcaatacaattcctatcaatcagaatctcagtgacatttttgcagaaaaacaaaaatctgtcctaaaatttatattgcatctcatgactaaatagacacagagctttgaggaggaagaatgaagctggaggactcacactttctgatttcagcatttactacaaagccccagtaatcaatacagtgtggtactggcataaaggaggacatagaaattaatgaagtataatagcccagaaagaaattcttgcatatatggccaaatgattttcatcgagtgtgccaagatcattcaatggggaagggacagtgttctcaccaaatgatattgggaaagctggatattcaagggcaagaaaactagaacctttacataacaccatgtacaaaaatcaacccataatagatcaaagatctaaatgtaagagcaaaaactgtacaactcttagaagaaaagcttcatgatgctggatttcacaatgatttcctggttgtaacaacaaaagcataggcaacaaataaaacggataaatcggacttcataaaaatcaaaaccttttacatatcgaagaacattatcaagaaagtaaaaaggcaacccatgaaatgataaaaatatttgcaaattatatgtgtgataagaaattaatttccagaatacatgaaaagctacaagtcaacaacagcaaacatccgaaaacccaattaaaaaatgaacaaaagattaaaatggagttttctccaaggaggttacacaaatatccagtaagcccatgcaaagttcctcagcatcatgaatacttagagatgtgcaaatcaaaaccacaatgttacaccacctcacacactttaggatggctttgataaacaacaacaatgacagcaacacaaaacaacaggtgttttcaagcagatggaaaaattggagctctagtgcattgctgatgggaatgggaaatgttatagccactgtaaaaattggtgtgctgtttctcaaaaaattaaacaataaattaccgtttgatccagcaattccacttctggacatactccccatagaattgaaagaaatttgaacaaatatttgtgcactgatgttcagagaagcattactcacactagcgaaaaaatggaaacaaccaaaaagtccattgaaagataagtgggtaggcaaatgaggtgtgtctatacgttgaaatgttattcaaccttaacaaggaataaaattccaatacatcgtgcaaaatggatgaaccttgaagatattatgctaactgaaataagccagacacaaaaggataattattatataattccatttataaaagatagttagaatagccagttacatagagacagaaattagaatggtgggtgctaagggttcgagggagaaggagtgagagttactgtttattgggtacagaggtttaatatggtaagaggaaaaagttctggaaatggatagtgtgatggttacacaacactaaattgcacacttagaaatagctaatggtaagccttatattagatatatataaagtgtctggtagtcttaccctctctataattacacactttttggcactgcccttttcctgccatgcagagctccaggggtgaatctccctatttctctagctctgcatcagtcacagtcctccatgctgtgtcccacgtactgtgcccacagcttcatacaaccgctgacttcagagccaggaccaggcttaggagtctgccctgaggctccttctcttctcatttccctgcagcctggcccgggggaggcttggcttcaactggcagctccatttagcgaaattcaggacagtccacaaggggtctttctccacacatgctggtcccaccccaggtggagtcaaacagggccagtcaccagaggagcccagagcagagcaggaagcagagtctgagctgctcctccctcacccaaggggcttcctcctctcatttgggggaaaagtgtgagcttgtttcaaagcctcagatgttccttgtagctcatggaataggtacaagaaaaaaaagacgtggcagaaggggatgtgttagtgacatccagaagcaacttgatcttgaggacactccttcttgtccctctgtgaagcctcttctaccacatagggctcagggctgataatgacccctccctacctttctcaggcgagacacaaggtcagccatgagaaaacagaaaaacaaggagaagagagtttgtagagacaaattgggagggttcaggaggagaatttgggatttgcttttgcccatgggacacaggctgggaataaaaatgttttcctgactcttctctgaaagccagatagactccacctaaaaccctactgccaaggatgctgggatccacttaccagagactttgactgtcaacgatgtggagctttcctcgccagtggctgagttacgaacagagcaaacatagagcccgctatgctttgtagtaatttgggggataaacagattttgtcctgattgctgaaacttcccattaattgtccaagaatactgtgccggtgggttagagttcgcgaagcaagacaagtagaggttatctcctgaacggtaattggtgtatgaagggtgaattctggggaggtctggaccatctggagcaaagagaataaagccacaggtgatgccatctgagggaaggggatgctcctggtctcttaaagggacacagtgaccctctgagacaagacacatcctcaagtcccagcaaaaccccctctatgttcactgagccgaaccctgaagtattcacctgtttctcccaccacaagatgtgggccccaagtctcccacgacaagaccgtccactccccttatattcttggttaaggctgtgcctacccaggttttcccagggcagggagtcatggccagcttggatgtccagaagtaaagttgtctatacttggaccggagagagactgagaggcctggcccctggtcatttggatttaagctggtggcctggcccacagaggaacaaaagatacagaggacattcagggtgactgggtcactgtggatgccaccatatcggtcccgtatttcacattcatagggtcctgtttcatttctcgtgacactgggtagaatgaggatcctgttttcaatgggtcgctttaccctgggactgaccgggaggctctgaccatttagccaccaaatgtaggtgtagctctcactcttaggttcacaggtgaaggctaatacatccttattctccctggggtttaagttgttgatggtgatttagggcttgggcagcttcgctgtgtggataacagagagaagattgtcctgtgtggcacttttgattcctccacaggcatccttcaatcagagttaccatctcccacctctcagcccacctgagtccttgaaagccaataactggtgtgtgtgtcacaagacagatgcatgatgatctaagggctcaaagactgtgaggccgcctgctctgtcttaggaaagcacagactttctgaagtgtcaattgagcagcagtgttgggtcatggacagacatgtcagtgggagtcacagccccagtacccctcccagtctctccctaatcagttgactggctggctcaccttgggttccttacctggaatgtgcaactgctgggccccttccaaattccatcctactttgcccccctagatgtgatttctctgcagcttccatttccaaggacattctagagatcagtaataatgggacttcccattgtcctgaaaccctgaagatactgagcagcctggcctgggactggatgtttcagcagaaataacacaggggagaccagagtcaagcctggaggtcagttcagtcatcaggcagtggaggcacaaggtggggcagctttttgcaggtgtttcatgatgacttacttgaaccagtgacctctaaagatagaacagagtgcaaggaatgatctagaaagagtgaaggggataggcaagagctggtggctttggagcagaagcatgttccctgtcttgggttctttaagtttcctctccttctgcagagggcaggtgaggaccatgtggatctttccagaaatacatgcggacatttgcaaaagcagaactgactggtggaaagggtgggaatgaactgctggaaatctggtcgtcatggaccatgtgtgtttgatggatatgagacaaatttggagagaagtttttcaaatattttctttcattgaacaatctactctgtgattccctgggttcgactactctagggacctcatgtaagtggattccagagtgaatatgagaagagactgctggttgccaggagctgggagtggggagaatcagaagttgttcatgggtgtgcagtttcagttatgcaaggtagggagtttctagagatctgctgtagagcttgatgcctatagttcacacagattgagtatttcttatgcataagacttaagacaaaaagtgtttcggatttctgacattttttgattctgaaatatttgtcatatacttactggtttagcatcccaaatctgaaagattcaaaatctaaaatgctccagtgagcatttcttttcagcatcagattagtaggcaaaagtgggaggtgataagccaaagatattcttgcccttttttttctctcaccacgtttctggcttggtgattagttttcggtcaattccatactggccatgctgcactcgtttattttttaaggctttgggatgtgagaaaggctgattgctattttctgtgtcatcagaactttccaccttttcatggttgcatctttttcacagtgtttctgttgtggcagtcattaataagagcctgtcaggtcagatttaggacggagttttctaattctgccaaaaatgttactgtgattctgggaggggttgcattgaatctgcaactcactttgggtagtattgtctttctaacaatattgagtcttccaatccatgaaaatgaaatgtctttccatatattgatatcgtctttaatttctttcagcaatgttttgtagttttcaaggtataatcatttgacctttttggttaaacttattccaaaatattttattccttttgatgttaatgtgaattgaatttctttccttaatttcctttcagattgttcattgttagtgtatagtctaaagaatgatctagaaagagtgaggggacaggcaaaagctggtggttttggagcagaaacatattccctgtcctggggttttgattttccctctccctttgcagagggcaggtggctcttccctgatagctagatagacttcactggaaaacatattgccaatgtttcagggatccacttaccagggactatggtcctcttgattatgagatttgttccagcagtggctgagttatggatgaaacagacatagagccctctatatgttttagtgatttgagggataaagaacacttgtgctgattgctggaacttcccatcaatcagccaagaatgctctgccagtgggtgagtgtctgtgaggcaggagagcttggggacttcccttgtatggtaataggtgtgaggaagaaatggtgggggcatccaggccatctggagcaaagagcataaagtcacaggcactattgtcagagggaagggaaaatcctggtctgtggaagggccacagtgaccctgtgagccaagccgcaacactgaactcccagccaaatccccgctgtgttcactgatctggagcctgagacattcacctgtttctcccatcacaagctgtggaccctgagtctcctatgacaggaggagcctcttttctcctattgtggatcaagcctaggcctattctggtttgcctggggcagaaagtcatggccagctttgatgcctaggggtaaaggtctctgtacttggacctgagagggactgagaggcctggcctctggccatgtgtatttgggatggcagtctggcccacagaggaacagaagatactcacggaggagattcagggtgactgggtcactgcggctggcactccctgagttccgtatttcacattcatagggtcctgcagtatactttgtgacaccaaatagaaagagggtcctgttggtttcggacagctgaaacctatgagtcatagggaggctctgaccattcatccaccactggtagcttgtgtccggagtctcaggatcacaggttaagatcacagtttccatggcctccctggggtttaagttgctgctggagatggagggcttgggagtctccactgtgcagaaaacagagagaagattgccctgtgtggcacctttgattcctccaaaggcatttttcaatcagagttggcatttcccacctctcagcccacccaagtccttaaaagcccatggcaggtgtgtgtgttacaagacagatgcatggcaatctgagggctcagtgattgtgaggctgcctgctttatgtgggagaagcacagactttctcaggtgtgtattgagcagcagcattgggtcatggaaagacacaggaccagcagtcacagcccctggtgcctctctgagtccctccatctcgaagtgcctgcctggcccaccttgtggtcctcacttggagcatgcagtgctggaatcttcttagtttcagtcttactttgccccctgaggtatgttttctctgcagcttcccttgccaaggacatccaagagatgaatgatggaacttcccattgtctttaaaccctttgggtactggaaagcctggcctgggactgggtacttcagcataaataacacaggggagaccagagtcaagcctggaggtcagttcagtcatcaggcagtggagccacaaggtggggcagttttcccaggtgtctcatagtgagtgacttgagccagtgacctctaaagatagagcagagtccaaggaatgacctacaaagagtgaaggggacaggcaagagctgatagcttctgaacaagaccatgtgccctgttctgggtccacaatgctcccttccccctgtagagggcaggtgaggacgatgtggacctttctagaaatacatgtggatgtttgcaaatgcgaaactgactggtggaaagggtgaacatgaactgatgatggaagtctggccctcatggaccatatgtgtttggtggatattagaccaatatttgggaagaagtcttgcagatactttcattagatattctactctgtttctgagtttaactaccctatgtacctcatatcagtggattccagagtgaatcagagagtagaatagtagtttccaggagctgggatcaggggaatagggcgttgttctgtgggtgtgcggttccagttatgcaggataaggaggttctagagatctcctgtacagcctcgtgcctatagttcattcagataaagtgctccttatgcagaaagcttaaaacaaagtgttttggatttctaatttttttattttggaatatttgccgtatatgtactggtttagcatcccaaatctgaaaaatttaaaatccacaatgcgccagtgagcacttctttttagcatcacatcagtggtcagaagggttgagttttgagcatttcagattgtggatttctggatttgggatgctcaattcgtaatactgtaattttcccataaaaagttgtcaggagtttagacctcatgttatgttctgactctagtaacaaaaaaaatttggaggaaatattaaaatgttttcataagtggaaatttttactgatgatccaaacatctaagatcaattgctggtagtagtatttctcctgagaccaaaataaggtttaggtgtgccgtgaattccagcaggatcacattatgctcaaagaaagatgccaaaggtgattggaaattagcagctccttaagtagagagagtcccgttaaaaggacagaactggtcagtgcatcaattacataaagggaggaaggatgccaaattaaaagaagtgatgtgtgttatgttagtaaatatagaaagaactccctgcttctaatttctgtgcagagttaggaaaaatggggaggaccccaaaacaggtatgtgaaatgctttcttcattttctcttaagctcaggaaacaccactagagtttaagtttgtgtgaaataggaagattctaagtgagatgccaatggctcatgtgtctccccacaagaagaactccaacttatgaaaacggcatcatcatgaggaaacacttgtgtgtggcacaggcagtaaaaccatcagatagcacccacctggtcacctccaactggtcctcaaaaccaccagtattcctattacgtgtacgttacagcatttgtatttgtcccacaactacataatttaaaaattgctactgtcaaaacaaaatattaaatatgaagttgaatcagttgttccactttttcttccccactcttcttgaactttcctgtttcagttttggaaatttctattgacacgtcctcaagctagggattccttagcttttttacttagtgttggaaccgagtgacaaattccaagcttgttatatgcctgaccggaagccagaagtctctaggaagtgactggagaatgtgagctctatagcaggttgaggatggagtcacgagtgaaatgggtgatatgagcccatgggcttgggggactgcaggcctgtccagcctctgacaccctggtgagtcattgcagagattacaacagtgacagcaaactagcatggctgactccatctggcatctagtctcaggctggctgtcctcacttattcctgggcataggccaggctaaccttgggaggaatttagtttatggtttaattttgaagcaagaatgataatagttcctccataaaactaacacccttactttgcccagggacggcctttgtcaaactagtgaaagaccatgagattaagattataggagggaaccgaattctgctaaattgttgtcacagtttctataatccctgactgctccaatgtcatttggctggagttgacaaaatttgtaactaattgatcctatagataacatcactattatagaagttgagattggtcttttgagatgtttctcattcttttgcattctggcaactggctgacctcatccatacctatgattaatggctcagccagtcatgtggtccctacctagaggcggattccagcacaaactgatcatttccctccgcccgcatgattccatcaccaaacaatcagcagtactcatttttcagtcctgtgcccctgaaactatccttgaaaatctctaagccctgatccactggggaggctgatttgagtaataataaacctctgtcctcctgtttggcagacttggagtcattaaaatctttctttactacaaatcaccatttcaataatttttttgtgtgtgtgtgcaggaggccagaagaacttgtctgacaatgataagagtggttggagggacttcctatccctgtcccatggtcttgtccacaggtcagcctcacaaaggggaagagcccttgatgggaatacagtggaagctcattctcttagtgacctggggacattggctcgagatgaagcctggcaggagtggcaactccaggtgatttctgcacctttcctatttcctgggaggttggctaggccacagtgttagaaggaagggaacagaacagccagcctagttagagggagtgtctggggaaggcctaggtgtgagggaagaagctgtgcaggacagggcttgccagtcagaatgaagtgggaggaagatgagggacacagagaagcagagagaggcagagacaccatggcagtgagcagtgagggctacactgacgtcagagaccccagggaccagctgcccccagttccacagtccagaaccaaggagccctgagaaccctctggtggccaaagagcttcagagttacatgaggtggggttgctttaggggcaagaggtagtggggggatgaaacatgggtgtcagcttctgaaggacaagggacaggtgtggctaggacctcctaggattctgcatccaacatccagtctctaaagaggttttggatcattcatttcttcattccattccttcatttgttatgtgagagctcctgagtgtgtgtgtctctcactgggcctgtgctgatgcagggtgtgagtggggaaagaaaacaaggtcctctccttgatcctctcatgacagtgacatggacactttgggaaacacagggtttcaggttcagtgatgggggttaagatctgagagggaggcctgctcatgttttttgcactgattctgacagttgaggcaggtgatttagttctggagtacagattaatcagctgaccatttgctctcactcctctgaggtttggatgcctaagaagagaggatttgagccaataaatgacatggggtccttgggacccagtaagccctcacttctggtggaggagaggaagggcctgtggctgcaggcagacctcatgtgaccctgatctcccctttgtgttggtgtgactctggttcagtgactgtgccttcctgtgcctcagttttctctcaatcaaataagctaaatggcaaatggactgtggcttttcatgctatctgtgaataaatgttaaagtattcacagtcacttgatctaatgcttggcacagtggaggtttcacacaaacagcatttattattaatttgcttccatgagaaagcaccgttacatcagatccctgtggacaagctgctaccaggtacatcttctgtcttctgtttctgcttctggggacattagacttcctatggactctcctaagcctcctaaggcagttggctgatggtcttcaaagattgtctttctgtcctctccactctgcctctcctgttttgacctctgtcctctacaccattgcccagatgaggctctgagggctgagccctagctggtgaacagctccaggagacacagtcctcagacagctggtaaatccttggtcccagtaagccctgcccatgaagccacaacccagccctggcacaggctcctaagctttatctggagcaaggatttagggacagggtttggaggttgaggtttctagggctgagcttctctgagagtatctcaggggacccctcaggccaagccctgctcagttctccagggtctttctcagggtcaaatttatgaagagggcatgaggtgcttggctgagactgatctcctcctgctgagtccccccatcagactgtccttcctctgcagcgagtgtctgcagggtctggatgcgggaaaggaattctgatctgttgaaatgtgtctcctctgtgtgtgtcctgcactaaatgcccaaaccccagcatgggacataatgcagagagggacacaggcacagtctaggcctgacaatcctgtgtgtgtgaagtagaaatgacccctgtcccccaacacccagggatcatgtggaatcacttacggtataaggtgaaggtgaaatatccagttactcctctagtcccatcacctcgctttatgatgtgtaaggtgtaggatcctgcgtcctcccgggtgacattctggatcagcagggatgcattggaatatgctgtttctcgtccactatatgcaggcccatatataattatttgaccgtctactacatatgatgtaatgtaatggtagaggtccctgatttgccctttgtaccagatgtagccagtaagattctggggcaaattgtggacaagtagaagaacatccttcccctcggaaacttttggtggctgggcttcaatcgtgacttgggcagtggtgggcaggttccagaagtttaaaagtgatgctaggaggtggagagagcatcagacaatattgagacctatgtattggggtgaaaagatggggccctgggtcctgaggaggtctcttcaatcctcagccttgaagacacacacacacacacacacacacacacacacacacacacacacacacaaaaggggcatgtgtgtttgtatgtgtgtatgtgtgtgtgtactactgtcctactaggtcaaggtcagcagcatgacccccattccttcaccacttgtgaccttggcatttttctgtttggaatcctcttccccaggggtccgcatgaccccatcaggtcctgctcacatcagggtatcctaagacttctttcctgacacctccttcagagaccctgggtcttccctttctgacctttccctgctctgctccctaaagggttcttgttaacagctgacctcacattctagatctctttgtatgtctgtcttcctccccatgacagcatgagctcagtgaggacagggacttttgtgatcttggttgcaccccagtgcctggaacaggctgcagactcctgtagatgtgagacttctcagggccctccacacccttggtgtttttttttttctcccccaattgttgaggttttttgctgaggacagtgtttcacgtcctgcttatatttttatttgaagtgtcatctgatatagttattattatcatttttcaaaatgtggcccctgatgattaatcaggaaaacagaacacttaagattttcctacctcttaccaattccagttcaatgtgattttcctgttttgacccctgtccctctctggtatattttcccctatccaggctccaacagagccttctttccttttatttctttcttctctcttttttttttttttttttttttttttttttttttttgagacggagtctcgtactgtcgcccaggctggtatgcagtggcgctatctcggcacgctgcaacttctgcctcctgggttcacgtgattctcctgccacagcctcctgagtagctggaattacaggaacacacgacaatacctggttaattttttgtatttttagtagagacagggctacactgtgttggccagactgaccttgaactcctgatctcgtgatccacccacctcagcctccctaagtgctggcttctttcattttttagaaccccatcctctccaggagaccccatccagtcactcttcttcctcctcctgtcctctcccaggaagttctctcctcacctgtgaccaggagccccttccatttgatgtgctctgtgcagggaggggctgagaggggccccatggtctctgctgcctgtgtgttctcctctgtggagatgagcctaggatccagaaacttcctgagcacggctgtcagctgtgctgtccttcctccttctgcactgagcctcttcctggggcagcagcaattcccaggctcatgggtggggtcaggcccaggacacctctctgtcccctcctctctcagtcctgcctccttgtccctccttctgttttccttttgtctgtgtttcaggtccctggggattgtggaggcctctgcctttttcagcagtgattctttcaccaaacctcaacacacactttgtgcagacacacacacacacacacacacacacacacacaaaagagacacacaccgacccacacagtgacacacataccctgcaggttgggcaaggacagtcctgggcctcagcctcctgctgtccccatggccctgggtcggggtacacattcacgacctttgccctctttcatccccatctggctctccccttcagtgcaggaggctggagctgcaccaggtccctgtcacagtgatgtcccattgtgctgtgggtgagctgtgtgttgcctggtgagagggacccttcctttctctaatcgtgtctagcttggctgcagcttccaagaatggacattcaggacctgggtgtcctagaggaaactgtcctttctggaggtgtgcagggtgaatctctcatgcctcttggtaggagaggcctgtgctggttgctcagtgggggctg

SEQ ID NO: 611 - DNA, 386820 bp, Homo sapiens
caaacctattctagcctccttcaaatctttactttcataaaattaatactagcccttccaaaataattttaaaaagaaatggaacatttcaaatggtcaaaattaaaccatcttcatagactttatggaggaagattggtcaacgcatcatttatcagtagtatatacatatattcctaaaagtaaatgaccttatttgcaattccacttatatttcctacatgtgcatgcgtactttctgtcagaaagcagagagtaaatgagtcagttgaaagcatacattcagatgtctttgaaacatacccaaaaccctctgccaaaagctcaatatgaggtcttttgaagtgatttaatctagaggcttttaagtgaaaaatacgtagtagaataaaatttttattcttttcaattatatggacaaggagtaatttttaggtaagcatcgaaggcagcacgaaaaccttgacattatgtgcaaagtgttacttatttactgtgtaaataacactaaatgtgagcttcaacatataaacatctttgctagttgtcctctctcacctctacgtctttaatacaagaaaaatgtcttcaatgaattattgtcttattttggtatagtagcatatattttcttcaacataataattattaatacaattaattgtattattattataaaatacataacaattcttagtgccttactattcataagtttgttttaattatgtcttctcaatctgtatgtaatttactactttatacataaacacaagctgagaaggaataaagctattaagtgacagaaatgaacttgatacagattttctgaatcaaagtccatggcttttcacattgaccagatatctatcatttacattataattgcataattaacaatacagaataccataagataatcagagtcacaaaaggtgaacatattaacgcaaatgcaaaacaaccatgaaatcagagcttctattttgaacaactcaaggaggttccatgtatgttgtaacctatgtgaatagcgtcctggaatttggcaatgcataacttatttgtctgtatgaactgatctagaactgaataatgagccttctttaatggtgctggatgatatggttgttaatacttcaaataataatgcttttacatttactaattgatatttggtatttcaattttcgtcttatatatcattatggaaacattttaacatccaaaaatcaatcaaaatttttgtgtccacacttttaaattccccataaatacatatttcttataaccaaaataatattctttctttttcacttattttatcataaatctcatataagctgctctttccttttgtttgctattagagactaaatcacaataaacatgctcatgcactcacttcttttttgtttttataattgtcttcgaaaaaattatcagttcaacattatgaaaacctttatgacttttgctaaatatctttataatactttccaagtgatcacacccacttctactggtagcagaaagaatgaggttgggaattatcatctcagccgcaggtatgtcattcataggagtttcgttgctttagtcttttacggtattgctgctttgtttagatgtaaggagatccttgatgtttgctttaatcataattaatttgattactaatgaagtagaagatgtttcatgcatttatttattctgtatgttcctatttttgtcaaaatacttgtttacatcctggctcatttatctattgagcatttaatattttaaaattaattggaatgagataattatatattggtaattcttaaacatttcaagtcatgggctccatttgattatctgatgaaaataatgaaccttctctatagaaaaatgtctacacatacatatttgcatatagtttcatagagttcactgacctccttgcagaaaactcctataaccataaaatccaagttaacgatcaaaattaagctactcacttttagtcagtgaatggacatattttcccaagtggtcatatgccttttaatttttattttagtatgctaaaattttatacgtatttacttgaattgatatatttttattgctatttgtcatattgcttaaaagttgactattttaagctgtatacccttagttaacctaaagccaccatacatacacatcacacatatataaattgttctagaaactattttgatacgttaacatgatgtctatttctgtagtcacatagtctatagtaaaacatattaatgtgcaatcagcaacaaagcaaatgagaaaagaataaagtgatagctgttttattacaaaatgattatatgctcctgtttagtcatttcaagcagcacatattctatttcatttcctttagggtttgtttataactgattttattttactaataaaaacatgcatgtgcatattaataagagaggcaaagaagaaaatctctcttaggaaaatttacttgaaaactgttccctggagatgtcaagaagtgaagaaccactacttcataaattgcaaaaactgaccaacgttttattttattctctctacggggaaatcccatataaaattagctttctaacatgacataaaaattgtatttcctctcagtaatctttaaccccttctaataaagttatttttattcagtatatgtggcctttcatattttttaagattagtacaatgaacttttaccctgttattaacttttatattccttagtccctcaggaatataaatgtgggatatattaaattgcaatattcttgattcacaagagcaagttactgcagaagaatgatactgggcaaactgagggaacattaaatctgtggaactggcttccagtggctttgcaggacttattagaattgtggccttaaaattgccaagccttagcgtctttaactgtgaaatgagaatattaattgctctttaactcatggagctattgacaggatataatgagatcatttactcgtgtaataatttataaaataaatatttacagaatgcttactatgacctggacattgcactagttactgaaaatataaacaagattcagtctgggagagctcttagcctagtagataatagacacatcatagataaatatgaaacattttgcataaacaaaaatatatataaatttaaagcgtattataggagcatggagaaaggaatatgtagccacatgggtgttagaaaagatattttggagaaggtaatgggtaggttgagttcagaaggatgagagaaagtaaagaaggaataaaggtaggaggaggataaagatgaatctcactgagcagacagtaaggacaaggacagagtgataagaaactgaaagtacacgctcattcattatgcaattctgttttgttgcactctaaaatgtgagaaagggagtggcatggaatgaaattgcaatgagagttaggagcgagatgctggagagcctccttaagacctcttctctgccatcagataaacaatgtaagtgaaagcatttaaaaactgggggaaaaaaaaaaacagaaaaacagttctataaacactaacaattattcccattacacaaagcaattaaccataatctgtacaagaaaataaaatttttttgacacaaggtctcgctctgttccccaggctggagtgcattggaaccatcacagctcactgtaacttcagacccctgggctcaagcaattctctcacctctgcctcctcagtagctaggactctaggcacacatcaccacatctgtctaatttttaattttttttcttttgtaaagatggggtctccccatgttgcccaggctggtctcaaactcctggactccatcaatccttctgtctcagcctcccaaagtgctaggactacaggcatgagccaccacattcggcctagaaaaacattttttaaatgatatttccttgggggctagttaatatgttaattgaagatcttcatccctaatgtgacacagaaaatgtatctttaaaaggggaagggaatattaaagttgataccagtttagaaactcacgtagtgaagaaatgcaatgggatgagttaatttcacttaaagaaagaactatgaagccgggcgcagtggctcacgcctgtaatcccagcactttgggaggccgaggtgggcggatcatgaggtcaggagatcaagaccatcctggctaacacggtgaaaccccgtctctactaaaaatacaaaaaattagccgggcgtggtggcgggcgcctgtagtcccagctactggggcgtgaacctgggaggcgcaacttgcagtgagccaagatcgtgccactgcgctccggcctgggggacagaggagactccgtctcaaaaaaaaaaaaaaaaaaaaaaaaaaaaaaaaaagaaagaaaagaaaataaagaactatgaagtaatatgggagagcaattaagttcagtctattctctgcttccatcaaacatgagaaaaaaatgaaaaatatggaagattaatgataaacattagataaggttatgtgatattttggagcattataaaggaaggaaacaaatttaggacatatttagaaagtggatttactgtgccattaatattacaaaatggcagtgcagagtggaggaggctgcaatggaaaatggtatgaaaaatgctttctattaaatctgagtaatagtctttgattatgggatttttctaccgcctgaggtgacgttagtggtcagcttacaatgaggaggtctaaaataattaaacttctgcacgaagaacagaaaagctgttcatgtcaaagatatttctttatttcccattcgctttacagtcaatgtaatgcagtcttcactgctcatcatcctacaaaagttgttcttaataacatcacctacatcctttctcatttccaagagagtgactgtctggatcagagctgtaatcccagcacttagcatagaatgtgttacatagtagtgctcaataaaggtgttttaagttaacgaagaccagatttactttttagtcctcttctcatttttctcctctgcagatattaattctattaaactctggtaggcagaataatgcctcctcaaaaatggccacgtgctaatccctgacatctgtgaataaattatgttacatggcaaagtggaattattgcagatagaattagactttctaattagctaacttttgatagggagattatcccagattatctgagtgggcaggatttaatcacaggggtccttaaaaggggggaaatgttggcataaggggagaattagaaagcactatgagaaggacttggtccgaggtggctggttttgaagatgtacgaagaaggccgtgagccaaataacgtgggaattctctagaaaatggaaaaggcaaggagacagattctcccctggagcatccaaaagtacacagcccttctggcatcatgatttgagtccagtaagttccagtttggatttctgacctgcagaactgtctgagaataaatgtatataattttaagccactaaatttgtggtaattttatagcagcaataggaaactaataaattacatttcatatttaaggctattaagtgacaaatgtgtactgacacctactaggtggtagaaaaacaactgtgagaaaggcagtgtctctagcttttttccttctagcttagtgagagaagcagacacaacaaaagggtatgttgatacaaatatacagataagttgcctgatgaagaaactacagtcatgtgacaatcatatattaaggaaactaccttgaaaaatccagagcttccttgatgaagtgacatctcagctgagttttgaaagttaattaagagcagagagacaagtggtagaaaagagaactccagaaaatcaaaagagcaggtgaaagtgtcaggatgtgagagaaagagtatggtcctttcccagacctagagatggtggaggaggataaaaatggcagagatgaccctagaaaaagtgaaattatcatcaacctatttatgaagagcctgaaaatatagccagagggcagttcgaaatcaaagcagaattttaagtagggaaatagcaatgtcaggcttggcttttagaaataaatttcacagtgtagagaatatttggggataaactgtaaataagaagacacatgagctgattatacctataatccacgtgagaagtaagcatgacttgcattaatgaatggcagtggggctggaaaaggagtaggtgcattcaagatgtgtttacggggtagtattggtaagtactaattattaattatatgtggagttaggggagttggatcatggataatcaatgataaagctaaattccctgatggagaaactacagttctgttacaatcatatattaagagaactaacttgaaaaatccagagcttctctgatgaggttacaggctagattattcagaatggcatataagggccttcacaatttgactccagtgtactcctctaaacatattatcgattaggcctgttggcagtcacccatatcccaaaccttatatacatctaccaggtctgccttagtcacacaagccaaatttctccataaataaatcatatgctttcttgctttagtcctttgttcatgcactccctagaatgaggacactcactattaagatctaggtcgaatgtgagggttttcacaatcacacttatctccctggcataacttatcaatcaatccttctgatatatacatatgtgtaggcttttttctaattatgcatatgtgttacacacataaatactttaactgtatgtgtatggacacacagatactttaattgtgtgtgcattataatttataaagtgatttcaaatatctcatcttgcttacactcacacatacacacatacacacacacaaacagaaaattagtttgttgtcttccaataatgcagcccaaatcccactcattacctcctaaatgtgaccacacttagatgggagaattattatgtctttgcaactcctggcaccaaacatggtatactgaagcagaaataggtacttagtaagggtttgttgaataaatcaagtgactaatcaatactgtaattaaatctcagatctactaagtcctagaccaatgctttccccctgcacttcatcatactgctcaaactactctgttaattatagaccttctgtcaccaattcatttcctaaattatccattgagcacccattagacataaaactaactttcaatgacttctccccaaaatttagccttggaactgaaatattgctacttattttcatcactacaatgaataaaaaattaagagaaagaatatttcttgcaaacaatctgcctttatttctctaggtgaatttcactctgtaatatgatataattgccctttacttcatctttcatgactgtcatgcttctgacacaatgtaaaatgctatggatgacctgtctgttcctttgcctccactgcaaacgccacttctttctcaggtaggtcaattgcttttttattgtagggagttgttggactcagaaaccagattggaaagccatgtcagctcatattgaataaaagttctctcccattccctgccacttaatcacagaatttatgctccattagcaaattggagttatggtgagaacctaacataatcgcatagttgtatattcataaaaattgcaatgctctatacattggaaacatagcacaagtattgtagaaatatacttgtgaagaattaatcgaagttgcatgaagtaggacataatgacaatgagattgaagaaatgtattagagtggaagaatgatcagaactccaagagtatatgaaaaggtgttaagtggtctcagttggaaaaacagtgccatctggtagattgtgcaaacagttaattcttatcctcttaaaattgcatgtgttagatacaatgcaggccggggttacatcatacactcatttcagagtcaaataacctgagttccaactccagtttcacatctcattatctctgtggccttgagtaagttacttaacctctctgtgtctcattgcctctatttgtttcatggtaatagtaataaagatactgaattgtgaagactaaatgtgacacatgtatgacatattaatgctgagaaagagaaaaaaatagacaaaacctataaatctttacttccaaatatattacaacttcccgtgggtcttctgtataaatgacattatttcataaaatagacacgattgctacgtggcagccatgttaataattagtaggatttttatagtatttgtaaatatgcaaaaaattcaagtcttctcgatttgaaagataaaaacaaaatatgaaatgatattcacataaattatacctcctcatgctcaaaagaatgaagtaagtttttagtaataatggaaataatggatatttctgtggtgcattataatttataaagtgatttcaaatatctcatcttgtttaaacatgagtatgtgggtgtagacttgttaggagtaaaaataagttactattaattagtatgcagacttgaaatgtgctttggtagtgttcatgagaaagatgacttatttttgttaaagtaataaccatagactaattatgacagaataaatcaaaataaggtcaaggtctccagtgtaatttagaggtgaaattaactacttggatattgtagcagaactgctaactagatgcctgtttccatacagctgcctactcaatattacttttaaaagattcaaattctcccctgaaaatttaaaaaaatacattgttctgtggtgtatatttatctatttttatgggttgcaaaatacttctttgcaaaccaaaaggaaagcaaacagccaaatgtgcacgacacacaacagccatttccaaacatactgttaatgagatgctttagaaacagacaaatggtcaaacacagggcctggattataaggggatatttaaatcacaagatgtatttactcaacttacactatggagtaaaggttaataaaatggcatagtagatgaggataatgcctcatcccttatttcaccgagccatccctgagttcacctataactatagtgaacggattctgtggatgctgaagattcctcaccacaagcatccacatctctctgtttctttgtgttaaggctttcttcagtttaggagggcttggtaagcccatttgcagggcagtccagaagtgatagagatttagttctcccaggggcaaccctcaataaacgagggacagaagtctatgtattaaaaaggacaaaaaaaaaaaaaaacaatggaacaattgctaagcatgccctgtagggctcctcaattgttgcatgggatatgtaatccagaatggcccataggagcatcgttattgtctgctctctgtagtggaatttgggcccacatttcttggcttgatcatgcactagttatgcagtgttagaaaagactcataggccgggtgcagtctctcatgtctgtaatcccagcactttgggaggcccaggtggacgcagcatgaggtcaggagttcgagaccagcctgatcaacgcagtgaagccccgtctctactaaaaataaaaagattagccgggcgtggtggcggacacctgaaatcccagctacttgggaggctgacgcaggagaatcacttgaacctgggaggctgaggttgcagtgagccaagatcatgccactgcactccagccccgacaggagttcaagactccatctcaaaaacaaacaaacaaacaaacaaaacaaagaaagaaaagactcataagccacaccaaacccaagatttccagtctgaaaagaggaaataatcgtggtaaaaaaactcttagcttcactttgatgaggtatcctgtaaagcatcgaaagtagtcttaagcaaagacttagtacaaagtaagtgccaatagagatcagtattattattcctgactatatatttaattgcattagaacttcttgaacaagttggtagtttacattatttgctcatcggtttctttttcttcctcctttccacttgccatggttcaccatgggtggattacacatcccactcactgatgtggccttggtcatgtgacttgccttgaccagtggaacacagtcagatatgagagtgtgtcaattctgagctaggggcttaagaatcataaagtgttttcacttttcttggtccttcctccctttgtcaggggaagtacacgcctcaggtagcctctgttcctaaaaggagagatgcatagagctgacctgtactcaatacaaaattgaacctgacatgtgaataagaaataaatgtttgttcttataagtcattgagatttggatttgttttttacagagcattagcctataataaagctgactaatatagcaggtaaatagtaaatgtggcccatagaataaaattcaataatgatggaatgtatataacctcttcatttaaaaaagagagggttgtattccatcattaaatttaaaataagctgaagaatgggttttaaatgaagtattaaaagctttccaaaaattgccctttcagaatatattatcttttaaatcttggtctttctccttaccataccattcaaaatttaaacattaaaacaagcaggttgttctcatacatggccaagtattagcacagacagaaatcaatgtagaaaacaatttaagtggaaaataagttttaaggaaatgcagtgagttattgtaatagcaatggtcagtactgagcctgctcatttccaccttgtgccaaatactgaaagcacttaaaacagaaataaagtttcggagtaatcattcactccctgttcaccaaatacggaagtcttaagccagtgtttatgaaagatcaagccaaaaattataaataggaatgaaggccaaacatgttttcagcactgacgggaaactttgcagtcagtaaaagaacattagagtcagtcttttagaaaagggtttggaaaattattactgagaatacaaaagaaatcctgggagctaatcaaaagaggagacagttttgagagttaatcaggtgccaatgctaatagattatccaagtggcagagcaaagaaggtccagagtcacacaatcaatttttattcagcttgagttgctaatactgatgacaagtggttaacgactgcttcttccaagattcttaatgaaagacttctcttttctcaggtttattatgccactggattaaaaaaggtatttatttctgtactaagatcggtgacaggactacaccgagaacacgtccctcagtgtacattgccaatagatgagttttgtctatatcttgattgactaatcatttaatagatgtgagtgtaggttggcatgcaaattaagtaacttttggccaggcgcggtggctcacgcctgtaatcccggcactttgggaggccgaggtgggcggatcacaaggtcaggagatcgagaccctcctggcaaacacggtgaaaccccgtctctactaaaaatacaaaaaaaaaaaaaaactagccgggcgtggtggcgggcacctgtagtctcagctacttgggaggctgagacaggagaatggctgaacccgggaggcggagcttgcagtgagccgagatcgcgccactgcactccagcctgggcgacagagcgagactccgtctcaaaaaaaaaaagctctcatactagccttattgtttgcacttaggtatcactgagttgaacttgtagaggaaaatataacagaattacaaaagatttagacattgtagaaaaaatttggatttttattatataaaacaaacaatagattttgaggttttaagggaattttctgtttcgaaaaacagcattttaagtatagttttatttcatcttcataaattgtaaactttattttaaattctagtcattacaaaagactttaagtcaaatggcaaattgctttcctctatagccaatttaaaatgtttgaatggttatctatatatacatatgtattcaggttgtgttcatatacatattgttatatacatacataagcttcatacatatataacatataaagttcatatatgcatgtgtataattttatattctgatatgaatataaaattcatgaattgtagcacactgaaaacattagtttttgattagagaacattaaaatgattgtaaagtagaatctccagaatttccaaagtttgtaaattgaagacattcgaattttctaatttaaagatttgatcattccgagcgcctactaaacgaattataaagggaatggctttcctgaattacagtaatatggtagttttagctttgaacctgcctatctgggttcgaaaggtagttctgctacttattaacagtgtgcctctgtttcctcacctgtagaataatgataataatatcggtgtagctttgtcatgagctttggatgaatgttcccacttgaaccctggctctaacactaacttgctctatgggcttctgttaatcatttaattatgtggaatacaatttcctcaactttaaaacatagaatttggaaaagataatttctatgtgttccgccagttctaaaactctatcatctgcttctttattctaggtttttgtttgtttatttgtttctgcaggatgcagtttacagtccttgttggagtatgctctggaatcatacggcctggatttaaagtccagttttgccgcttactggctgagttttctcaatttatttacataacttttctttcctttagttttctcatctgtaaaataggtactaaaataataactatctcatagtgtcgttgtgaggactaaataagccattatctttatatggcatagaaagtgtctggccccaaatgagtaatcaacattgttattcctatcctgaaatctatgggctttcaatacgactatggaataaacccctaaaattgtgggcaaaattttatgagtgtgtatatatgagagtccacagtcatcagcagattctaaaagggctccatggtttgaaaaatgttggatgaaaaatatagacattattctggctcttatggatattaatgatctctgttttacttttttctggaacagtggcattaacagcaatagacctgtttttattatttttctttactttgcttttttttacatgtttatttaagagatctgctcttcatctctgtcaccattgtaccattctttttatggatatacacacagtaattggcactgaaagaggtataattatatacactgcagctatgccagagaaagccagggctccttatctggcctagggaataaataatgggttttcttcatattctcttagatattactcttcagccacctaggattgggcactatttttttgttgttgttagtttcttgtgcttccatatacacagatgcagtttcttgtcacccattatattgcaatgccctttctgaaaagagcccagcctttttctgtaatgtactttgacagtaagtattgacataatgtaatacagtaattggaactcagaaagatttgtttgctacctgactgcttaagatattttaatgccttaatcggacacatatttttaatgcacatttttctttagttagagcagcccatgtcatgaaggaaccactcaaatgtggaattgatggttttcacaggatataaaaaacatcatgccatacaagaaacaaatcactcctttctgcatagatacagtgaattcacagcttggaaaccagtattttcaaagcgtggtatgaaagtgtctgagaataaactctcagcagagatcagtagaaataaccagtaaccgctaaaagaggaacattattgattggcaaagtaatccaaaaaagagaaaagatgtgtgtgaacttaatactaaatttagacaagtattcattgattaggaaatcaaaattcaagataaagaaacatcttcagagattaaaagtagtctttcattgtttgagtaacctagctgaggagtcaaactaaaaccaatagattgtaattagtatgatgctttaggataaagttgaataaagagagcgagagagagacagagagacagatgcattatttaccctgatgtttatacaatgccaaggtcaattaatttataaattaaatttatgtttattagccaaattttagaaactagagaaaaagtgagtattaaaagctttaggatttaaagtttgatatatttcctttgcattttccttgcataattgtaattgcattgcacaagtagttagacaccttactttcttcatttaaaataacaggttttccaatgttgttcaaacacaatttaaatatctagaagcattgtcttctttgttcccataaaaattaccgttctgcttttttttggaaccttgaaaaatggtctcataatttttgctattaaaatagtcttgcaattactatcaatatagataaagcctccacccaaatgtgggattattaccttagaaaagagtctcaaaaattataatggatttaggtgaaaaatcatctccgtaagttttggtacatattttcaaattacttctcaaaaattccatattaaaccacattcctacctgtaatggatgaaaaggtctataacgttgcattgtaacctacattgaatacattaaatagaaatgtaattcatatgtaattcaatgtaattcacatatatgtctgtgtatgtctatctaaacatgaatgcatgtgtgtgtatatatatatatacatacatatacatatacacatacatacgtatgtatttaaagaatttagacttgggtcttagaatcaggctctccctgaatccttcaactgcgagatataaatataagggaatgttggcaatcatggtctgctacatgaggaacagcggaagccaatctgcaataaaaaagatagtttagagagaaggagatgtgacagagagtcctggaaggttttgattgcattttctgaggtgtactgcaatttgccctaacctgccttgagaaacattttaatccttagaataaacgtatcctttggaataaattccacatttgataaagatagttcaaatttggtataagttatttgtagccaagtgtcctaattaatactcaagtaataagtagtttactgcttaacagtagaattagttctatttcatataatttttccatctctcattcagatgggaagttgctctccttcctcttgtaaggtcatgatgctctatatctgcaaactcaagggagaaaaagtctcttaacttgaaactatacaggaaaaaaaaaaaaccctgatgtcatttctagtacttaattggtatttatctgccataaacacatgaagctgttttggtttgttcagttacccttgtctgcatagggccatttaaacccaaattggaattgtctctgggttactatcagtgataacaagaactttcaattcatgccaattataggaattcacaaacacagataggggtgaccaaggaatccaaccagaactttctgtttagtttcattagactcagacttaatgagaaaaaaaaatcattagcactgaaaaacttgtaagtcttgtttagtttcttgctgaaatttaaataatactgattgtgtctgtgatggaaactggtaaagaataaaatgaatatttaatttagtaaggtatacaaaacaaaacatgagagggagcatagctattcctaaatggaaaaataaattggtatactacaataggaagtatgatttccttttaatatgtttgttttatagaagttactaattgcagaaaccattttgatttaacatcatcaataaaatcaatgtgtgaacaatatcattacattcgaaagatgacatgtctaacaaaatggcactatcaatatatatgtatttaaagacagtctccctttaactttgctagacaccaaaagtttaaatgcacaatgccaagggcagttaagtgtcaaaatacaaatgtatcttaatattttatttaaggcttctattgttaaaaataatgcatctaacataataaagagggtatttgaaatttcatatttcaatatccccatggtttgccatagaagacaaatataaatacatgcatgaaattgtgattttattttcttggttactttttggttacagctcatcactttgcattagtgcatacctccaaacctccaataatctcatatgcatcattataaggagatgaaagggattaagaaataagtttaagtcagtgcatagaatattaaaagttcctttgcatctaatatgaatggaagtgattactattaatataaactcaataataaaataagcaaatgcctgcttttattttctcctaattaacaagtttaatcctttgcacttaatgttagttgtttgccccggagcccggcattggtagacatctcactgctcatgggccattcttgtcaccttgactcccagctcaactttgggatggatgtttcaaaccacctgcctcgatgtgttcaaactttgtgtgagagcatttttgaaggaatgtaattgagtatgaattatgtgacagtagatatgtgaattttgactgaaaagttttgtaaaacttgagaaatgaaccttttggctgggcacggtgactcacatctgtaatcccagcactctaggagctgaggtgggtgaatcacttgaggtcaggagttcgagaccagcttggccaacatggcgaaaccccgtctctactaaaaaacacaaaaattagccgggcatggtggcatgcacctgtaatcccagctactcgcaagtctcaggcaggagaatcgcatgaacccaggaggcagaagttgcagtgagccaagatcgcgtcactgcactccagcctgggtgacagagcgaggcttcgtctcaaaaaagaaaaaaaagaaaaatgaaattttttcttcaattttatagtaaatgaagaaaacatttcatttctccgaagactattttgattgacacccgtagcctatgggggtttcatattccctcttttccgttgttggagatatcatggtttaaatttttaggaagtatctcaatcattcataaaagtgtgagtattctaagttacttcaatgagatacaaaattttggagccctgcttccatgtttcaacttcaaaagtagaagtcagttcgaactccctggtgactgcacttgagaataaactatcagtcaataccacactccttatcttttctttttccttcctacgcccaccccaccccaccccaccaaacaaacaaacaaaacaaaaaggccaggacagcaggttctacacttttgaatgcaattttggacagtgtgccaaatctcagtttcaacatcacaaattaggtttcacaaatggattctgaatatacaaaatgcttttgagtcaccttttttcttcacctttaaattaaaagctctgaaatacaatgaagtgttttcttcagcttttcatgacttttcccattgggtgattcacagataacaggtcctcaatacatttttattaaattcaatttttaaaatatcacttatctactacggcctttctctaataaaaataagtattattcattgtttccatctaaagtaagggtaactgtaatgattaacatgtcgaatgtggatatcccaagagggtaaaatacttacgctttccatcataatcaagttcctcttctgcttaggatgtaaaaatgctatataagaacgttgctccacccaatgagaaaaagcagggtgatctataaaaacgtattattttttgagccatttatatagctgtggccacaaggcaacgaggtgagccaaagtacttcaatctcctccaaggagagactggatacatgaaaggtttacctttggcagggaactggaggaagaagtagtcatcgtaggagcaggaaaaagaaaatagctccaattgtaaggcattcttaaaagtcaggtgtgggctggtatgacatttcagcatccttggaaatgcagaccgaaggagtctgcactcattctggaattcttttccacaaacttctattgggaacttgcaaaaaagtaaggcgtaggacaagagataggaagaagctcccctcagtgacacacaaacatgaagtcaaacccattttccagaccctcctcttctaaaaggcgtaagatttaaggaaagatactaaactgaaggaaagatactaaactctaccacccatgggacccgcctgttcagaggggttggggaaggtagaagccactgagagagggtcaagataccctctttggaagagcagtatgataacctctttggcccaggattctgcaccaataaaaacagaatgatctgttaccactaggggagagacaggcatataaggcttgctgaaaactgaggatggaacaagaagatagaaatccctttaggaccgcagacactattacattaagcacgggatagcagcagcccatcagtggaggtctttgaagactgtagtgttctgaaggttgctacagcaacaacaacccccgcccctccaaaccagctcaatactaacaccactgactcaaaccccatactagcagtatgacagaaaaaaagctatacctatttccaagattaaacatatttacctcattctctatttttcttctatacatgacatctaacattcactaaaaagaaaatgagacttgcaaaaaataaataaaactaagcaaaatacacccattatcaagaagtaaagccatcaacataaccagactaagagataacctatatgcttgaactaacagacaaggactttaaaatatctctgactgataagataaggaatagattcatctagatactaaagaaaacatccaaaactttcacaaacagatgggatgtttcagcacagtgatggaatctgtaaaatgatgcaatggaattgctaacaataagcaataatcaactcaaaatgttaatgtagcaattgcaaaattatttctattataaaaaatgttaaattacaaagagaataacagtaccttaaaatgacacataatttaaaatactacagatgttaatattggaaaaattgtttaccaatgttcacacctgagtactcaatcctttgatggaaggtatgacactataatgatttattataaaaactccttaagtggccgcgcagcctgcgcatgcgcgccggcgaccaagcctaaatagctaccgcctctgcgcgtcgccctccacggttaccccggctttccgcccctccttctcgcggggctcgagggaccatggccgatcctcgcgtgagacagatcaagatcaagaccggtgtggtgaagcggttggtcaaataaaaagtgatgtatgaaaaagaggcaaaacaacaagaagaaaagattgaaaaaatgagagctgaagatggtgaaaattatgacatcaaaaagcaggcagagatcctacaagaatcccggatgatgatcccagattgccagcgcaggttggaagccgcatatttggatcttcaacagatattagaaagtgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgcggtgtgttcaagtagtatgagaatgtgattgtttttatctggttacatatatatttctttgtctaatttaatatgtcaaataaatgagttcatctaaaaaaaaaatccatacgtgatgtgtggtttatatttgtaactgcctatatgatatatattcttaccccaaccccatcccatcatatagataagaaaatgctacttatgtgctcaggtttacacaactcttagatgtctctgactacaaagtctttgttctttttaatgtacctctatgcctctcatactttaaaattgaaataaattaatctactgctccaaatgatcaattttccatggaaaaaaaagagaacttttgtaattgtaacaacctctgctatatgactaaacactgagccatgaggtgggctgccaggtaaattggaaggcttcatctaaaaagtacaagactgtgaggcatattcccttctcaacagcctaggatgattggatctacccattctgtcacattttcaatatataattcctgttcaaactttctattaatatatcatttcaagtttcattgatagtcctaaaatgcaacacaaaagacgagcagatgatttcagccattccaatttgcagccttttgtagaggggcatcaatagattttactgtacttgcataaagccctagttgttcttttcctattctatcatttctggattggcgaatgggataaaatgttcaggaaagaaaaaacaaatctcaacacaaacgtgaatgtcattgaaagctaaaaaagtaaacaaagttaatgatcacacccgtaagtgctactgatttttcattgaactcagaggagaaagttactggattcccaaaagtaagtgaagggtatatgtttgctaaatgcattcacagcctgttgctctaattatttgaggttttttatgtgttgttgttttagctgttgtttgtgttttttattctttctgcatttttcttctactgtacagttgttattcatgctatgagttatctaaagtttacattaataatcaaattccttgcaccatcccaactctgaaacacacaacttggatggagattaagactcattcaggactcaggcagacatccttagtacccagaaccacaacacagcacacacgaatgcatggttctataattattttatggagcatctatgaatttgctatgcaccggaccctgggaagtcaatgtacagtggtcaacaaaaacaattcaattgtattaatatttagaagccacaaaatgcaaatatattcttttttaatttgaagcttgttattcttctgcacaatctatagctcctattagaatcattaaagtacattcagcagcagtaacaaacgaacagggaaaatgtgaacatgacaaaaggctgccagagtaacacgggtgacaaatgtgggaacattttagaattcccaatttcccactctaataaaataatatgaacaaaaaggctttttttagtagcttcaactgaaactatcacctgatctatttcttaaaatcctcacgaaggtttcactgaaccattagaggtttgggcagtcaaacaaattaaacatgaaccaatctttttagaatgactactgaagtgctcagtatttccagccttccagttaccacagtgaaagaaacaaacaggtacttgtcaggtttataagggaatgatctattttctgcccttttttgcctactctttaaggaaaacacacacacatatgcatgcaagcatacacgcatgcacaagcagaacacaaatttagaagctatagagaaaataaatagaaaacaaagaagttttgacaaaaccaaactgtctttacttttagattataaaaacaatcaactcttttttttattattatactttaggttttagggtacatgtgcacaacgtgcaggtttattacatatgtatacatgtgccatgttggtgtgctgcacccattaactcgtcatttaacattaggtatatctcctaatgctatccctcccccctccccccaccccacaacaggccccggtgtgtgagggaattagaattttgtaattcatttgggtagaggagcaaaaggtatatattaggctcaacttttcagtcggtgatgagagacaaatggcctgccatccctgccctctctcacctaccccagttaatctaaatctgcaaaacgaaaggagcttccactaggccagaggggctgcaggatgggaaaacaatcagaatggaacactttcatgggcgttcctacagaccaatttgcttccagtcagcccatttaatttcatatttatgattgtttaaaagagagagcccaggcgcagtggctcatgcctgtaatcccagtactttgggaagccgaggcaggtggatcacttgaggtcaggagttcaagaccagcctggccaacgtggtgaaaccccgtctctactaaaaatacaaaaattagccgggcgtggtggtgcatgcctgtaatcccagctactagggaggcttaggcaggagaatcacttgaacccgggaggaggaggttgcagtgagctgagatcgcaccactgtactccagcctgggtgacagagcaagagtcagtctcaaaaagaaagcaaggagggaatgggacaattcataaaagcaagccccagcagttctagttaactgtgaactgaaccagtaagatgcacattgatttaacttcggaaataatttatgtgctggtttcttaaatgactgctacatattgccttcttacctgacgatggagtgcagaatatggggacaaaaataagagcaattccaaggaaatgctttatgcccgagtgctaattcagaaccatactgaaaaaggagatgcaagagaatgctcagcgtagattctaggccatccttaaacaatccagagctgaagagccgtattcagagataaatttattctgcgttcaatgtttcttgacctacttctcgtaaggaaaattctgcctgaataccagaaggaattcatttttcactttagcttgaaatttaccttaagataaaacacaatagttgtataaaaatatgccttatttggttatgcatataaagcagacccaagaggatttggggtaaaatatttcataagttgtactatgcatgaatataaaaaatgagaaacaaaaggatagttagtaaaaggctgttcagtcccaaataaaggagtaattgttgatatgctaaataaaaggggggtggggaaagtcctttttttacaagggaatgtgaggaagggaactcacatttgttgaggctgtattttgcatttaatcctcacaactaggctgagaacaaacattaggcattttatttcccatttacagattgtaaacctgaggcaataggattagttgcctgtgataacaattcacatgttgagaatcataatattataggcctccaccacctaacaatgccatcttcagaactacacacacacaggtgcgtacacacacacacacacacacacacaagtatttcgtgagattgtaaccacattcttaagttccatcctttgcaagtaaggtaagttaggcactgtttcctcactgccttagggttgtttataaatacagagctcttgaattacaaaatcaactcttgatttcactgacagaggtcaactgcttttagtgtaagtgaaccatgattctggcataaacagatatagaagaatcctgtttaaaagtttttacctgctctaggtgcctaccaagagaagaagagggggaagttgagagagttacagataagtgagagctagaagccgtgtgggggtgtggggagggtcctgaccctctgacacacacacacacaccttttcaaataagaggaacattataatgtcctcttagggaaccaaagtcctaaagaagagaaggaggttctggagctgctgaaaaatagtgcccaaccagagcaaagggactgggcatgtagattagcctcacaggggtctgagcatctcatcaggtttgtgataagcagctaacatgtgtcggtgcttgagaaggtcatggaagttaggaggagcaagctggcagtctttcaagggtgtggtaatcaggacacagacaccccaaatcctggaggcagaataggcagttcaactaagggcgggatgcaggtactggttcacttcagccaatgcctgcatgcaaagatcttcttccccacagaccacattggatgtcacatctctgtgtgtccttgacctagaatcagaagttggccctgatgccatgaagctaagtaatactcctgtgttattccaatcctagagtggaggctagagtcctaacaactcctgaatgtgaccggtagacctgaaaagtcactgaattttattaagatttcctgagaatggtatattaagaaacctgttaaattaaaagaggaaccaaaatagaaatttaatttagctatagaaaaattaataaaataccatttttagcccacttaaatttgtgtgatactgaaatttttttttcctgctacagatgtataatttagtgcaaaggtgtagggcccaaggcttcactgtgaggaatgtaaatgtgctccccaaaataatttatgattttgactaatgtctgcacaaaatactatagtccataacaggtttcaaatcttataacaactattaatactatcaacatgtagaaataagaaaactgaggcttagagtggttggactctatccattgattgcccaggataacatcaagtgactgactgggggctcaaaattgttctcctgattgtaaatatcaatcctgtttcctatacttgtccatatacttcctgatgcctatttggtgctcaataacttttagattgagtaaaagaatgaacaaaaacatgtatttatttagtgcccggaaggggcatagcaaataattgatatcctttcctatctcacatagcattcagtacagcaaagtaagcaaaattgaggagggaattttaataatgttgaacatctacaaattgctagacactgagatttttatgcactttttaagtttaatcttcgtgttaatccacattacatatgaggaaatggagagagaatatagtttgtcaaggtaatggccatagtccatataatttgagtgcttactatgtgccacctactaaacactttaaacacatgaacatacttcattttcacagaccttgtaagagaggtacttctcttgaccctattgtatggataggaaacaaagcttagcgaggttaagtaactgcccaagttcatatagctactttgcagtagatgagcacaaattgaaactcatgcttctctaactccattattaacccaatagcaggtgctgaaaatcactgatcgtgttgctgacaaaggagagtaaacaatagccacataataatactatctaagggaacattactgatgtacctagattttttaaactttcttttatttatgaaaataaaaatgaatatattcgattgtattttcattcttccctctgtttgtgccactttaaacactggtgcctcccttctctttgacccaaatactcaaaacaggtcacacatttaaatatggcaagccctccagccctgcaaatgatggactataaaatttgtttgtactactggcgatttttttttaaaaaagcttatgcacacctactttcatatttttaggttggacagtaccttagaaataaaaacaaaaattaaaacagatctttatcttttaaaaaatctattttccaaaaggaaacaaatgaattatttttgtcttattattaccatatagcttaaaaatcaattacctgaaatcattatcattcaaatctttaaaacaaggcacttaaatgtttaatcttttttaaaaacttagccaatgcaaaactgctttcctccaaaacgccctcagaattacctgcttctcctgcactcttagtatccccaagttattggcagtgaataaaagtgtaaaggaaatgaatcttgcaattctctgtgaatttcattccaaaaaagaattttaggcattttgatgaagcgatgtagggattagttttaaatagggatctctgatttgtgtattattttcacaatttgtaaacttactttcttccaaaagtgatttgaaataaatattctgaaacactgaagatcaatggaagctaagaattagaaatgcttatacaaatctattaaacctaactgtatatatgcatataatatttttgttaagaaacatagaattctttagaataattcaattttatataattatggatacagacacatagattcacattgtaatgtttattcagattttgtgtttatttgttgattgttcaggcaaacggaaactgcatttggtgtcaacagttgcatttctttatatttatattagctggttagctgtgctggcagaactaaaggaaacctgtccatagagccttacgtagtcgtaactacaacacaatcatgtgtcacaaatttatagcacagcagacctttacactgaaaattgtttagagaaagaaaaattcgactgggagcggtggctcacacttgtaatcccagcactttgggaggccgaggcgggtggatcacctgaggtcaggagttcaagaccagcgtgcccaacatggtgaaatcccgtctctactaaaaatacaagaaaaattagctgggcatggtggcatgcacctgtagtcctagctattcgggaggctgagggcaggagaatcgcttgaacccgggaggtggaggttgcagtgagccgagatcatgctactgcactccagcctggctgacagagcgagactccccatctaaaaaaaaaaaaaaaaaaaaaaaaggagagagagagaaaggaaaacttgaaaaatgaatgagaactggtaaacaactgcagggaaagtaattaccacactcttcatatggcaaactaaagaaagggggcaccgcaagaaaagtattgccagagcttgaagggcagaatgtgtaattaggatgtgatatctggcagtggtgattccaatcattggggattaaaactgtatctcaacttgtgctctttctgttgctttagggccagtgtattcactcaatcttccatgatatctatatggactcactgaacctcagatcttaacttcagttgagcagaactagtcttctctctctcagaccaaggaaggcataacttgtgttccatgaagcctactgtgtcaagtctgccaaatgaaactttaaatatgtaggcattgtctacttagcctgaacactaaaaagagtcctttctacagttcccaaggatttgtttggttgcaatgtttctaaagtcagtacagaaacttccctgaaaatggagctccaaacttatcacgattttcatcctggaatgtatttaggtttgtatccctcgacgtgcaccactcaattgacgtcacatactttttacctgaaatttatttcagtttctcagaagactgtatatttccccagttacagattttactattccttaaatatggtggctgccactttcttaacctacagtattaatggcagaaatgcttagatttataaaaggcaaacatggggaaaagagagacaatattaaattcaagtctctcgaaaggaaaggaaaagataatgaaaaagcaatgtaaaaaatgagagataggtggggcaggtttaagatgccattgaatctctgcatagactgcctttttttttgctctaaatactaaacttgcctaaattaggccacctccctccagagaacaaaaggaaacttggccactatggaatagtaccaaagtgaatttttagaagctattattacccactcataatctatatttttgaaaattaatatatatgtatatttgtaattatcaatattaatacgaagcaatagggtcaacatgaacttggatacttctgttaagttcacttaaatattgaactaatctaatcacttctcattttttctttaaccaaatatgtaaattcaatataattgacttagttctcaaattggttcaataaagtgttcccacagtatttgcaaatatattcgtctttagaatattcctccttaacctttttaagtagaaattaaaatagaaatattaaaacgtgtatttaaaagtggtcttttctcttaacagacatttactttttcttacatgaattggtttagtttttttttccagcactgaaaccattccaaaaaaaactgtagaaaagagtgaatatttattctattggatgtttgttatgtttgcataataactaattagtgaattgaggccaactttgatcaaaatgtttgctctgaatagatatttgctaataaataattttttcatgtgataagtgtgtaataataagttctctatgctgccttgctttgatagaatattcagacaacatttataaatgactaattcaaggaattaaaaggtcttaagtgccccagaatgtagaaatggaataaacatgtggtagtggtgagggtgggctagaaatgattaaactagattttttttaaaaaaagaagcaaaaataccgctggaaaaaatgcacgcagaataaatgtcattatgaaatattctgaacgtgtgtacttgattttccttcatcacggcttcattttgagacgtccaggtcaaccactgtcaaccaatcaatctctagcctctttgagcagagatcaagggcaacagcagagccttaatgatttcaacctctagccttcaagggcacagattacagggactgaaagtaaatcagtccatcacaaggcacttcagcccatagcccatgacaaagcttgattagaatggaaaagtgttaagccatcaaaaacaagacacagctataaggaaagaggaaatataaggctaatgaattttagtgttcataacaagataaaaatgtgtttctcaatacctgtgtagccatttagaaatctaaagagcaagaagaaaattatgatagaacattctgagcaatttcttcctcttttctcaagagcagaattgagatagacttagatgtcaagtctacccattcttctaggccgttctcagacccattttcaaaaaaacaataaatccaaaagccaaaagcaataaacttgtttaaatactgaagttcacatggtgctcatgttttcagaaatccacttacactttacacccataatgtaagtaacgtaccctttaaatatttaactgctcactaatgtttttatttgcatatcatttctttttaaaactagataacacacacttttttagcagatatctttggatcttcactatctcaactgacttttctttttttttttttttttgagactgaatctccctctatcgcccaggctggagtgcagtgtttcaatctcggctcactgcaacctcctcctcctgggtccaagcgattcttctgcctcagcctcctaagtagctgggattagaggcacccaccaccacgcctggctaattgttgtatttttagtagagaaggggtttcatcacgttggctaggctggtctcaaactcctgtcttcaagtgatccactggcctctaactcccgaagtgctgggattacaggagtgagcccctgcgcctggcctcaaccgacttttttagaccacaggtaaatgttagttttacttaatgattgtaattattttgatatactctatatggaaaataaggaaagtattttttcccttttaaaataaggaaaatatataattacgctctatttttttttttttttttttgagacggagaccggctctgttccccaggctggaagttcagtggcacgatctcaactcactgcaacctccgcttcctgggttcaagcaactctcctgcctcagcctcccaagaagttgggactacaggcaagtgccaccacgcccagctaatttttgtatttttagtagagacggggttttaccatgttggccaggccagtctcgaactcctgacctcaggtgatctgcccgcctcggcctcccaaagtgctgggattacaagtgtgagtcaccgcgcccgacctaaatatcctttaaatctagtgtatctatgtgactataatgatgagaagtcaggatgccttccctacagctaaacaaagacttttctgaaatgtatatttggagacccagaatttcaccttatttgaatgcaaaacacttagaggaaataaatcttaatagaaatgatttttacagcatttcgaacacaagaattgtagtttaaaatattgttctttaaagctataagtaaaccaatgtttccaaactgttttttctagagcaaaatttcctagaaccaaaataatcttgaaattttagattaaacaaagcaaaacagattaaatcacctccaagtttctcagaatcttcaacatacaaatggctgttaatatctcaaaaaggaataaaaactgtttttccaaatatatacgagaatgactttttttctcccctagaattagctattgatgccaagctcagtgtttctcatatagtttaaaacacacggaagtaaatttgctgttcccttataaacatatcctgataatatggaaacatttattcaactaactaataacaaaacaggcaacaaattaaaactgattcaaaggggaattcaagggactgaacacacatagtcacagaaagaaaaagaagctagaacaagattgctaagttagaaacaaaacagattaacatcaaaaagtgcaataaaattatatattttgagggtgccagaaagatattacttgtctctctactgaacaaaaatgtgtacatttatgtaaaatttctcagaatctaagccctaatcaatagtaaatactatagggtgactatagtcaataataacttacttgtacatttttaaataactaagagtataactggattgtttgtaacacaaaggataaatgcttaaggtaatagatgccccatttattctgatgtgataactatgcattgtatgtctgtatcaaaatatctcatgtgcttccaaattatatgcacctactatgtacccacaaaaaaattatcttttaagttagtactaagttatacaaagacgcatgtccctaacaaattaaactatctgtcggtagatcttttagacaatactttttagtatgataataaaagaacatctacttgttcttttgccttatttccaagttttagagtttaacaagcttgaatgtgtcataattactcatttaattactcacgtaattacttaagtgtcaggcattgtgctggggactagggagatgatagggaactggataaatgcccatactttttagaagcttactaatgagggataatgacatgtaaacaggaaattgcaaagtggtttgatgtatgttaaaacatagttactgtgggccgggcgcggtggctcatgcctgtaatcccataactttgggaggctgaggcgggcggatcacgaggtcaggagttcgagaccagcctggccaatatggtgaaactccgtctctactaaaaaaatacaaaaattagccgggcatggtggcacgcacctgtagtcccagctactcgggaggctgagacagaagaatcgcttgaactcgggaggcggaggttgcagtgagccgagatcacaccactgcactccagcctgggtgacagagcaagactccatctcaaaaaaagaaaagaaagaaagaaaacaaaaagaaaaaaaaatagttactgtgggatgttgagatgacacacaagagatattcctcctgtaacgtcaattctaggtatgttccaaaaaggagacatcacctaaatgataaactggagttagctgggtaaaaagttgaggtgggagatgacatttccagaagaataacagaagctagaatagtgacttgtatgacatgattagtacgtacaatgtcgttcttgagggatgggtgggttcggtgggtgggaaggggtgaatgtaaagagatagtgcagaggccaattaatggagagattggtagagcatcttatagaattcagatttcacttttggggcaatgagaatttggcataatgagtagcattatctgacttacattttaggaaaactctttttgataacaattgggaaagtggatttgggaagtttgaagaagggaacgtggcaaataaagagacaaggaatcaggaggctattgtaatcactcaggtgaaaaggtggtataaactaaggtaacagccatggaaacagaatgatcacatcagttaattgttcaacttacatacaaaccacaaatccaatcaactaatatttcaaacgtgcaaaatatgtttggcaggggtttattacgaatgtttctataaattatgtctctatacacatatctatacatatatatacatacacacctatatgcctatatatatattccatagttttgtgaaagtgatggtataacaacaaaaaatatattctgtcatatccactgatcacaatagactttgtgcctctggttattttgcaaatcatttaacaattagttttcatttaaaggaagtttataagttaaagtaaacataagacaaatttattcttgaatgttaagccctcagcatcgaggaccatgaaaatactgattaattagtgtgacgaaggaaaacattgaattaagtcaactagttattcagttaaatttattttgaagaaaccgcagaaggttttctagggggaagatgacacaatcgaatatgctttttaaaacattctggctgcatgtggaaaactgaatcacaggggtgggggaaattgaacatctgttttaggggaactgcaacaatcctggcaaaacatgatggctgatgccaaggtaatgttagaacagtgatctcgagggagaatgcaagaatgatacccccaaacctgagaagtttggcacatgatgtctttcaatgagctagagaaggaggaagaattgcttagaaggcagtttttgatctcatatatactgattttgaattaactatgtgacatacatgagcataactgatgggcagggggataggtctctagctcaaaagaatgattttggttggatataaaaatctgagggtcatggttaagagttgttattgctatggattttgatgagatcaagaaaaatatgttgattgagcattaagattgaagctcaacgttaaaagagatttacgataggagagcaaccctccaagaaaatgataaagttgccctgagacaggaaaactagaatagtggaatatcttagaagccagggaagaagagtttttccaataggaaggaccgatcaacaatcaatactacagagtggtaagatgaggcctgatgtgacttgggccgtgacaaaatcaatttcagttgaaggatgtggaagcagccggattattggtgtttgaggtagctacgtgagtaaggaagtagatacaatgagcatagaaattgttaaagaagtttagcttcaggagtggaaaataacaagtcggtaggagattaaaaactaatagcagaatgtcctatttgttactacaggcaacactgtattgcaagttaaaataaattagttaaacctgacacaaatgcctgaacgcaagaaaaaaaattaaagggtttcttcaaccagacatttgtattttaagcattttattttggcaatcaattggggaaatgagatattttctcctcaaaggtaatgctgtagcagttataattgtattccaggacttgcgggctactattacaaatactcatggaaattaatgaatttttatccccctggctctggaggagtggctgaaagcaccgtgttttatagtctgacaaatttgggttctattcccagtatctctggataccagctatatgaccttgaacaaaatactgagcctctttcaaagcctcagttttctcatttgtaaacaaagcagtaacaatagctcttttatagaatcatggagaagaataaataaagtaatgaatgtattgtctactacactgtctctcaacctagagactatatcaaaatcccctgaagaacttcttataatacctctcccagaattcattatctagtaggtctccgcacagcccgagaatttacatttcttacaaatttccaggtgatattgcgggtctgaaacatactttgagaaccacagctttagcacatagacagtcacataacaaaaaccaatgaatgtaaatattagcatttctttgatggagacagccccaggctgcctacagcaagatgttcccttaggttcctgaaaatagaaagtcccgcatggtcctcatcaaagtccgctggattccttcaatacctcttcctcttttctcacatgggcattaacatccccactcctctaccttctaactcaattatctgacccctgcgctcttttttttttctttttcttttcttttttcttttcttttcgagacggagttttgctctctttgcccaggctggagtgtagtggcacgatctcggctcactgcaaccactgtctccagggttcaagcgattctcctgcctcagcctcccaagtagctgggactacaggcatgcgccaccatgcccggctaattttttgtatttttagtagagacggggttttaccatgtttgccaggctggtctctaactcctgacctcagatgatccgtctgcctcagcctcccaaagtgctgggattacaggtgtgagccaccgcgccccggcccccctgcgctttttataaattcattcattcattcgttcgttcattcattcaataaactctgctacagtattcagagactcttttctgccatatttgctttgatctagttaacacttaatgagtttatataccataatatcccttttacagtatcctgtaacgaatctctttatcatttctagcttatatcatggagtctgtgacagacaacaagattgcctctgaaccatgccctctactgatgtgggtattattatactgatgagatttcttctttctcgttctctgttatgaaaaagcaagctcatggcccacggggctcataaaaaatgtactaaaggctgagagcaatggcaactaatgatatacgtgtaagtacatattgatcaaattagagatgattttttttttcacagctcagtgatgtgtctaacaatagtattctgggaaattccatatatacataatataagccatggctttattcagatagaacaaatgccagataatattgttaggagcttctacaatagcaaaattcaaaatcacattatcattttaaaacacataaaatggctcactttttttttcttcagtgcctgtccatcttgtttagaaaagacttgattaaagccacatccactgataggcaatggaagttagattagatacttgtgtatccgatactgtttaaaagactggttctgttttataatttgaattaaatggtaactaatctttttttttgtaggagcttgggctaggcaaagtaaggaataaagaaataaagttacattttctatgactagaggtattttagaagaagttgaatgcgtacttaataaaatgtgtgttctatggagattctacgcatgcatagaaaactaggtgaaataaaaattctgcacatttctgtaagcaagtatcaaggaaaaagagttctgaacaattgcagcaccctgtaagtctccttcatgctctttcccaattcacactatattcccaccagcctctcaggaagaaactgctctgctgacctgaatcattatagataactttggccagttctcaaacttcatatagatggaatcacacagtaaatgttcatcttctagtcaacattgtgtttatgaagttcgttcatattcttccaagtagcaggtttttattactatataatattccacggatatacccaatttttgttttttgtttgttttttgtttttgtttttgagacaaagtctcgctctgtcacccaggctgaagtgcagtggcatgatctcagctcactacaacctctgcctcctgggttcaagcgattctcctgccttagcctcctgagtagctgggattacaggcgcctgccaccacacacggctaattttttgtatttttagtagagacagggtttcactatgttgaccaggctggtctctgactcctgatctcaagtgatccgccctcctgggcctcccaaagtgctaggattacaggcgtgagccacctcgcccagtctataccgcatttttaattctaattctgagggacacaagttatatcaggttctgctattatgcaaaatgttgctattaactaccttgtgcatgctattttggtggacttaatttctccccttttttgagacagggtctgactctgtcccaggcaggagtgtagtggtgcaatcacggctccctgcagcctcaacttcctgggctcaagccattctctcatctcagcctctggagtagctgggactacaggtgcatgccaccatgtcaggctaattttgattattattattttattttttttttttgtagagatgaggtcaaactatgttgcccaggatagtctaaaactcctggcttcaagtgaccctcccactttggcctcccaaagtgctgggattacaggcatgatccactacacctggcctactaatttcttttgaacacatacatatgagaggaattgctggctcataaggaaggcataaatttagatttagtagatattggcaaatattaatttacacttaaaccagcaatatttgagagctccagctgaggcaccaattctccccaatacttgatattgtcttattatattttaaccattcggatgcatatataggggtattcaaaattctttgattactaatgaagttaggcacctattcaaatgttttttaccatctttgtcctcttttatgaagtgcctgttcaaatattttgccaacttttaaaaaatgggttgtctttttattgatatgtatgagtttattatatattatggatacaagttttctaatcagatatacgtcttgtgaatatttttctcccagtccatgacttttcttttcactgttattagtgtattataatagatagaattcttagttttaatgaagctcaatttatcagtgtttgactttgtacttagtgcttgttcggtcctaattatgaaatctttgcttagcctgtatctcactcgtagattattttacttatgactggagattgcccaccagatgtaaccacttacacactaatggtcacagccatattctccttgactatgtttacttaatcaccattggcagagactatgtctcgtctaatattcttttatcccttattcagagactctcatattattgtgactgtaaattttcttagctaaaataatttccctctatctctctctgtctcactttctttctctctctctctctctctctccaactcccaaagatatataagtcggatttattgggcacagctaccaggaaaaggggttcaagaagggttacagagcaaatgaataatcttttgctagggctgaggagtccaactcatggcctcgatataatttttgagaatggaagctgggaatagaagatgtcagggaaccctggggttgttaatagtattgaaacaacctaccttgcagtacttttgagagagatataaaaccatcaccctgttctgaagctcgagccctagcttattattttccctttatcaattcacaaataaaagcaatgaatttcctacaaatacttcttcttggttttgaaggtatgttatagaatagaaaaagtcttacaaaggtgtattttcacatagtggttggtgatggtggacagaaatttttaaaaatcatatgtacccttcatttcatatttttataacaaaatgacaatttaatcaatgtattaaattttcaaaagaaaatgcaaatatctgttctacatagattgaagaccaagaatttctgccagtgatacccagccaagattagttttcagttagtctttttataccatctttcaaaacaaatggtaatgtgcgatccttatactgttaaagaaaaaattattcaatgtcacttgctgaatcacggtaaggcaggctttattcaagaccatctcaataggtatagggaccgtgaaaatagggtcttgcagtaggggagagagattgagctcaatttgaatacagcacaggcaaatgggaattttataaccaaggaacagggtaggggtcagtggatggaaaattattaagaggaagcatcatgggtaagggagactcctgctgaaaatagtccagtcatcccctggaggatggtggatgatgaggaacatgatcagatatccaggataatcaaataccaaggatgagtgttttctggctaaactgatctggcctgctaaaactaaattttaggagaatgtgcacagactgggctatgagaaggttgggaagcctgaataaattttggccgagcaaataatctttgtcagtactaacatagttaataaacagagagtaccccagtaattcatttatgaaaatgtgtttcaaaaaattccagtctcgaccaggcgtggtggctcacgcctgtaatcgctgcactttaggaggcagaggcaggtggatcacctgaggtctagagttcgagaccagcctgaccaacatagtgaaacccctttctctactaaaaatacaaaaaaaattagccgggcgtggtggcatgcacttgtaatcccagctaaccgggaggctgaagcaggagaatcgcttgaacctgggaggcagaggttgcagtgagccaagatcatgccactgcattccagcctgggcaataagagtgaaacttcatttcaaaaaaaaaaaaaaaaaaatccaatctctttgaaagttatgtatcacttgacaaaaacatttcctttgtgacgtaggttcagaaacattgggttaaactaagttaaacaatttttttaactacaaaacatttcagggttgagttgtgactcgctaaagaaggaaatgaaattatcacattttaacaatttgtttttcattcaacatcttacgggatcaatgttctttacaatttccatttggaaatgctgttctagactcatccgttatataaattatacatttaagaggatgttggttctaaatactttaacttgctatcaaggcagaaatttaaaagcaaatttgctcttgttacgttattctcttttatatccaagagaaaaagaatgttaagttgaaagttattttgctcagggacacttacaaagatatatacacattcagtagacacttgcatgacattacatttgaaattggatatatcttttagctttttatacacagatcatagtatgcagattttaagtggtggaaaatgaatcttttaacattcaaagtgatgagctttggagaaggctgttttaatctgttatactgcaggtgtaactcctggtacacttgtaggttagtagtgatattgtaggcatattcgatggatcaatatatatggagtacttgatattcagatattcagttctccccgatgccttaatctgggtgttgtttttgcagtggttaggaggaaggagaggaggtgccaagattcagacactgcagaagaggattatataagcagaaataattccatgatgcggttttgtacctgtttactacaaatcaaaggtggctgacacaactttgtccccaggaattctataatggttagacgatagctgtaaatacgctcctgtgttccttccagaggtgtgtgggaaaccctgagaatggggtgtgcatttgcccctagttaagggtcaacgaaatctaaggcagaattcagctacaggtttagagctatagtctctttagagttccaggtgtcccttttacttaaaactctttttttccctgacattttaaatataagtttccctattcactttgcaaagcttagttaatactgatatgtaacaaaaattattcgctacacttgagcatgtctcttctccataaagatccagctttagatagcaactcttctcatagatctgtaagtattgtgagaagataattaaaagtttgattattgtccatataaatagacggtaagaaaatacacattttcagtattgaataaagactttccttcttctcagcagaagttgattgtattccagaaaaggaaagaatccttcctttcataagggcaaattaaaatgcaggaactctgaatttgggagtctgtttttcaagatgaataatcatctttggcaataggattcaaatggcacaacagaaggaattgaattgatattgaataatctgaattcttgatccaacctctatttttgaatatgtacatttaagatcactttgtgcatttaactctcattatgcataattgcataactggacaacaatatttgtttcttcctggaattcaaggagtttattctacaatttttgtttttatttatttatctatttatttttgaaagatggagtctcgttctgttgcccaggctggagtgcagtggtgtgatcttggctcactgcaacctccacctcccgagttcaagcaattctcctgcctcagcctcccgagtagctgggatcacaggcgtgcgccactacgcctggctggtttttgtatttttagtagagatggggtttcaccacgttggccaggctggtcttgaactcctggcctccggtgatccacccgcctcggcctcccaaagtgctgggataacaggcgtgcgccattgagcctggctattctacaatttttagaaaggtagcaacttctttccccacatgacattaagttttttataatactaaatatgaagctttaatgcaccaaacatacttgcaatcatcaataaacatatgacatatctctactaacaagcagattggaaattatggcatcaattcaccatctgtgccacacagactctagttttgaaactcttatttgaaacagaaagttatatatgagcataagaggacactgcacatggagttcttctaactttatgtgtaaatttctacttaatagaatatatactgttataagctgcttcacttattgttaaacctatatacatatacattaataaaaagtcattaatattgacctacaaataatttgagttttaaaaaattattattactgtacttcatttttggaacaggaatcaaattataataaaactagtagcacagaaacagacaagattactttggttaccagagactctgccaaattttcaatgataatttacatatgaaaaaaatagaagaaaaagtagaaaatgttaccatggcagtaaaatatgcatgtatttgaggatgatattcaacaggacttacctgcaacaaatataaaaagggaagtggaaaaattcactaaatcccttaaaatgttaagtactgagggtggaaagtaagatagataataattataatttttcctagaatgagggtaaggctcgagttatgaaaacactaacaccgtcagagtaagtcttaagggagaaccacttctggaattccctggttttgctccccggctgatgtacagaacatatgtctctagaagaataatcaaaggcattacaaagaaccctctcactaattgctgatagttacagtacagtcctagacacccatagaggcagttctttgcccctactacacatcagaaccacctagagagccataaaatattacctaagcccataccccaccccagaccaactgaatcactatctctatgccggggcttgggcatatggttgaaaattgcagtcctagatgacctgctacaatacacacacacacaaacacattttcaacttcatgtactctcatactttccacttcacgcactagcacttgttccctgtaccttcctaagtccacttagaaaatcagattttacatttttaattttttcgtgtgtgcattttaatgaaagagtatcactaagataaaatgtgacagtaggcaaccaatttctttcttcacagagcattgaaaatagacataattgattgccttagattcatgcccatatatacatatatatgcacatatatacttcaaactcattttgatagggcacagtagtgatttcctggtgtaataacaatccgttcatttttcatgtaacattgtctatatgattttattatactttttatacatagaatgaaatatttgttaataaatgaagaactaagggcactcactctatagcaaaaatgccacctctactagtaagaaaaagaaataaacattttctattattgcggcaactttctaaaaggaaaaaaaaacacaggaagactatcacataatgaaatcctttaattgttacttctttctctatctcactctcttttgtttcatccaagaaaactatttaactattatatagtgatatgtaattagagtctttcaattaaaattgttaagctacagattgttgacaccaccgaatatacttgattaaaataagtatagatgtaaacaaatgtaaacagaattgcacttaaatgatattcattatttagttcatttatttaaaatgcattgatggccagacgcggtggctcatgcctgtaatcccaacactttgggaggctgaggtgggtggatcacctgaagtcaggagttcaagaccagtctggccaacatggcaaaaccccatctctactaaaaacacaaaaattagccgggcatggtggcaagtgcctgtagtcccagctacttgggagactgaggtgggagaattgcttgaacttcagaggcggaggttgcagtgagccaagatcgcgccactgcacttcagcctcggggtcagagagagacttcatctcagaaaaaaataataataaaataaaataaaataaaatgtatggaatggccaaccaccattctacgaagtaagaactgaaagtctaataagcaaaggtctctacttctcagaagctctgttggatgatacaggtttgtgtacaaatattacattaacatggaaaaagtgctaacatgcagtagaggaggcataaacttgctcgattaggtttggtggttggaggttttacaaaagagatgatgaggcaaattggtgtttacctacacttgacagcccccacccatagttagtataaaatgtaattataattttgtgtatacagtacttgaaaaattattacagccaatcacaatagtggatataaaaattccaagtctatttacaaggaaaacattctggccaaatatgaccataaatatttgtgcttacaatacctagaaatttcaaatgtttgatatgttaaatatttttatttgtagagttcttcactttcaaatatagattacttttaatgagatagaaacaattatcagtttgattcattaagggacaatatcactttacagaaatttacatgtatttattaacatgtgaagcactttagtagataaaaaggacatttttgtatcacttaaaacattaggatgaaattatgaaatgtacatgctgcctactggcaccaaagattataagccggtctcacaattggcttttcattatataaagaacacccattatatgcttggaattcctatgccagcaggcatacagcaaatgctggaagcccattgttcataactttacttcttgccaagcatttcagttatattttctttggttatataaagggccagagctattttaagtgaaagaggtagccatcctcatctcactatatgacagatgtcatattacaatgccctacataatagtatgcaagggcaatgctacctccttcgacctggtgtaaaattccttagaattacaactgtgtgtttagacaataaaaccgaaggatttgcctcaaatatcaaaactaagtgcaaatgggcaatgctatatagatgagcaggaaacatttctcactctcctctaagtgaatgctaatatgatttcatgaattgacacaactaaattttgctttataagaacatacatagccaaaggatttaaaaaaaaaaaaaaccaccttaaaacaagttacagagggttaaacggaagcaaaagtaggtagctaagtattaggaagggtggaataatgtctaggaaacgagagtaataaggccaggtgcagtggctcatgcctataatcctagcactttgggaggccgaggcgggcagatcacttgaggtcaggagttcaaaaccaacctggccaatgtgatgaaaccgcgtctctactaaaataaaaattagccaggcctggtggtgcgcgcctgtaatcccagctactcaggagggtgaggcatgagaatcgcttgaacctgggaggcagaggttgcagtgagacgagatcacaccactgcactccagcctggacaaaacagtgagactctgtcaaaaaaaaaaaaaaaaaggaaggaaggaaggaaaaagaaaagaaaaaaaggaaacaaaagtaatagactaatcttaggaagctggctggagtagaatggcatagagcccccaacggtaccagcaatgtggggtaggtaggactcagctcctagatcttcttatggtcctcaggacataagaagcacactaaaaggcctatagaggatagatgatgcccatttaaacctttaattctgcctaaagttctgccaggtttatgtacgggcatagtgcacataaagcatgcataagaatgcatattttttgccttgcctttagtttttccaggttttcatgatattaacaccaacgattatgtcagagttatgctttgttttttctcaatgggagaaatccaagcataggccccctaaagaatgaaatgtaaaacaatgactcctgcctgatacaaccagaaggaagattgacaatacaacatgaaaagtcacggagtaaattattttcatacaagtggagaaattattttcagggaattcgtagaccgacagctattcacaggccatcaaacacccataaggacctttgtcatccttcaatcacttcagtagagagagaacatgtatgaaagagacagaaaacacagttaaataagcaattcctgttcagtaagtgtctgcagggagtttttcagagtgtgtacggataacacgtatacctactcgatcctacaagtgcgtggttctgaacagaagcaaatttgaagtattaataacaatgaagatggaaatagggttgttgaaaattctgtatttaatgagtgaactcagcgactgcagacacaaagagtgtggattctccgaatgattataaaagccttaatagaaataaatgattactaattggaatgggacatgaaagaagataaccttgttacaaagattccaggcaaagaaagaagagatggttccaattacaataatcaaagaggtgattttcttagaatatggctaaggaaacacattttcattcatttgtttcattcatttttttagtgcagtgtttgggaactaacctcagtactagtgaacatatgatgttaattctttagcgaggccaggagcggtggctcacgcctgtaatcccagcactttgggaggccaaggcgggtggatcacctgagatcaggagttccagactagcctggccaacatggtgaaatcccatctctactaaaaatacaaaaaaaaattatccgggtgtggtgacgggcagctgtaatcccagctacttgggaagctgaggcaagagaatcgcttgaacccgagaggtggaggttgcagtgagccgagatcacaccactgcactccagcctgggcgacagagccagactctgtctcaaaaataagtaagtaaataaataaataataaaaataaaaattctttagtgagatgaactgttaatggttgattccataatactgattctcattataaattactgtaacttttagttgtcttaaatattaaacaaaataacaacaatagtgccaacaagtgctgctagtgctgaaaatttcttcagattgttagaggaacagtatttcagtacatatattttgttacaatttcgagaaagaattcaaaacccagaatgggaataacaaagaccttttagagttgtgtttctcaaagaaagaccccaggaatacatgacttgtaaagacctaccagaagaatatcatttagaatggggctttagaatctgcatttttaataagcattctaggggattctgctgtattctagagtttgggaaggactgcctagtagattgtaaggccaaggtagtgattaattgatctaggctagagtaaagctgtggctgaaatatttttctaagttctcccagtgagtctaacagccaggagaaagaacacctgtgcattggcagtgacagcggaggaggtattgtactttgccaaggaagtatgcacagaatcatttttatataggtaataactgtatatctaacaaaactctatttcatttcactcttaaattcagaaaaaaaatacatgtaattcaaaataaacgttatcactggatatggtagcaaaacaacagtgcgtagatatgtgcttatgtttccgtgtgagttctatctatgtgtgtgcttatatatgtgtacacacacatatacacaacacatacagtgagagaaagagaggcagtttataatcttccaacatttttggcttatgtcaacctgtaggttaaaaatctgactttgtgatgccaaagaggaaaggtataggaaggagcagagaaaataactcaaatatggtttacttaggtatgggaggtgaaagattatttgtggcatcattacagctttgtgaaacaattggcaaggttgtgcaaagtaccatcttgatcagtgaagctttttcccttaaggatggattacaagtgtgtaattcaaccttgacttgtagacctccatttcctctctagttatgtgaatgtgcaccatacaatacaaagttctatacctattactttaaaccagtaacgttttattgtacttaataatagtcttaggctatctaggtaatctctgtttataggtgtttacaaagtaatattattttatgtaaactaataaaaacgttggtgctaattgctttacacattgcttggaaaagcaagccatttttgcagttgagtagttgctcagcactattggccaatctatttctatagcttcttgtttttcatctccttcaacaagttcatctgccaatattttgctccccgtgttgctctaatctcaatttctatcttaaaaaaatacaatggtaagggggtactttgcaagttaggcctaagaaggagactgatttcccaaggatgttcacgttgatttattgccttttaaaatactagttgcacaatgaaatgacaaattctgccaatttacatactattcctagtgtcattctttcaatttttcaaccagaattcatatacacagaaaacatgcttttcttgtttcctgagttccttcaagcaaaacataattctataatgagcaattatagcctaacacctgctgctatgaagaggaccttgtcaacatctatctaaattgaagaacaacagcattccttgattttgggaaaatgagcaataaacgaagtccatttcttagcagaaaaactcataggcaatgtattccaaggtagctcacagaataatcaggatttaatagaattagattttttaccatcatttgagagaaagttttgctctgggctaagtattatggttaaggaatccaagaaaaacactaaaattcctggatcccttacaggcaatatttacttaaaataaaaccatccataaaagtccttctctactatagtatctcttcctgtttttcttatgaaacaagaactctgctcaagctgaaaggtaaacaaatcggatagaagcatcatttgagctcaagccatatcaacaatcttgtggatttacattgccaggaaatcttttttcaaaattatgccgggataattacatcaacaaaaatggaggcagaaatcttggtataatatcaaaaagatgggggaagaataggttgctggaaaaagcctgctagcagattgcctagaaagaaaaatgaagccattctaatatgttaaaatctcatctaaacattgaaataaatgattattcacttacagagtaaacagatatgtttaagtgtatttttttacgtagtcacatgtatatatgatgtttctgtgtgcctatgtacacgcacacatacatacacacacttgaacgtcaacttgtacgtattaatagtgcaataaaaaatgttgtcagggatgacttcccctctggcattcccagcactatgactgacagctcttactgcatcaatagaagaattgtatttaaacaaaagttatggtacaattcctaggttgatgcttaatagacagtaaatactacaggaactaccaataagcttccttattaaataaatgtatttattcatttgatcttatgtaaagaacacaaaaggtaaaagaaaaaaattaaaaaagagtattttatttttgtataattaaaaaatctagttccttcttcctggatttgaggtatctatatctgtatctatccatctctctctctctctctctctctctctctctctctatatatatatatatatatatatatatatatatatatgttcatatctatatcaatattgataatgtttctttacttcttaaataaagaattacctaagcatcttttttcaagcgggagaatgaaaacacaattattctaagatggcgaatattgacaagggaatgaaatggtgaaagcaaatctatctagaaaaaagggcccccttagcctgaatgaatagaccagtgaatgaggaaacaaaatgattaaatcaagtcttttgaaagcacagcattattgtgagacatattgtaaagatctgtgcagctattctgcccttcctacatactcattgctctctattatacaaagaaggaacacagagaaaagaacattatacttgaagttagaatacctgggtttgagtgtgactttatcacttactaattatgtgatcttgaacaagttactcaacctctttgtgctcagtttccttttctaaaaaatggacatacaggccggacttggtggctcacacctgtaatcccagcactttgggaggccgaggtggcagatgacttgaggccaggagttcaaaacaagcctggccaacatggtgaaaccccgtttccactaaaaatacaaaaattagccaagtgtggtggcacatgcctgtagtcccagctatctgggaggcagtggttgcagtgagctgagatcacgccacttcactccagcctgggcaacagagtgagactctgtcctgattaaaaaaaaaaaaaaaaaaaaggatatacaaatatccagggctaattggagattcagatttgataatgcataggaaagatcctagtacactataagacaccttacatttataaagtagtataattgtcatccacataccattattattacatcatagtgaaaaaatacaacttacaagagttcagctgagcttaaagaatatattcatttgaagcccaatcattgttgtgtgagcttcttcatattatcttatttcaattattatgcttttatcttagactctaattatatatccagttttacttacgccattaaatgaattttaaaaggagtcacattaaataaaggccctttaaattttttatgagataaagagttgccatagacacactcttttgcatcttacccggtacagtcaaactcaattaactattcagactggcaaagcatcttttacatttttcgtaaagattctaagtgaaaagattgtactatttttcaattaagttatatatctttcaaaaatagctggtagattaaagcaaaggcactgtcacaatcacagattctatttagtgccatttagaggacaaaaatgaagccagctagacttgaaaatgtgttcatagtgatttttcaatgtatcaaaatctactaaatggaacattgaatggcaagtccaaaggcatgtgatggttaagaaatctggtcacaggcccagcgcggtggctcacgcctgtaatcccagcactttgggaggccaaggcaggcggatcacctgaggtcaggagtttaagactagcctggtcagcatagtgaaaccccttctctactaaaaatacaaaaattagccaggtgtggtcgcaggcacctgtaatcctagctactcgggaggctgaggtaggagaatcatttgaacctgggagatggaggttgcagtgagccacgatcgcaccactgcactccagcctgggcgataagagtgaaactctgtttcaaaaaccaaaaacaaacaacgacaaaaaaatctgggcacagataattacacaaggatttcacataacctctctgttattcatttagagatgtctaaaagtaattcctgagaaatttggaatttttattgaacatgtcagaatcttctctaaataacttctgaatcacctgtaaatgcaccattgatttggataatggtggaatctagctgtggaataagttaaaaggtcataaggcctccaagggtgaaatttcagtgaggtaaccagccaggctacggagcagctcggtgagcatttcatcagtttggagtagaatatggggagatgataccttttctcaactcaggtaaaaagaatttgaccaagttctcataccagcttttatgttacacagctgtttattaccatcaatgtttttgaaaactgggcagcataatttccatcatgctatgtccctggttctacttattatttggacctcctgatttactgactaaaactactatttaattatctgtatacaaattcaccggccattttcctttgaggtatccctatttggccagaaaatttagagcaaaagatgttcaattcagaaatttctttttaatgttatttatcagttttaactgatatacataatctttcactttactgtcagagatttataacaaaattatccagtgatatctactgaataaaaaagtaatgtttatcctcagtataccaattgttcagttttggtgcaaggtggtttaatatgtcacagctctaggtaagaatatagtaagaaaccctgagagggacatgtttaattgtaaaactgtgaagcacataaatacatacttactattatcaataataatagttaccatttaaatattgcctgctatatatcacaaagcactaagaggcttaaaatacatttttctctgtcctgtacaattctatttaaaaataggcaaaatttctccactttgtatgtaaggagaatgagtcacaaaaatgttaagcaacttgatcaggcccaactgccaataagtttgaagacaggattcaaacctcagtttgcctctccaaatctcaggaactataccaagccatgagttacatattaaacagctaaggcaggtgggcgtggtggctcatgcctgtaatcccagcactttgggaggctgaggtgggtgggtcacctgaggtcaggagttcgagaccagcctggccaatgtggtgaaaccccgtctctactaaaaacacaaaaaattagccgggcttggtggcgggtgcccgtaatcctagctactcgagaggctgaggcaggagaatcacttgaacctggcaggcggaggttgcagtgagccgagatcgcatcaccgcactccatcctggacaacgagagcaaaactctgtctcaaataaataaataaataaataaataaataaataaataaataaacagctaaggctaacagtcaatattaaaaattataaacactaaagtgtttctctaacttattattttgcatttaacaaaataccattttcccataaagtctattgttaaagcaaactaaatacggcctgagaaggactccgtacttctatatttgagtccctgtggatgaactacaacctatctcaataggtagacaagattgaaaaactaacttaggagtatgggcctgtgacaatcactcagtcttggccaatcccagccgccattcttcagccagttatacactgctgattgttcaaactgtgttcaaataaggcaaacagcgagctgtaaccaatccagctgtttctgcatctcacttccgatttctacatgtcactttacttttttttgtctataaatttattctgaccacaaggcacccctggagtctctctgaatctgctgtaattctgagggctgcctgattcgcaaatcgttcattgctcaattaaactcctttaactttaatttggctcaagtttttcttttaacactatattttttttttttgtcttttagcatcatttttaaaaatagcatttaactcctttgattcagtggttgctatggtttcactatttatcccctccaaaatttaacccccagtgtggcagtattgagaggggaggcctttaagaggcacttggatcatgaaagttctgccctaatggattaatgagttaatggattaatgcattatcatgggaatggcactggtggcttgataagaagagagacctgagctagcaagttagcatacacagccctcctgccatgtgatgccccaggccattgggaccctgtagagagttcccaccagcaagaaggccctcaccagatgtgtccttttgacctgggacttcttgaaatggtctttgcaaaaattataacggtgagaaaatgatggaagtgaaagggatctaatctagccaactcctctcttgcctttagccttcaagctgctcttaattattcctgggcttatgccaagctaactttgggagacatttatagtttaaatgacaatagcccttccccaaaactcaaccgcgtttgtagagctaatgagagaccaccaggctaggaggataggggaaactaaattctgctgcggtgtagacatacaggattgccagccattattccagaggtcacaagacacgcgacttccccaactactcttgcagacaacatcactattgtagaacttaagattggccttttgagatatctgttcagatatatttcatgtctgatgactgatggctccacctgcacctgccaactgctcctgtggccccgcccagaagagactcagtgcacaggaggacccttgcccacagtcctatgattgcaatccctaccagtcagcagcaagcacctattgcgtagctttccacatgcctttccccaaaccgatcttgaaaaccctagcctcagacttcttgaggagactgatttgagtaatagtaaaactctgatcttctgcttagctggtggctgtacatgtataaaactctccattgcaattcccttgtcttgataaatcagctctacctgggcagcaggaaagaagaacctattgtgcagatacattctgagcctccataactgtaagaaataagttcctttttgaaataagtaacctagtttcaggtattctgttttatagcaacagcaaatgaattaataccgagcaaatgaattaataccgtattgggatatcttagatgttttggcattgaagctttgtcttacgaaaatgcattcaggtattgaaaccaccattgcaaaattataactgaaatagtgaaagagatctgatgtaaccaactccctcttgcatctaagccccaggctgtccttgctcattcctgggggtaagctgaaataactttgggaggaacttagtttatagcttatggtttaaaacaaaggcaatgacaacccttccccaaaaccaacctccttcttgcctggggactagactgcctttgtaggactaacaaaatagccaaaagattagaaattacggtttagtagtcatgcagctagagactacaagatactgcttctccccaaattgctcctgggcataaagtcaccattgtaaagcctaagatcagtgcttgagacgttttgcagaccctgcactcgatggatcaactggtaccacacagatcaataaactggctcatctcatcctatgaccccccactcaggaactgactcagggcaagacagctttgactccctatgatttcatctctgatccaaccaatcattacttctgaccactggctgctccccacccaccaaattgtccttaaaaaccctggtccccaaatgctcagggagactgatttgagtaataataaaactccagtctcccatacagcctgctctgcatgaattactctttctctattgcaatttccctgtcttgataaatcaactctgtctagagagtgggcaaggtgaacctgatggcaattgcagtatgtatgtatacccaacatcttgtatgtaattttaagggatgcaaggatcccaaaataaactagaactttagggtgatcgagtgtctggtgtgcctgggggctaagcaggtttgtgggatatgggactttaaattttaaaactgagaaattcctgaaaaacaaaaacaaacaaaaataaaacaagaaaagttggttaccctaaaatgtaacgtttatatagcactttaataaatactatttactagaagctaaggcttttggttatgtatattataaattaggccatagggcaaagcaagaaaatgaaagctttactaggtcaaaactgtgaccgcccaagaggttcaactcgcctgctgcctggacagagccgattcatcaagacaggggaattgcaatagagaaagagtaactccctcagagccagctgtgcgggagaccgaagttttattattactcaaatcagtctccccaagcattcggggagcagagtttttaaggataacttggtgggtggggggaagccagtgagccaggagtgctgactggtcagagatgaaatcacagggagtcggagctgtcttcttgcgctgagtcagttcctgggtggaggccacaagatcagatgagccagtttattgatctgggtggtgccagctgatccatcaagtgcagggtctgcaaaatatctcaagcactgatcttaggagcagtttggtgggggtcagaatcttgttgcctccagctgcatgactcctaaaccataatttctaacactgtggctgatgttagtcctacaaacgcaagtcccaggcaagaaggaattttgctctgggaaagggctgttaccatctttaaactgtaaactaagtttctcccaaagttagttcagcctatgcccaggaatgaacgaagacagcttggaggttagaagcaagatggagtcagttaagttagattgttttcactgtctcagacctaattttgcaaaggtggtttcaatcccttcctttgggttttctaacactttaaccctaaggtataggctataaagatgggaaaaggccgtcgatcgctctggcttcttcctgctgatgggggaagtagcgggaatgggaacgaactccaaggtgagaagagtggaactgctttgcaactgtttgagtggattcatgcaggcctaattgggcttccaaggcttgcgtggcagaaacattattactctcatctatagttttactacagtgtttatgtgaatagcctactataaggtataatgagtcctaggatgagaagtacaattcccaattttaaaagcaaacatttgaaatcattagtttgggaacttctaacccacaaacaatttagaatttagtctaaactgaagaattaacctcaagaatagctaatagtttactatagattttcttttgaagcataatatttctctgttcagtccccatttttattaaaaacaaatcatgatagaaatgatttgcttataaaatgcattttagtcttactgtacttggcctgattatttgcatgaagtgcagcaagaataattatttttcacttaggctttttaaattggctttgatggaactctgttccatgaagaatctcagataagactttttgaaagccgagcccagccatgggtttgtaccctcaaatacctatgagttgaccaaagtcctctcctcttgaggtcccaagataacttggggttcctgggcctgttagaaagtgacattctttacttaccacaggtcaggaaccttgtacagggactctgtgtggacaaggtatgaggccagattccccaacgggctttaaatggctctataagtcaactttgattctttaaaggaagcatgccattccagtcaaagccttggtaaaatgaccaatttctccaatggtgtcctgttacaaaagaaaacagattcttattgcacgtatgcaattaactatactgtcataaattgagaatactcacaaatggtttccaaattctagagaaatcaggtagagagaaacaaatttgctccaaaatttgtcactgagtgtattttactcactcggtaaaagtggcaaatagctctaaagaaataagttatgttgactctgaaaacaaaaggattagcaatgtttaacacatcagtttgccacatttagatgttttttccctctattccaagagcataatttttaaagttatctaagacctgcactcagagtattatatccgattataaactgccttttgaaaaggaccaaagcaagataaaatgtctgtggatgacaaaagtctacagccattattaaagctacaattgactaggaattttggttacttccgtggcacacaacaattttacataacaattataattattaatagtgaaatcatatcagaattatagaagtttcccataatttttggaacacacactaataacatatttatacaaatacagtccaaagaaaaccaaacaccattcactcttctatttgaaagttttccttctattctaacgtcacaatctccagagttattaatcagaaacctgcatttaagaccacctgttacattttacagctggtattaaaaccatttttttttgagacagagtttctctcttgttgcccaggctggagtgcaatggcatgatcttggctcaccgcaacctccgcctcctaggttcaagcgattctcctgcctcggtctcccgagtagctgggattacaggaatgattttgtatttttagtagagatggggtttctccatgttggtcaggctggtcttgaactcccgacctcaggtgatctgcccacctcggcctcctaacgtgctgggattacaggcatgagccaccatgcccggcctataaaaccatcttttaagaggacaaaaatgagacaacaattgcctgtggacgacacaaacattgtagagtagccagagttaaagacacaatcgacaaggaaatttgttacctctgtggcacatagccatttaacataattacaattattactgataacatatactaagtcatattagaattataggagttttacataatctcagaacatatgtcaatcatatatttacacaaatatagcccccaaaaagccaaacaccatttcatatttgacaatgtttcctgtatgatttttatgcaaaatacgccaaatgtcatttttggactttagaggacctaatatctaaaagattaggccagaaagagacataatttataatttgattttggaaagtttgccaaatatcaaaggtttaaaacactggatatcacaaaatagaatcccaggtcaccataagtcattcatttgaccaaaacgataactccaaaatcttaaaagaaaaacctttattctgacagaggagacttagctttccaaacaagacccaataaagacagcatgaggataactgaatttgtctcttctctctccccttttcccctgccatttacccaaaggagaaagccaaaccctttcattatcttttaacgttacaaaaaaatcgtcttcaaaagagaaaaccaaatttcatgttcgcattagtgcatctttaatgctaaagctagtttttaaataaaattttatgtatctatccagttttaattagtttgaccacaaggtgacattctcataaactttttagaacgctttataattttccattaaacagcagatcaattttctaagaagaccctgttatttggacacatgggcccagattctggccccacagtatgactttaatattttaacctatagaaaaagctaaataacctttttcaaatcttagccaacttgtttatacccacagaattttttttttcaggatcaaccctgtataaacccttttcactttgcttaaaccctcagtttcgttccgttactcttttagtttaagacagtctttaaaacctctgaactagacaaaattacattctcttcaacaaaagccatattcctatgccttattatctttcaccaaaaacacattccctacacaccttgtatgtaaaactgtttctccagtaacctcgatttcatgttacaatgttaactcttagcaactttgatttttagtgaaaaacctgataaaaaagctattttaattatatgctagggatggagcctaggacatcagacagaagtgaagataaggtctgactcttttcagcatagctaggggcatagctctccacgtgtccccaggcctcatctataatataatgctccaaagtaaataaattgaacaattttccaaagtcaaggaaacagtttgaccttaaagaatttagcaaatctgatagctgaccttaatttagaccaaatgtctacattttcaagatattttactttaacaataatctttaaaattgtctttattgccaaaagattactaaagtcatgtgaacaaaaagtcatcaaagtttctatttttctgacaaaatatttttttatttaagcacttattttccaagccaattaatcagagctcttttataaacatcacacacacacacacacacacacacacacacacaaaaacacatgtaaatacagacagaagatttggcactgataagactttttatttgccagtttcttaatcagattactggcttcagggtggagcctttggaggaacagggccaggaaagtatgcatttctaaggcttaatcacagctgaaggcaaagacagaactcccaaattaagggcaccattttatactgcaacccaaaaggagagaaatactacgggagaagacagtacagtgcttctaccctacatttcttttcttatttttgtttctttctttctttttaagacggagtctcgctctgtcacccaggctggagtgcagtggtgctatctcagctcactgcaacctccgcctcctgggttcaagggattctcctgccttagcctctcaagtagctgggattacaggcatgtgccaccacgcctggctaatttttgtatttttcttagagacggggtttcaccatgttggccaggctggtctcaaactgctgacctcaagtgatccgccctcctcggcctcccaaagtgcagcctcccaaagtgcttggattacaagcacgagccacggcacccggccataccctgcatttcattgcaaggcaacccaaagtcaatcagcccattttgtaatcagcccgtccttcatgggagtctgatctcccagtggagggtgaggaatgtttccttatcttccgggtgaccaaaagcatgcttctctggatccaagtgtgcaaagagtcaagtatccctgtataactaccattagccatcccttaaagtatatttcctatctagttattacacactaaagctccctcataatgtgaagtaatttctgatatccccaaaactcaaaaccatcagataacacaatgaaaaacagagcagagtctttgattttgagagggatccatctgtttttaattcctggggtttcatgtggaaaacagttttttttttttttccctaaaacgggttctgtggtgcctcctctgtttttcccaatgagtcccaggctaccagaagttatcttagggactcacgtgtgcgttaagagtggcaagacaaaaaaattaaaaaagagaaaaaaatggagaaaaataattcagtcggctgagaagaaaaaactttttccaaaaaaacaagttccaagaagagaaaaacataaaggccttttaaatatatctatagcttgtttatccactcttaattaagctgacttttaaccatagtgctctttaaaaaagaaattcttttagatctcttattacctaattttagccatgccaagtggacaatatttttagcttctgaactttaccaaaggaaacctcctaggtgctgcaaagacatagtaagaagtttctttttacaagatttagaatctccacaaggtagtccagagaaaggaaaattcaagagaggaaatcagaaaagaaacttaataaatggcaaagctacacaaataacaaatcagaaaggaatcattccagaagccaacaattgaacccaggccaccactgtcaaaagacaaagccttagctactgagctatatacagcgttgagaaatttctactgcttttcccagaaggagcctagagaagccagtttcaggcttgcaaggcttttaactgctcaagaaaaatcttaggagtaactatgacatgaaccccaaaattcctgtcctctggatggtagaaaccaaaagaaagtatccccacatggtcacaaggttaagctcttaaggacacaaaacaagacagagaaatttcatagagtattggtttcagggacctgtagcaaagtttgtagctgaccagcctcccaagctgacttgaaaagcagacttatgggtgtcctaacccacgttctatcacgtgatatccctctctccattacataacacagaaagacaaattcttagcacaaactacatcagatgtgctaagattagtctcacaaatccttctttctattaaccaaacccttgcagaggagacaaatagtttactatttaacaatgcagagaaagagagagagagagagagagaccagaaacttgactgataagaatttcttacccttattgctgggatgccaggtttctgggttccctttctctgcagcttccagaagaacggagtggcgtcttacgaccctgcttgcttgtgctatagctgtggggtttaagccactttacaagataaaatcaccctttaccattttatggaaccataaacaagattcttaatttgcaagattctgcccaacgggctgcatggggaactgaattaacattttccaacccagcaaaatacacataacaaaacagacattagtcacctctttccgcacccaatatcagcctggcaaagctcaaaatttttcatcttggtccctgttgtctttgatccacaccaggtggggacggatgacctctgaacggtaattcacaatgaggtctctgggcaagggaaagagcagatagtcaccctgagagacaggactgttgagccttctttagagctcactgaatgtgaccagacaaataaggagggttctctgagttaggcatgctggacttctatcagcaaccccttctgagatccctttcacatatttaaacacatgcaaagacaagagggacagaaggccttccaaatcagatccctaaccaagaagtccaagagtatcccttccaaactatcctcctattttctgtatgagaaacctcctcaaaatcttcctgattgaagagaagtctcccaaaccagtagtcttcctactagttagaaagagcgaactgagacctcccaggagctgaacagacaccccacaatggagtaacagacagagacaccccatgctggatctacagacaccccacaatggggctacagacaccccaccatagggctacagaaccagtcaggagaatgaagcaggcattggcagcacctaggatactcaccaatccagacaccccaaaacggagctacagatagacaccccaccatgaggctacagataccctgtaatagggctacagttaagggacatctccccatgactatttttccattgcaattaagtccacgcacattgggttggaataccccaccagtagacagagtaacagagtcagcccccagtccaagagaattaggcagccacttgggctgccttctggatccatcactgaaagggggccaccaaacaacaggcaggtagccacaggggcaatcctgggtgagcccccaaatttgtaaccacccaaggggttcaccttgcccactgcctagacagagctgactcagcaagacaggggaattgcaatgaagaaagagtaattcatgcagagctggctgtgtgggacactggagttttgttattactcaaatcagcaaatcggtctccccaggcattcggggaacagagtttttaaggataacttggtgggtcgggggaagccagtgagccaggagtgctgactggtcagagatgaaatcacagggagttggagctgtcttcttgcgctgagtcagttcctgggtggaggccacaagatcagatgagccagtttattgatatgggtagtgccagctgatccatcaagtgcagggtctgcaaattatctcaagcactgatcttaggagcagtttggtgggggtcagaatcttgttgcctccagctgcatgactcctaaaccataatttctaatactgtggctgatgttagtcctacagaggcaatctagtccccaggcaagaaggtctgctttgggaaagggctgttatgatgtttgtttaaacgataaactataaattagtggaggttagaagcaagatggagtcagttaagttagatctctttcactgtctcagtcctaattttgcagtggtggtttcaaaacccttatactttattttaccataaacaaatgagcttttagtaatgaattctaatgactgcaatggggtgggggtggtgagttaattgttatcagttgtacaaggttgttttattgtagctcaaatgttggaggaaagggaagctttatggtattatgtttcattaaactaagataggctttcagaattgtacaaaacatttttaaacctatatgtattactgatgatttaagtgagtgtatcagggaaataacttgtttggtgaaaaatggaatatggcctgaaaacataacaacaacttcgtaagttgtccattttctcataaaaataatattgacttacttatatattaaattagtgattcaatttctaaaggccttacaaagatataattcagtattttatggtaattattttctaattagaaatttacttttactatagcactaagtgccaccagtattaattattgttatttccttacaccatacttgttcctagtaaaacaagcttcagccactgttctctataaaatatggtgtcttctagatgggaacaagaatattttacaacacataacctcccatttctagggttgtgacaaaatgcattttatttcaaatggcacgcaatattaaaacaactcagtttatgtttcattaatcaagaattcaaaacaacctcattttgtaaatccataatatgcaaacttggctacagactgtccaatcagattttattctcctttcaagtcagattttccttatcctctttacttacactatcttaccaataggctgtcagatgctagtatgttctgagacattcagtatctcttatcactcaccactcatatactctcagggataaaattctgtagaggcactcaattcgcatagaaacaaccataaaacccagttttgcaaatattaagttagaaaacaattggcatagcattacactatggtaatacttactatgcactcctaaaatttagtgttgatcttatgccatgatgtaaaaacaaaaaaagaaaaaaagttattagtacaaagagaaaaatgtcagatgtgtataatataacctctgatttgactaaaatatgtgataacattcacaagccagaattgagtagagctggcagttcacagaaggcctgaagcctagatgtaatcaatgacatagctgaacttgataaatcaacacatttacataaggaaaatatccctgattatcataggattgaaccttctaaattatctgttgacagtcaatattctgatcattttcttcactgtgaattcagacagactatcattcaaaggtttgctatacagaaagagaaaaataccaaaatgctaaggcacaaatatcaaatctctttcccatgaaaatcagataatttagaattttttaaagttaaccttgaaatgtgactatgtaattaaaaaaaataaaatacttttttgtgataagtcaaaaactaattataaggtagaacatttgctaatatagatttcaaagcaacacctgttaataacatatgttcccattttaaaagtaggtaacagaaattaataactcatagttatataatggggttccaagattttatagtatgaaatgtggtaaaaggtttggtatttattataggatgtgaaaggccccctaaagcacttttaattactcattcatgaattgctaattaatacttccaaactaaaatattaaacactttagaaagactgacccaatattaaaatccaagctgttagattttaaagtgtatgttaaaaaatatttaaactataatatctcttagtgtatatatacacacaaatatctgttttcatatatatgtttatatatattttatatatgtatataatatatatacatagagagcgatagagggagataaaggaagggggttttgtttgtccaatatattttagctgaccacatcattttatgtatttttttatttaaagggccaaggaataaaataagaatgcgaaggtagaatgcagcactttatcctcaattagaaaaatgcagaggaatttaaataattagacttttccacaaatgttatgtttgttgccaggaaacacaggtgcttctaaactcactgctttaggccatgcaaaatttaggagacaggccaattcccctcctctagggaggaaacttgtcagtcaggaaagctcaagagattagcatccaaagccagtttacttctggggctggttaaaagctttcagaggattcctgtgtaattgctaaatattgtaggctaaattaaagttgttatttaaaatgtaaacatcaatagcaactaacatttgattcttgctcttggtataaaaaagcaataaaattattaacaccttggaaagatttgaaaattcattggtagcattaagcaagtaaatatctagcatttagttcatatggcgagaccaattgtgagaacttaaaatacatatttgtgttgatgattctggctactgtttgagaggttatattgccctcttccccaaggatttctcaagaaatgtttatttgatttgtatgatacatttccagctttgttctcagaaatgtcttttctactcacattcattcattctgttcagtacaatactgtgttcattatgctgaggctttaaaattagaaactgtgggggtttgaatcttgtttttgccatgtgatagctgtgtgaccttaggcatatttcacagcctcccagtaaaataaagataaaacagatctttcttcatagaaattatttcaagcattcaatgaggatattaaaatacagaacttagcacatggtgacaaaggaagtactcaataaagttggctcttataattatgatgtagctaccctcaccttcttgattatttctgagttctttttggatctttatgacttctttatattcactagtccctctgcttacgatgaattttttctatgtctattgaaattctagatgtcttcaagatgtcacctcctttacgaaactaatcttagctcccccaaactgaatgcatcattctctgctttgcggcccatagcttcccaaagttacccctatttcagtattcaactcaatatattttattttatttttattgctttttgagatggagtctctgtcactcaggctggagtgcagtggtgaaatctcagctcactgcaacctttacctcccggaggattcaagcaattctcctgtctcagcctccagactagttgtgattacaggcatgcagctaatttttctatttttagtagagacaggggtctcaccatgttgatcaagctggtgtcgaactcctgacttcaaatgatccatccgcctccgcctcccaaagttctgggatcacaggtgtgagccactgcatctggctttgactaaatatattttaattgagttaatatgggatctgccttactgtgaattccatgaaggctgtgaagttatttaattcttctgtactttgtccaaagccatggaagcaccttgcaattggtagaattcaacactgggggaggatcttaaagtaacgaataaatatgtcacaatcgtatgtgcattagagagctatggattctttaattaagaagctgctaagagctactcgggaggctgaggcaggagaatggtgtaaacccgggaggcggagcttgcagtgagccgacatcgcgccactgcactccagcctgggcgacagagcgagactccatctcaaaaaaaagaataaatattaattaccagatgacatattaaatatttttataattctgatattaaaacttataataaaataactttaatgagtggcttggaaattaactgtttaattttcaaagaaatattttgcttttttgaaatgaaataaagacatttcttgttcattaatgactggctctggtaaaagtgacacaaaaaggtgagtgtaacagtgttatggaaaaagatgaaacaggatagtaaaataactgagagatgagcaaatagcctggcccatccagcaacgtagacacatatatctaaatgtgaagttggcgggttcaaacgaatattggcgccatgaggaggctcatgatatctattgctactcaattcatttttttttttttttttttgagacagagtcttgctctgtcacccaggctggagtgcagtgtcacgatctcggctcactgcaacctctgcctcccaggtttaagcacttctcctgcctcagcctcccaagtagctgggactacaggcacgcaccaccacacccagctaatttttctatttttagtagagacggggtttcaccatgttggccaggatggtctcgatctcttgacctcatgatccaccagcctcggcctcccaaagtgttaggattacaggcgtgagccaccgtgcggccctgttgcttctccattcttaactgattgctccagctttacaaaatgataaacccaggaattgtgtctcacgcctataatcccagctacctgggggactgaagtgggagaataacttgagcccaggagttccaggccagcctgggcatcatagtgagacaccatctcaaaaaaaaacagcctgataataaacgtcagtataaaggagatacaatgtgactctcggaaaaatttttaaaaaagttatgaattaaaaaactttgaatcagccttgctaaaagtaaaagaacctaaagtacacaggggtatttgatgaggagcccttagaagtaatcttgttgacctaagcatattacaaaaattgaaattaatgagctaattattattcttcacggtaagatacagaagtagagttcagagaatatttacattttgcctctacaaaaggacgtttaaaaaaaaagaagcctctcgggagaaaaatgaagtagagcaaaggacttactcaagtttaaatttgcagtaactctgtctcttgatttcacaaattaaggagaaggagcaagaagttcccagtacatccaatcatacaactatgaagttccctgacatatttaagtatgtatctataaaaacccctaagatactcaatcatgtgagcacaaagttactgtgtaatcttccatagatgtaaactttaaccacgaagtaagtgatagctacaaagcttgtaaaatatgtttattaaaggaaattgattttttttcagtcaatctagaggaaatggcttcggagatacatggaatttgtttgcttcgactggccatctcacaaagctcattggacttataataatttagttaacaccatattcatgtctccataaaaaccctcataagccacgtatatataccaaaattacatacatgtatttacccacagctacaaatatagtctatgtgagtttcatattaaatgatagtatagaatattattctattctatactatattattatagaatattctattctatattataacatatatattatatataactcgatattatatatatacatttctttaggagatactcatggctgctctgtgtccaactacatttgggagtcacctcttactgaatccttttatatactgggtcacttgcaaaggcttaattgagcatttgactatcatatgccacagaatggatcggacactataaataaaacacaaaagagagtttgtcttttctgggcttcatcttcttaaaaaaatcagctattagacaagcatatgtctaattatatatatcaagcatatgtcatattatatatatcaagttatatatgttaaacatcatacatatactgtaggtagctttttgtggtcacaaagctttactattattatttttatgtacttcttgagaaaaggctatctataacaggataattttaagtaaaaaaagcttaaatctttcagtcaatgttcatatattatcctcataagaacaatttgtgttaggtattcttttctattttaaagtagataaaatataggtacaaacatgttaagtaatttgtctgaggtactagaggtatggcgagaagctgatctcaagccaaaatgtaaaggcctatgtttttctgattctcctattattttggttctatgagagaatgttaaagaaaacataactttttcccaactctcagtccaggactgagaaatctcaaacactaagcatatgagtttgtgagcgaaggtttgcacataaatgtatatactcacatttatgggaatatatgatctgtacttaagccataaactaaatttaaaatttatagtttaaacatgatatttcaaaattctagtaaagcagacacacacttctatttacttttctatttatatttatgtatcttctggtccttttactattttatcaagatacttgaaagcagggatacttaaccaaaagctggtttaggaatggattatgaatggcttatgaatggattgcaggagcatttgaactgctggatttttatgtaaaaggttgtatgtaaaggatattcactgtgtatttttctgaggagtcccacagcttttatcagactgacaaaggatgcatgaactaaacaaattaaaaagcaattaaggtctttataacctctatacatagaaagttctatgttttttctactttttatttccagctggacaaataatgtcttgtaaaagtttagttcactgttttctcccttcaagcccccagtgaagtaggagatgatgttatctatttagtacgggctggagataataaattgtgaacaaagtgaagaatagtcatgaaggctgctttacagaattggaggtaatttggtgtcttttatttactgcagctaaaaggttcttcaaaataagcataatctttgcttcagctacatgtgtttcttccagattttctaatgctcttccacatcactgttttcttggttcaccctttacattttagataaatattccacagtgagaccttcctgatcccaaacctgaattaaataaatactcttacgctctctcatgcacttatttttatttagaaaatttatcataattcttgactacttacatatgcttgtctaatagctgatttttttaagaagatgaagcccagaaaagacaaactctcttttgtgttttatttatagtgtccgatccattctgtggcatatgacagtcaaatgctcaattaagcctttgcaagtgacccagtatataaaaggattcagtatgaggtgactcccaaatgtagttggacacagagcagccatgaatatctcctaaagaaatgttccacaggctgaaattaaggcataatctctagaaaaatgttttttaaaagttgtgctttataatatcacatttatcatggaaatatatctgatcattatgtatcaataacagaaatgtgtgctttactattttctttaggttttgctaaaacttactaccaaatatcctgaaattaatttcactttaaagctaaataaattggtctatatacactaaagtcataagtgaacattttcttttagtagacaattatacaaaaaaattcccttttcctgaaggcatttcttgtctctgaaaataagaattttataattggtcttattttccgttttctttggcttctaggggtcccagaataacatacgaatcaattatttatcttcttagccaacacccttaatccaagcaactgacctcttttgctttgattacattactttcaatacattctcataacctcaccaataaagagctatttgacagatgaatgtgatcaagacaccctttgcttacaattcttcaatagcatactactgcttttaagatagatatccgaactcaggagctttcatttcttgaatgaagaggcttctgtgtagttcctcctcgtcttgtagcaccgtaattttcttttttatttatttattttattttatttatttatttttgagatggagtcttgctctgtcgcccaggctggagtgcagtgtcacgatctcagctcactgcaacctccacctcctgggttcaagcgattctccagcctcagcctcccaagtagctaggattataggtgcccgccaccacgtccggctaattttttgtatttaaagcagagatgaagtttcactatgttggataggctggtctcgaactcctgacctcaggtgatccacccgcctcggcctcccaaagtgttgggattacaggcgtgagccactgtgcccagcctgtaattttcttcttagatatagttaccctggcctttctgttccttcccacaataggagctttgcataagctctttactccaacagaataggcttccttgatattctctttctgaatacagataatgtaaatattactttacgttgtaaatattaacatttctctgactgagtgtacgtcttccccattgacagtaagtttcacaaggataggaaacatgttttcagtttttgtcttgttactgttttgttttctcatcatactccagcaactagcaccttttatgtactgtttttaattaaaatttgaatgagtgaactaaaacatcaggccttaaatctgcatacatatttggctctagtcaattatatatatacttctttattttcactaatttggttgcacattttattatgtctccaaatcattgtgaaagacagtaagcaaaaactgacaaattagtacaatcttggaattcatgtattataaaaggctggttcagattgttttactcaattgtaacatgttttgattgaaacggtgtaaaacaggaaaaaattatctagaaccaaacttttattgcatgttggctatggaaaagtacaaataataactaagacgtaatcaactaggccataatcttgatgagttttcagatttgattatattatatatagatataaaataaaggaattaatattttaataaaatcaatgaaacttcaatatattttacaatagattttaaatactatgttgattttttatgaaagttcagaacatcaaaaagactaatgcaacataaatttgccatgagtttatacgcaccttaaaagaaatgttcgcagattctacttgtatcatgatgggttgcttttgtgacataactattgaaaatgtgtgttttttttttctgcagtacaatcttcacattcagatttaattgtaatcttagccaacttttgctcatagaaggattaatcatatgactttttgtttacacacaatcacctgtagaaagcagttatcattctattcatttcttcattcattcaacaacactgacttttatgctactctatgccaggccctgagtgagttctgggagatactaatatacacttaagttctgccatcaatgaacttacagtcttttgagaaagacaaggcaatagtttcagcatgacttgacaaatcttaagaaaaaagagccagagaaacatagaaagagggatctaaattaggctagaagaaatagcaaggagtagatacagggaggaagggtgtcccagacacagaaatatgcatgtgctatataaaattacataatatatttaagaaagagcaagaaggccgggcgcggtggctcacgcctgtaatcccagcactttgggagtccatggcaggtggatcacctgaggtcaggagttcaagaccagcctggccaacatgatgaaaccccatctctcctaaaaatacaaaaaattagctgggcatcgtggcagtcaccagtaatcccagctactcgggaggctgaggagggagaatcgcttgaacctgggaggtggaagttgcagtgagctgagattgtgccattgcactccaggcagggcgacagagcaagactccatctcaaaaaaaaaaaaaaagaaaaaaaagaaagagcaagaaatttcatgtagttgggatcaagggcattttgaggtaagtaagacagattttaggttaaaggggtagccaagatttttaaattctaaacatatttgaaaggaaaaaatcataatctaattttttattactctttattacaaaaacaaatttggttttaaagatcaataaactacatttttaatacaaagtagtatatacaatatgcatgtaattaccttttgctatttcaagctttgctctgtgtgcatacaaatatatcaatacacatatataatttttaaaatacataaaatcttaatgtgtacaacacacatatgacaacgttttgaatatttaaacaaaagcaaatgacttgctaaattgcaaatatgtacatatggaaaatagatatatttgctcatgcaactgctttttaaaattccattacttctgccaaatcaagcaacactcacacgggtggtataagtacacagaaatagcgaacaacataaatgttagcattcatagatcagccttttatgggaatgtaatttttcatgtacaattcactcaacatattaaaacaatctttttatgtcccttgttatggttttatcagacaagcagaacaatttcaagggaacctaagagtagactatcaatattagtcattgctcatgttgtgtttacaggaagttcactaatttacattcgatttatattaataatcaagagtggaactgcaatgaagtgcaaactttctttttaattctcttttctgtagtgtacaaactcatgtatcagtagctttgggggctattagcactacctccagaatataaacctgtcatattttaaatttgcctcatttcagaagttttgtcttcttatattcaaaggagcatgcttggtatgagtcacagtatcaacttctgcattgaatgttttctaagccatctcaaaatgcatacaaattgttagaaatcaatctcaatttatttatctaacatatttacatgatatccaaaaatgaagacaggatagataatagaaatctaatataaacctgtaagctattttaacaacatcaaatgtatggtgtcccttaagagtgctaaatcaaacactacttcttccagaattttttttttttttttttttttttttttgagatggagtctcgctctgtcacccaggctggagtgcagtggtgcgatctcggctcactgcaacctccgcctcttgggctcacgccattctcctgcctcagcctccagagtagctgggtctacaggcgcctgccaccacgcccggctaactttttgtatttttagtagagacggggtttcaccatgttagccaggatggtctcgatctcctgacctcgtgatccacccaccttggcctcccaaagtgctgggattactggcgtgagccaccgcgcccggccttcttccagaatttttgggagatgtaaaataaagagatgatttaaaaagctctttgtgaatgcatattttaatctttactctggctctggagattttatagaggtaggtaaactaaagttgtgtttctaaataatgtttctgtaagatatatttttaaatctataagttaaaatgtttcagagagataatgcgatctgtttgaagccatgctatattttggagacgactttttttttttttatttttttgagacagagttttgctcttgtcacccaggctggagtgcaatggcaccatcttggctcactgcaacctctgcctcccagattcaaagattctcctgcctcagcctcccaagtagctgggattacaagcatgcaccaccacacctggctaatcgtttgtatttttagtagagatggggtttcaccatgtgggccaggctggtctcgaactcctggcctcaagcgatttactcgcctcagcctcccaaagtgctgggattataggcgcgagccaccgcacctggccaaagggacaatatttctttaggtcaaagggaaagtttacaacaaaccacgtaaccacacaaactgcaagaacaaatatttcccttctgagctgccttagcaaagggtatctgggaatatcaaacagaatgattcataagcaaattataatgtccagaatattcaaattttcaatatcaagtttgtgttttaccagcagaatcaaaattataagaaattatcgagtttggtctcagtatagttctatgtgctataaggatcctccagaatgtaaaaaataatacctgttctcaagaatcttatttaacagttgagagaatgagctggatctgaataaaacacataaactatgattcttagacttttatcacctcagagatatgctaggaaaatactgtattttttaagaatccctttaaaaactttccttaaagcaataacacaagcattctagatggttccacatagaagcagaaaaaaaatacaagaaagaaagctctatataaccaatccctgatttaaaattgtgaaacaatctcaaataggtccagtcccatttcattaccaaacatctacaagtttatgctctgggtttaccatcttttgatatctcctccctaataccagtgaaagggatatggaaatttgttgatacagatgttactgtagaattaatactgacagtgatcagtgaaatttacattggggtggtaattagttattaatgatttaaaatttttacagtgtcacctttactgtcttctaacgatgtgtgtccaaaacagtatttatacatgagactcttttttttttttttttttttttgagacagagtctcactcactctgtcgcccagcctggagggcagtggtgtgatctgggctcactgcaacctctgcctcccaggctcaagcaattctcctgcctcagcctcccaagcagctgagattacaggcactggccaccacgcccggctaatttttgtatttttagtagagacggggtttcatcatgctggccaggctggtctcaaactcctgacctcaggtaattcatcccctcagcctcccaaagtgctgggattacaggtgtgagccaccatgcccagccccaccagtaacattttaagggctcaatagtcacatatggctattggctactatattggtcatgatagatacagaacatttctattgcagaaagttctattagcactatctgagcaatataactttttattgtcactaagaggaacttacctagttatttactctggtctgctagtatgattttacctgtaaatataatacagcatatttggactgcaacacataattgaatctttcccagataggacagaatatatgtatttgttctgttcagaaagattcatcccagtttagcggaagagaaaacgaagcctcaacacctataatagctttttaaatatcacaaaactggtgcttatctatcaaagaatactgacaatgccattaaaattgttgttctctgcgctgtatataaatatactgaataatattggttaatatgggtatgcctaggagcaagttgctaactttctttgaattatagtttctcatggtgtaaaccaattctgcttgaatgggtctgctgtcattggatgtggtataaaaattgtgaggagcttagcataaccataacctagggcaaacccaagcccttctcttaagtagcacggcactaaagacttataacttgagtgcttttcaaaggtgtgtggaggctgtatcctctttactgctccttccctgtgttatatgtaaacaatgtttatttagaaacagaatgcttgttccctggtgctgcaaagaaacagcactcgaacataaatttaactctctcagcaaggtcatttttactttttgcagaaagggtacactcgccagcagttttgccacgagagtacaccgaacaaaggagacagggtcatttataacctgacatgtttactctactgctgtgtccggtttccattggctggaacaggaccacacattctgtatttgtcccgattggctagcaacttagaacttttcaaaagagacaaaggcagaggagaacaaaggaaggaggaagtaacttgtttccacaagttacttgctgagaaaggtaaaaacaccttcaaataaggaagaggaacaggctatgacctaatgcgtgcttggaccagtataagcatgccagggcaaatatttaggctaaattgtgggaactaagaacataaagtacattgatttctttattacggctagtagatatttaagaatgttagcacaggtcgtttaataaattttgcttctaggagacgttactatttattcccatttagatgggtaggaaagtttctttggagagaaacctctactttttacacctgcaagagctcaggttgtaagtggctgtatttctttttcaaaggtcacagctcttgttgggcggtctctcctcagctcctccatttccaggatctagtaattgctccctcacattttaccttttttaggcctagtggtgggttatgtctttctattgtccccagagccaggggccacctgcatcacagtattcattagtttcccttaaccctacccacaactttgaatattgtttcttattgcctctcatagtttacccattttagcatgccgtgtgtttgttttcttgctgatctctgatagataagcatccagagatgatgatatgtctgctattaattaaggatttgttcgtcactccatatgagttaataaaagtccaaaatatgacttaaaattaacaaattttgtatgaacttgtggttgttccatatctatctagaaacatatctctagaatagttctcatttcatgtcgagattaagatatttagtatatagtggcattaactcttcatcttgcccattaaaggcaaaacagattgttttttaattatttcttcaaatggaacttcctttcataaagacaacgtgtactgtaagcattctttactgttttttacagccaagaaaaatcgacatagtttacacacctattgatttgtcataagatgtcaactagagaacaaaaaaaacccaaacagattaatggacaagagtgttaattgcaatgatatataaaaaagccaaaattacataatagctctaacgtaatagctctgacacgcaacataagaagataaagaatgaactatctataggtaatatttaaaaatatatgtagaaaccattaaggcattgttgactcaaggacactggaagagatgctggcccaatccaaacagatgctggtttaaaatgactggactattcttacaaggggcacaccaactcagtatcagttctacagcaaaaccatatgacagaatattatggagcaatgtaagtaatgattaagttttacaatgcaaagttagacaccaaaaaatatctaactttattaaggaaaaaataaactgtttagagaaaggatgttttagctgtgggtggctttccctctgttttaaaattatacttttaaaatttctttaaatatcatgtatttctttgttaaagatggaaacgatgaagccgggcacggtggctcacgcttgtaatcccagcactttgggaggcagaggcaggtggatcacctgaggccaggagttcgagaccagcctgaccaaaatggcgaaaccccatctgtactactaatataaaattagtcagggatggtggcgcatgcctgtcatcccagatactcgggaagctgaggcaggagaatcgcttgaacccaggaggcggagattgcagtgagccaagattgcacagttgccctctagcctgggtgacaagagcaaaactccgtctcaaaaaacaaaaaacaaaaaatgaaaaccatgagtaataaatgaaaatcaattaactcagagtgtattaatggaattatatgtgtatcaagtacaatatttaactaaattataattgtaaaactcctgaatttggatagaatatctcagaaatctacccctaccaattttttcatgttaatatcacctcttctaaaatctcatcagctcctaggaaatgcctagattttaaaaagcaactataacctatggataggatggtccctgtgtggccactaggaagctgctggaagagaaagagagatatagtatattctgtagccatgtgacaagtgtgggaccagaagagcagttagtgaggataattttgcacagcatttgaaattcttacattaaagatactttgttggcaatcgcagcgtttatttgtttatttggttttacatataaataaaaatgcattcctaagcatattaaagaggcacttgtattgttaatgtcctactaaagctaggaaaatacagtttttggatcagatctaaatttaagtctagattctgccacctaggagctgtaaaatcttgtgtaaattactgaaaaatctctctgaaccctattatctatattgatgaatgggcataagagaaactacttcaggccaggtgcggtggctcacgcccataatctcagcactttgggaggccgaggcacgcggatcacctgaggtcaggagttcgagaccagcctggccaacgtatagtgaaaccccgtctctactaaaaaatacagaaattagctgggcgtggtggcacatgcctgtagtcccagctacttgggaagctaaggcaggagaatcgcttgaaccagggaggcggaggttgcagcgggcagagatcgtgccactgcactccagcctgggcaacagagcaagactccatctctcaaaaaaagaaaagaaaagaagaaaaaaaaagaaagaaaaactacttcaaatggcttttgggaagaactaatgtgatagtgtgtgttgaatgcgtagtgcctgatagtgcataattaataaatgtttattcccttttctaaaatgaggaagtaaataatatggtaaatgacattttttctcttttttaaattatattcacaaggtagacttgtttccctctatatcagtaagcttgtttatttttaaactggctcaaggcaattgaagatatttcagataacagaagttaacctttccatcctcttggtattcaaattctttctcctttgataaaactttcaaagaaggttttcaatgtttattccaaatgatttcaagttgacgttataagttcaaattaaagtttgaattcaaatccaaacttcctaaacttttctaagacagtaaaataaccattgttctttaggctcacggacttcatagactgtcacgttttatttatttcaggtttgttgtttgccacaatagacattcttctctttgaaataaaataatatttcctctatttattccttgagataactctaaaatttattcattaaaagaatcgtcctttaagtataattttggaaaaaaagaaacttccaaagaggagatattaccccagaaggctggttttttttgtttttttttttttttaagtattccactttaaaaactcaggtgttacagttcactgagcataatgtattggatttctgggaattaaaggcaatgttatttgacaaagttctaattaactggttgtacagttaaaatttttttcttcaaattttctcatcagataacctctcaaatattttctcatcaaataacttcttagaaatggaggttttattttaaaaaagacagtgttacatttaatgctaggattgaaatcttcctaaagtgggagaataaataataatgatgtatttctctgaatgctttattgattccactacaatttgtccatgtgttaccatgtgttaccatacttggtatattatttcatatccagagtccattcagtcttataagagcttattaaatacatactaatacatatcaaattataaatgaatcagtgggcattctacattttacatcgtatatatgtacatatatatctacatataaatgctcaagcatttagttgttaagtgaacgcttttcattggcaagaaaaacttacttgatgtttaattggttcaggttgcatctcatgcacatacttaaacccgtaaatggcaagtggtatggaagcatataagcgaattaaagtatgattcattttctgtgacaaggggtagtctcatttctttactgaagactactgtgaaattgtgaggatggagatctgagcaaaatcagagttctattggaatggacacaggaatgagcctatctggtaggtgattaaggtatctgttacaacttgatacacaacaagaaatccagtaatattaattggtaagacattcttctagcatcacgatattaaatacgtccagaattcctataaaatctgtacattaagttaatttctttcaaaaattaacttttggttctagagtactttgatgtgtttccataactgacctgtcaggcctctgagcccaagctaagccatcatatcccctgtgacctgcatgtatacgcccagatggcctgaagtaactgaagaatcacaaaagaagtgaaaatggcctgttcctgccttaactgatgacattccaccacaaaagaagtggaaatggcctgttcctgccttaactgatgacattaccttgtgaaattccttctcctggctcatcctggctcaaaaagctcccccactgagcaccttgtgacccccactcctgcccaccagagaacaacccctctttgtaattttcctttacctaccgaaagcttataaaacggccccacccctatctcccttccctgactctcttttcggactcagcccgcctgcacccaggtgattaaaaagctttattgctcacacaaagcctgtttggtggtctcttcacacggacgcgactgaaatgacccattagaaaagcatacttacttatgtcttgcattttttgagctataatttttaaaaaatgtaaactcagaaatgtatggaatcactaaaaaaattatagaaaatgggatctcacagttatgtctttgtaactcatgcacattaaaagcaatcccaaataaaaataatgataaatctagcataataaatcattatttctttaaatatatttttcctaagaacagaacgataactcaaatttaagtgttccaaactgataagtcctcaggggaacactaaaagtgagagtaatttaaaagtagaatatcagtagattttagcaaaagaaaaattgatagtgctcattaggaatttatataatttattgaatcataattacactattgatttacataacagactcctttcacaggtaaactttctcctagagttttgtcatattttacaaattctaaatgagttagcccacttaaatgtttgtttcttaaaattttctagcacagaaaaatatgttaataacgttttaaaataataatgtagtgtgtttcttttgaataaagagactatcatgtagaaactgtcaggcctctgagcccaagctaagccatcatatcccctgtgatctgcacgtacacatccagattgccggttcctgccttaactgatgacattccaccacaaaagaagtgaaaatggcctgttcctgccttaactgatgacattgtcttgtgaaattccttctcctggctcatcctggctcaaaagctcccccactgagtaccttgtgacccccactcctgcctgccagagaacaacccccctttttcctttatctacccaaatcctataaaacggccccacccctatctcccttcgctgactctcttttcggactcagcccacctgcacccaggtgaaataaacagctttatggctcacacaaagcctgtttggtggtctcttcacacggacgcgtatgaaagaaacatttaaccattcttaattcaaacacagacgcccaagtaagaaaagtgaatttataaaattgggtaaaattcacaagctgaattattagttcacaaactgaaatatcagtaataacctaaaatagtgtttattctcaaagacaatgtgaaaactctcattaggcattagaatctacttttcaaactcaaaagtgaatctccttgtaattatcagagctaaatatatgtaaacaaagtaactgatttagttaaagtgattaaacttttttcccattctcccccagttaaaatgaacagtggctaaaaattattatcttaaaggtttatccatagttccaattgcaacattttaaaacgtctattcctacatagaccattggaatagaatagagaagccagaagtgaagccaaatacttaaaaccaatttaccttcaacaaagcatacaaaaacataaattgggcaaaggacagcctattcaataaatggtgctgggaaaatgggacaaccacatgtggaagaatgaaactggatccctatctcctaccatatacaaaaattagctcaaggaggattaaagacttaagtctaagacctgaaaccataaaactcctcaaagaaaacctaggaaaaactctcctggacattggcctaggtaaagaatttatgaccaagacctcaaaagcaaatgcaacaaaaataaaaataaacaaatgggatctaagtaaactaaaaagcttctgcacagcaaaagaaataaccatcaacgtaaacagaaaaccgacagaatggaaaaaaatatttgcaaactgcatctgacaactgaccaatatctacaacctacaaagaactcaagcaaatcagcaagaagaaaacaatctctttaaaaagcttggaaacgacaagaatatacatttctcaaaagaagatatacaaatgatcaacaaatacatgaaaaaatacttaacatcactaatcatcaggggaatgcaaattaaaaccacaatgagatacttccttatcttagccagaatggccattattaaaaagtcaaaaaacaataaacgttggcatggacaagataaaaagagaacacttatatactgctggtggaagtgtaaattaatacctctctggaaaacagtatggagatttctcaaagaactagaagtaggtataccattcaatccacgaatcctaatactgcatatctaccaaaataaaaataagtcactatatgaaaaaggcacctgcatacatatgtttattgcagcacaattcacaatcgcaaagatatagaatccaccttagagtggataaagaaaatgtgagatacacacaccacacacacacacacacacacacacacaccatagaatactactcagccatataaacaatgaaataacgtcttctgcagcaacttggatggaactggaggttattattctaagtgaagtaactcagaaatggaaaatcaaatactgtgtgttctcacttataatgggaactaacttatgagtatgcaaaggcatacagagtgatataagggacttcagagactcagaagtggagggggtgggaatgagggataaaaaactacatattgggtacaacgtacactactcgggtgacggctcaataaaatcccggacttcaccattatacaattcatacacgtaagcaaaaaccacttgaaaccctaaagctattgaagtacaacaaaataaaaaataaaatgtatattccaataagaggaagtttgtagtcttatattcttattgctcagcaaattgtacattaagggcatattgaatattccataaaatatttttcactaatttaattactagtaatcatgtaaagccaaaacataaacattcacagggcttcctggtgatctatttcctcatattttttcctcctcattatttgcctcataatgttttgaacacatccactgtcttcaataagcttcccttacaacatcaaatgtgatttcacctattttcccctattcacttccaacagagattttagttggttatcagatcctgttgtggctgacaggcattagaaatagaaaattatcaagttacttgaggccatgaaattgagggccaaacacagatttccaaaaagcttgctgttttcgatatggttatgtcttcagcccacatcctgtcatgctagggcagttttccatttacagaagcaagtggctgtaaggttttgtggtagtcaggtagatgtcacagcgcaaacaggaattaactcaatacgtataaaagagaaagctttcgaaaagaagtttaaggccgggtgcagtgactcaacgcctgtaatcccagcactttcggaggcagaggtgggcggatcacctgaggtcaggagttcaagaccagcctggccaacatggtgaaaccccgtctctactaaaaatacaaaaattagctggctgtggtggcggatgcctgtaatcccagctactcgggaggctgaggcagaagaatctctttaactcaggaggcggaggttgcagtgagccgagatggcatcattgcactccagcctcggcaacaagagcgaagctctgtcccccccccccccccaacacacacaaaaaaaacagcaacaacaacaaaaaacaaagtttgtgtataatacatgccaagagggtaggaataaaataccatttgctgtcaagatatatttctaaacaagtttattaggaaggcagtagcagatatgaaaaaaaaataggatagggcactggaaataataaatttaaatcagcatttttttaaatttagaaattcataatctccaaccaacagaactaatacttaagtataatttccatggtaatgattatttaaaaccccatattgactatgaatttatagatggtgattccatatgcaaaaaagcaaacttgcatttataatagaaatgagaacaaagcaacagaatgtgtaatatgttgaaggagtcattaactttagtggaggacagtcaagttcctaaagattcatttatttattcattcattcagcaaaaaaatagaattatttagttcaggttataattccagattctttataaattaataatgactttaaatgcatgtgaatttcatagtactgtatatttttttatctaggaatatttttccttaaatgatactattctccgaatttaataaagtaccatttctactgatagattatgacttttaaaaaattggtttataattaaggaaaatatgaataaaaaggacaagctgattgattcattaagaggcaaaattatgctagatattgtatcaacaatatattgttttactaacaataaaactaatgtttccattaactaaaataaataattagaatgactaccatttttgaaatacgtagaacaaataacaaattttagtgcatttaatccctattttaattttattaggtttttttttcagttctactttacatacaagcaaacatgctgagctaagctaatacaaaataatacattttctgttgctgttgtttgtcttctgttttttgagacgaagtatccctctgtcacctgtcacctaggctgtagtgcagtggcatgatcttggctcactgtaacctctgcctctcggtttcaagggattcttttgcctcagcacccccgagtagctgggattaaaggcatgtgccaccaggccggctaatttttgtatttttagtacagacggggtttcactatgttggccaggctggctcaaactcctgatctcaggtgatcggaccgcctcagcctgccaaagtgctgggattacaggcatgatccaccgtgctgggcccagaataacacatttaagaagtgattttggctggccgcggtggctcacccctgtaatcccagccctttgtgaggcccaggagggcggattacctgaggtcaggagtttgagaccagcctggccaacatggtgaaacctcgtctctactacaaatacaaaaaattatccaggcatggtggagggccaactactcatgaggctgaggcaggagaattgcttgaacctgggaggtggaggttgcagtgagccgagatcgcgccgttgcactccagcctgggcaacaagagtgaaactccgtttcggaaaaaaaaaaaaaaagaagaagagagagaagtgatttaaacctaagtctgttcaattttaaaacttgtaatcttaaataaaaattatatttagaattatagtatcaattttattggccagttaaaattttaataaagtagatatatatgcaatttgtactatcagctatagatggcttgtttgaccacattttaatgtgttacatattttcatttagtatagttcatcctggaatattaagttccctagatcaaccactttttaatatatactcatgctattgttttgaaaattagagataactgtttagctttaacataaggctttagactggttaactagtagtgtccattcaggtccctgctggtttctgtttgaaatcaaggccaataataacggtcttaaagaggattattggaaaagttaagatgtgaaccttcttgctcaacaaagaatgcaagcaaaattgtcttaatctagaacagtttgaaaacactatcttagtctattagtgtattttttcagtccggtttgtttcttctgcttctttaaatcatagttgtttttctggatgaacttcattataatctggaaattcacattgacatttctcccagaaagccaaataaagcacacatttagaaagcctaagtacagcatctaaagcttccttgaccattataactgaataacagccgtgtagtgtagtgctaaaaaaaaaaaattattccagttacatggttcagtctcttgagatttacaggtagccaattatggcccacaggccagacaagtgactgatcgttgtctgaaaacaacgacgaagtggggaggtgaaaaagatttacggttttttttccccttacaggtagatgttgtttgaaataatgagatttaaaacgctaatgcagagctttgatctcttctttgatgtttcttgcctgttgtctatatgaaatatagtcagttaaaataaaaagccagagaatagtttctactcactaatgattaataaaaactgcttggcaaatgcaatcttgcacattgacaaatgaaaacagaataggatgcccaacaatggtttaaaaaaaaaaaaggtttttttgtttgtttctttgtttgtttacattgccacagtacactgctctttgttccctgaccctgcaagctctcaccgggtgacttcgactttgcacctacttttctcttttttagaatgccctctctcacatgttaccactagagaaacaatcacgtgtgcttcaaggccaaatcaaaaatttcctcttcagtcctttggactgagagagttatgcccaatttcacagcatatggtacaagcctctgttatttttctgtaccatggtattatatgtacttgcctgtgtctcttctagatatggggtccttaactatttttgtgctatggatccctttggcatctggtgaagcatatggaacacttcccagactgttttcaaatgtgcaaaatgaaaactaaaagcatataaaaaacaaaggaaattaattatattgcaattgtaaaatactgaatataatactattatatgctattaatacattagttataagcataataattaatacaaattaaaagtagtgattagtatactaaccactggtatatattaacatatgatttttcaagatatccaaaacaactaggatttgatataaaaatattggtaataaattcacagatattgctaataccgttctgtgttgcttatcttcataaagggaaagaaatgcaaattttcagttacaggttagtgaaaataaagatgtaatttttttcctatcatggttcatggaccccagattaaggacactgtattttgactgtatggcttcaagggcagagtttttatttgttcatctttgtgtctttagtacagaacagaaccatgggcacaatccaagcctattgaatggtggccgaattgtgtattgaacgttcaaatgtcagttctatcactgcccttatcacatcacaagagagaaatttgatgttcattaaaattaataattttaaaaaacattttaattaaaatatttattataattaaaatctgataaacttgtcaatgggtatgatacgtggcactgtgtatattcttttgcttatacacagatgcttgaaaattaaaattaaaaagctactgcaactaagcactcagcaattgtcatatttttctccacttttccctaagtcaataggcaaccatgaagttgacaatgttgctgataacattgtcatactcaacatcatttcccacaaagcttaaacctctacagaaactcagcagtccctacaacacatccttgaagaatgagaggggtgtcaataatttcagctgctcaaatggaaggctctgacatcaaggaatattaagtggcacattgaagggaattctactattaagtaatgaaggtgaggaaaacaatttctcaatccacggttatttctttgttatactaagaaccgtgcccaatacttatggaacaaaataagcctatcatttggacgtctcctatcagcctgaagcctgatgtcatataaaccaataatctgtgattgaatttttcagctttcagtgttttatttttagcataatatttggtattgccatacgtgacttattattctgttcaatttaatcaaattagagaataaacaaaacgacaaacataatttctcttaatgtgcgtgtgtgtttttcttttttgagacgaagtttcattcttgttgcccaggctcgattcgagtgcgatggcatagtgttggctcactgcaacctctgcctctggggttcaagggattctcctgactcagcctcccaagtaactgggattacaggtgcctgccaccacgcccggctgattttttttctatttttagtagagaccggggtttcaccatgttggccaggctggtctcaaactcctgacctcaagtgattcacctgcctcggcctcccaaagtgctgggattacaggcgtgagccagcatgcttggcttaatgtgttttaatgacataattccaacaaccatataactatattagtacaaaaagcaactacatgaaataaaaatctcaattgtttgccaaatggatacaaataatatatattacatatattatatataacatgcatataataaaatacacagtagtctgcctcttatccatggttttggttacccatgatcaactgcagtccaaaaatagatgagtacagtacaataagatattttgagagatagagaccacattcacataacttttatcacagtatattgttataattgttctaatattagttattgttgttaatctcttatggttcctaatgtatatattaaactttgttatatgtgtatgtatataagaaacataatatatacataaggtttggtattatccacagtttcaggcatccaccaggggtcttagaacacgtatccctacagataaggggagattaattatttctaccattacagaattaaaatgagtctgtgttaatcttcctattcaaaaattatttctaattcagagaaattcaaagagagtctataacgctatgcggtttattgacattaaagacattaatagttaattgcttgaagaagaaaatagactttttcagtaataataacaaatttgcagcataattggaagtgtaccgtcctatccccctttgaactataaaataatattttggtaaaatatggtgaaggatccttacagtgtatcttgatcatagtcctcctgagttataattatctacattattatactaaaattgtggctcttcctcataagatattaatatattcactatatgaaattaactaattgcatagctccaataaaatattaacttattcaactgttaaagtaagaatatcggccaggcgcggtggctcgtgcctgtaatcccagcactttgggaggctgacacaggagaatcacttgaacctgggaggcagaggttgcagtgagccaagactgcgccattgcactccagtttgggcaacagtgagactccatctcaaaaaaataaataaaataaataaagtaaaaatattaattgcatacaaaaaagaaatatgctggataccgtccattgtattagcaatttcaaggctaaacattacttttttttttttttttgagatggaattttgctcttgtcgcccaggctggagtgcagcggctcaatctcggctcactgcgacctctgcctcccaagttcaagagattctcctgcctcagcctccctagtagctggaataacaggcgcccgccaccatgcctggctaattttctttgtatttttagtagagacggggtttcaccatgttggccaggctggtctcaaactcctgacctcaggtgatccgcacgcctcagccgcccaaagtgctgggattacaggcatgagccaccgtgcccggcctcaacattactttcgatctcaagactggaagtgcagtactcaacaaagtaattggggaaaaaaatagtttttgatgtaaaaattttagagttcttgatctttgaatgaagttggtctcccaataaatttcaaacgaataagaaacattagatttgtttccttctggctctagtatataggaaagacatttgcaaagcaggtattccaaaatatgaggcaaaatcatcattcttgcccccccccccaaaaaaatcttctagcaactgttgtaacacagagccattataatgtaattagacagactaagaaccagatgctaaggaagcaaaatataaaagatgaagcatgatattattttggttaatgaatttaattccaaatgttacaggagtgattcatggactttttttttcccaaaagatcagttgtcacatgtacatattgcattttaacatgatgtttatgtaatctaatgagaaaagtaaattctcatgtaatattagatgtttcgaaatggataaactgcagacacttccacgggtagatgaataattcgtcaatagtgataagttaatctttaaacttacccctcaaaatggttaagagttaggttatactataaatgtaatataattccataaaaataaccaagacaaaaaatactttagaaatattgaaaatataatatttgttttcctctaatatcctcaatctggtattattgtgtaattcgaatatatggcaatattattattatttttttttttttttgagacagaatctcacttttttgcccaggctggagtgcagtggcatgttcttggcttactgcagcctccacctcccgggttcaagcgattctcctgtctcagcctcccgagtagctgagattacagatgcccaccaccacgcctggctaaattttgtatttttagtagagacggggtttcaccatgttggccaggctggtctcgaactcctgacctcaggtgatccgcctgcctcagactcccaaagtgctgatattacaggtgtgagccaccaccgtgcccggccagcaaaataattcttaaaattcaacttaaaaattactccaagaaatgtgtaggtaaaagtcaaaacactttagtaaatccacattttgtatttccatttatagtaacctctagtgctcattattttgaagataaaactttcttatacagtaagctttttaaaatgtgagaccaaatcaaacaacaagagcgtaatgaaaaacgatagaaggaaaacaactaaaataagaacctcctagctcagatttattctaaaaagttgaaaataaatataatgtagaagttattattatgaaaacataaataataatattttttcatagatagtaacactagctttactctgaaagtagaatctgtgcttcattaatagtgcctgtgtttaacactttgataactcaccatacagaagtatagcctcagtgttcccagattcctgttcctagggatgaatgatcacattaggaaggtacattcctgttaatttggctaaatctgccagcccaaatcataaagttctcctaaagatgctctatctcaagagcaaacacttaggaaaattgttaatgtttataacaaggcaatcaacatctcatttaaatattcagaaattgatccttccacttcatactttcagttaggatgagcattgaaaacatgtagtaaagcacaacctcagcattcataatgaatatgataagaacaagccttttctcattcatgtttactaccaaacatctgttgaataaactacttaatccttacaaacataaccagattattttcagcaacaatacaaactctatagtgataacagctggtcctttactttcttcagggatatacactccacatatatttcatttcttctcaagttaagtgacaaaaagctaaaatggattgtgatgcagtcaaagccacgaatgacacagttttctaccatagacaaggggataattttttttttctttcaatgtaagccacaagtgtaatggggggatctcctaaacgaaaggcattatggtagggggaggttccttttcaagaccacgcctaaactactgataaatatgataaatatatggttgtaaaagacaacatttctttttttttttttcgagatggagtctcgctctgtggcccaggctggagctcagtggcgtggtctcggctcactgcaagctccgcctcctgggttcacgccattctcctgcctcagcctcctgagtagctgggactacaggcgcccgcaaccacgcccggctaattttttgtatttttagtagatacggggtttgtatcactgtgttagccaggatggtctcgatctcctgacctcgtgatccgccggcctcccaaagtgctgggattacaggcgtgagccactgcgcccggccaaaagaaaacgtttctatgaacacagtattacttatacaatatttaaaaacatattatttgatgctcaatgttttataaacaatgattcaaaaatgcagagctgggtgagcacggcggctcatgcctgtaatcccagcactttgggaggccgaggacagaggatcacctgaggtcagcagttcgagaccagcctggcccacatggtgaaacccatctctactaaaaatacaaaaattggccaggcatggtggcgtgcaccagtaatccctgctattcgggaggctgaggcagaaaaatcgcttgaacccaggaggcagaggttgcagtgagccgagatggtgccactgcactgcagcctgcgagacagagtgaaacccagtctcaaaaaaaccaaaacaacgacaaaaaaccacagggctggccgggcacagtggctcacacctgtaatcccagcactttgggaagctgaggcaggtgggtcacctgagctcgggagtttgagatcagcctgagtgataaggcaaaaccccatctctacaaaaagtacgaaaattagctgggtgtggtggagcgctggtagtcccagctactcgggaggctgaggtgggaggatcacttgaactcaggaggtcaagggttcagtcagccatgatcgaccactgcactccatcctggatgacagagaaaaaaaatgcagagctactgaggtatttacaaagaaatataaagcacagcacgtgctctcaggaaatctataaaaaagttaaaaagttatggaatcaaagttaatccacaggaaataattagcaagcaattatgtcgataactgggtagaaataactatgtggaacaaaagttcatagaaaaaagaggtgtttcaagccgttagagaaagtgttgtggtaactaggacttgaattgaatttttgaagatgggaatgctttagaaccaaaagtcgatggaggaaaaagattccagaaagggggaatcagactagaaaagcaagaataaatgagctggcctgtataggagagagaatattttatgcagagtatatagataaagtaacacagttcaaacccttaaaagtgtatagccagcatagttttctgccaggattcatactgctctcaaatcagaagatactctactagatttaagaattacatagtcaatcagctgaaagccttggaactttcggctacatagtcattaaaaacactactattatagctcaatttcaccaggccacattatatatatatatattttttaacataatgtacacaatacatatatacaattttgccaattaaacttgtttttcaaaaagtaactcattttatctaaagaagttaagctcatcaaagcaaagtggaacagtggtagccagtaactggggatggaaaaaaatggggaaatgctggtcgaaggatagaaactctcagttataagatgagtaagctctggggatctaatgtacagcatgttgactatagttaatagtactctattgttacttgaaatttgctaagagagatcttaagtgttctcatcataaaaaattataatggcaactatgtgaggtgaaggatatattaattaacttgattgtgataatcatttcagaatgtatatgtatcaaatcatcatattgtacaccttgaatatacccaatcgccatttgtcaattatacctcaataaagctgggggaaaaggtacctcatatttattattacattttattgttataacacatatattttatctcatttgacccttgaagtaactgaacctaaaaagcagtatttttagatatgaaaactgaggcccattgaggattaatgattctcaaagccacagggtaagcagtaaagttacaactcctctcatgtgtcctgattacaaatcattacctaacgtctgtaatttccttgcatcatcgagaacctgaaacttttatcataaaaacatttctaggaaatctggtaccatacgctaatcaactatggaaagaaaatccatttttaaaggagtatctcaacttgttgcaatttgcacataaaaatatcctttgtctcatatactacgggacaaaacagaagcagaaacaatgaaataggttcaccattagagatctgactagtcttgaaatgtagacaattcaggtcattagtcatggagtcctaaggggaaaaagcatgcctgattccacactagtaaagccagaagctatctaatttacatcctatacttggctgaggatatcagatgtgttcaggctgaacaagttcaagactcttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtggagacggggtttcaccgtgttagccaggatggtctcgatctcctgacctcgtgatccgcccgcctcggcctcccaaagtgctgggattacaggcgtgagccaccgcgcccggccaagactcttgcttgagtaatttaaagggatgtgacacagtctgaatagtaattggttatttaataatcctgcctgcagtggcaacataagcttgctttactcttaagcactggataggacaaactgtcttactcagtcctaggaaaagaaacgttcatctgaacaaaagatttaaagtcgacctgatgtgaaatcctgaaatacattttgaaaatgaatggattagcgataaaattaatgagaagactaaagtctctgaaatgaaacatttttggcatgtgataacctgatatgctcccctcaaaagtcccttggaattagcctagctatctcagcatagcttttcttacatcatgggtattacattagccaagccaacttgtctatttgtccttgtctcacatcacttttcaccctcaacttttactccatttatgccaatctccttatccacagcaagatgctactttgactttttggcctttctcagcatgcttcttcaccactgtggaagagcttcccagtacaactactactactgccaaccacaacctccatatctgacactaaatccttgcctactaaactgctcattatctttaaaattggcatcactcacttctacttcacacatccactgttcgatatccagccaagcctggactctgactgatcacttcagtgctacatacaaagacaccttagactttacttccttgaactttattgaacatctttacttccttgaacacattgtatatataatagagaaggaggcatataacatgacatatgtcaaaaatatgtcatatatgtcatatatatgttttatatatatatatacacacacacacatataaaatgagctcaaggaagtaaagaattgtaagtattgtcttctttctccaatacctactcctctttgctaaggcatcagatgatgttgtttgtgactcagtaaatcactattatccaccatcaactgaaccatgctgttactctttcccattagtttattccgcaaatacatattaagctactactgcgtgactgacaatatgcatgttagtgtatattcagtggcgatcaaggcagttagaggatggatgaggagagcattccaggaagaggcaatagcagtacagagactggcatttgagaaatggcagcaggtcagtatggctgaaatgcagcaagactgcagaagaaaaggaagaaaaatgaagtgtggttcttggtaaagatattggacgcatcagagcagtaacgaattttaatcagagattgacacaacctggtttatgtttttaaaagctcaacctttaggccatgtagagtatggagtgagtagaaaaggacaaaagcacaagtggcaaagatgagttgggggattattgtagtatctaagggtaaattagactaggatggaaacaaaatatatggatgatatatgtccattttctctgctgttccatgagccttttcttcacttactgggctatctggtccatctcccataaccagtcttctaacccttcctattgatttgcaggttcactaactgtttcctttcgatccacctcctgttcacttttaggtactaaacagagtgaagtcatcccgtgtgagtttcctcaccctccctccctctaacatcttaagtgcctttgccctgttttgtttaagcatgtgaaacaatttctcgctaaccttctgtgttactttagattctccccagacagacactgaggcaaggatttgaggtgcaggtacacagtttatctggcaattgattacaaaaagtacaagtgagaggaaagagaaagtgagattaggaaaggtaaggaggcaatcaaaggtgtgtcaatgagcacattattctggggctcagtcctgctggtgaatctctgagaagctgtgaggaacatgcctcagaattatgcaccagaagatgagatggctgcgtgcttttttcaagtacttccatcccctcgtagttaaaggtcgcttctggtgacattaacacaacccctcatatttctggcttactcctgtttatagcaaagcaagatactgcatggaactcgggtggggaaagaaatatgcggcagaacatcagcaacaacttttacatcttcttatcccttcaggatcttgtttatttctctcctctattgaaacactttttaggccaggcacagtggctcacgcctgtaatcccagcactttgggaggccgaggcaggcggatcacctgaggtcaggagttcaagaccagcctggccaacgtggcgaaaccccgtctctactaaaaatacaaaaattagccaggtgtggtggcgtgtgcctataatcccagctactcgggaggctgaggcaggagaatcgcttgaaacagggaggcggaggttgcagtgagctgagatcgtgccactgcactccagcctgggtgacagagcatgactctctcaaaaaaaaaaaaaaaaaaaaaaaaaaagactttttaaaggggttattattaggggctatatactggatcttataaatcatctagtccaaccctattatgtgaagattagaaaacaaagcattcacattattctatcgatttttggaatgctatttgcaaacttttttctgggcccacttaaatgtataagttttccatattttatgttggttaataagattaaaaccaattttaatatcttgacaccacattgccatttatcaatatgtactacgttttttactggttcctcaaatctcaaatctgtgccagcgtctgttgaatttttataattttgactcaatttatcattcttttttttttttttattgagacggagtcttcctctgtctctcaggctggagtgcagtggcactatcttggctcaccgaaacctccgcctcccaggttcaagtgattctcctgcctcagcctccctagtagctgggactacaggcgcatgccaccatgtctggttaatttttttgtatttttggtagagacggggtttcaccatgttggccaggcaggtctcgacatcctgacctcaagtaatccgcccaccttggcctctcaaaatgttgggattacaggcgtgagccaccacgcctggcctatcattcttttttaatttgcagacttttaagaacaggctaatttgagacacagaaccacaaaagctacttacgttccaaaatgctctgcagaatctctttttgcatgtgctacgtatggcctttgggagaagtacattttttgtagttgttttgtggttttttgaaatgactagaaatatttttagggccctagaaacctccaaggtaagtgtttagaaattgtgcttctaggaatctgtcagtacttttgtaaacattatctgaagcataagcataaacaaatttgaacagcaggctagctcacacagaaatgattttattcattggaatgttctcacatgtggtatactttatttttagtttggtttcatttatgattaataattatgattccaaaggtgcttaaatcagccggccatggtggttcatgcctgtaatctcaacactttgggaggccgagatgggcagatcacttgaggtcaggagttcgagaccagcctggccaacagggtgaaaccccgtctctcctaaaaatataaaaattagtcaggcacggtggtgcatgcctgtaatcccagttactgaggaggctcaggcaggagaattgcttgagcctggaggtggaggttgcagggagccgagattgcaccagtgagctccagcctgggtgacagagtgagactccgtctcaaaaacaaacaaacaaacaaacaaaaaacaaaaaacaaaaatcaaaggtggtgaaataattttgttgaatatttggcactgtctacattaatgcacacactcaatgtatatattttaacttaatttatacttaaaattgtataaaattattttagtcaaagaacctaatgcagcttagccttgattgataatttcattatctttaattacatggcagaatttctcctcattactctttaaccaaaaggctgtggtagaaatcattgatgctcatttttattggaaagtaatttttctagatttcctgataattgagtgataacttcagcactccttagtcacttttcattatgcagacaaaatctgactcttaactttcaaaaaaatatcttaccataatgtattttcaaataacatgagtttaattaaaaagaactttcccacaggttcatgtttaatcttggtttgagtcttgaatatagagtgaagcgaagtacaactttttctgctttggacaaatttagagctgcttgaagagataaaaacaagcggggacctccctctaaaccttccacttctctttctctccctctctcaactgtgttccgaatgctttctctaaaacacagaggctgagttttgactggctggaaaaacatcagtttatttcatgttcttcctttctccagcttccatttcaattccaagtgtggcccaaaagaaaagataggaactgcataaggatgtttcagtcaatgataaactgcatataccgcagtggtcccatttgattataacacgggatttttactgtaccttctaatggttagatatgttttagacattgaaatatttaccattgtgctacagttgcctacagtattcagtacagtcacatgctgtacaggtttgtagccaaacagaaataggatataccatacaacctaggtctgcactacgctataccacgtaggttagtgtaagtacactctgtgacattcacacaacgatgaaattaccttagtatggattgatcagaatgtatccctggtgttaacacataactgtatatatcctgtgtgtgtttgtgtgtcactgaagagatatgattccttcaccatgaggaatcagaaaactgaaaaggtaaacaaattattgtatcctgaaagtctcaaatgagtttttgttctactttcttttgtttttttttgagacagaatctacctctgtcgcccaggctggagtgcaggggtgcgatctcggttcaatgcaacctccgcctcccgggttcaagcaattctcctgcctcagcctcccgagtagctgggatttcaggaacctgccaccacaacctggctaatttttgtatttttaggagagacagggtttcgccatgttggccaggctggtctcaaactcctgacctcaagtgatctgtacacctcagcctcccaaattgctgggattacaggtatgagccaccacgcccggttcaaatgagtttttttttttttttttcagtccaatattaaaacaaacgaaaaccagaatgccttttgttctcacattcaattcataatctaatagctatcagaataaaatgtcatatttattattcatttggaagaaaacaaacagcagtaaaaattgaaataaaaggctgggcgttgtgagtcactcctataatcccaacactttgggaggccgaggtgggcggatcacttgaggacaggagttagagaccagcttggccaacatggtgaaaccctgtctctaataaaaatacaaaaaaattagctgggcgtagtggcgaatgcttatatcccagttacttgggaggctgaggcagaagaattgcttgaacccaggaggcggaggttgcagtgagcccagatagtgccattgcacttcagcctgggcgacagagggagacgctgtctcaaaaaaataaaataaaaataaaaataccctggccaggcacggtggctcacgcctgtaaccccagcactttgggaggccaaggcatgcgaatcacgaggtcaggagttagaaacaagcctggccaacatggtgaaacctcggctctactaaaaatacaaacattagctgggcgtggtggcaggcgcctgtagtcccagctattcgggaggctgacgcaggagaatcacttgaacctgaagggcggaggttgcagtgagccgagatcgtgccactgcactccagcctgggcgaatagagggagactctgtctgaaaaaaaaaaaaaaaaaaaaaaaaaaaaaaaaaaccgaaagaaataaaaataccctgtctttattttcttccttggcaaaattgtctgtaggattcactcatccatttatttaattaatttattgaattcccattacattccaagcaggtattaactactaaggattcaatgatgaaagacaaggtgtataggagacctagtacgtacagccttagtttcttttctcagatttatgctctaaaattccgttaagaatggatttattggctgggtgcggtggctcacgcctgtaatcccagcactttgggaggcagaggcaggtggctcacctgaggtcaggagttcgagaccagcctgaccaacatggagaaactccgtctctcctaaaaatacaaaattagcttggtgtggtggtgcatgcctgtaatcccagctactcgggaggctgaggcaggagaattgcttgaacccaagaggcggaggttgcggtgagcctaaatctcgccattgcactccagcctgggcaacaagagcgaaagtccatctaaaaaaaaaaaaaaaaaaaaaaaaaaggctttatttttatgaagaaaaccataaattaatgtcataaatcttatctatgttaataattatcagttgctttaatcatgaaaacaaaagggaaaaactggcaagtgagccaggctgaaataattcaatataatatttaaagattagaaatatggtacacttgttttctaaagatcagctccatcttatcaaactggaataacatctgaattaaaataatgtgacattgtcatcaaagctctgattattgctgaagcatgtgataggtaggactggccaaaaattaatacattagaaaagttaaataaaaaataatatatatttccttgatatgtttaatcaaaaacatggagaaaataattgtaataaaaatgtctacatccttaaaggcatgttcacccctaactctcagttacgaacatctagattaaatttcattaaaagtcaattatccatattaaacatttaatctaaacgttgcgccccattagaatacatcaaaagcttacattttactaaaagaaagtgactacaatgaatgaacatataactttatagcaaaggttataatttttgaatgtttgactttagttgttaacatttttaaagacgttctaattttttacgaagcattataattaagcaaaatatccagttttttcatagtttcagttttcaaactgtggctttggtaaggtaagttggaaaacatcttagttttaatggcccaaaaggggagactttgatgtatagtatagattcaagtgcttatctcatggatcatgctttcattttactaaaaatataatagactaaaactttacatagggagaaatcgcagagaataagaatcaaaggagtaattaaaaattgagggttttgggaggctgaggcaggagaatcacttgaacatgggaggtggaggttgcagtgacccgagatcgtgccattgcactctagcctgggtgacagagcgagactccgtctcaagaaaaaaaaaaaaaattgaggttttacgtatttgagacctaatgaccaattgtttacttttgtcaacagtaattttactgctaagtaatttaagtaattttactgccagtttcagcaggaatacaatttcctaacatagatatttaatattttattcaatattttaatatattaatctttagtagaatatatgcttcaattttgtgaggatatgtgtttattttcttgtacagtgtaaactaaacaacgcataaagagaacacaggtaactagattaagaacaattattttctgctctttgtattagaacactcattttctgttcttagtaatctagcagcatcagcatctcctaaaaaatctgttaaaaatgcagaggttggggccccacttcagaaggactgaatcagaaactctgggggtggcatccagcaagctgtggtttaaccagccctccaggtgaatctgatgcccactcaaggaagagtgagaaccactgttctaatctatcgtcttccaagagtgtgtgggaagatcaaagaaaaatcaggtcatggggctttgcggagaacaatcaaacaaatacataaatcaaggactctataagcataatttaataaatagacggatgattgtttttaacttatttttcaatttcctccttagtttgtacatgcatttagagataatctcagcaatgtcagcgagcttggtggcatagttcaagctgtgaaggttcaataaataggtcggtaaacattgcaaatcaacacagcttttgatgaaatgtcaggcaagacagggcttagctatattcggctcagcttgaactcataaaccatcaactggcctctgtacttccaggacaatctgatgaataaaatacagatataaaattaaaaaatatatttataaagagattagtaaaacagcaatctgtaagtgagaaatgacaaccacttagtccagaccaaatgagagagaagacttgcaaaagggtaacttttcttacaaatcaagttatgggaaaatttgagatccaaatagacttttaactttggattgtctttattcccaacacacgtttttaatttaatgcggtgtactttatcctaactcttttagctcacccccctgaaaaaaaaactagctgtcttcctaaagatagagaaaacttgtccaagtcagaaactctttggaattttaataaaagtaacataatttagaaattaatatacttcaaatatactgacagtatatattggcaacagaatatatgctaatttagaattttaggatattctataattaaaaaaaaacctgataaatcactacaccttttcactttatttagaagctaccatttaataataagtgtttaacctctaaaatcattctgagatatttcagataattaggcagcctggaattactgtttacaattgtcccagtttgcttcctaataagttgtgcttgtctaaacatgtctaaattactattcacaaggatccttgttatttccgtcttctttgattaaaaacttcttaaaaatgtgagtgtatatgtgtatgtatatatatacacatacacatattcatatgtacatatatgcataaataagcccatatatatatgtgaaacacaggtttttctattgttaatataaaaatccctcattagttttctaatgagtttatgaatgtagtctacgtccttagaaatttaatttgaggtaaaaatattatcgtttatagattaaggtctggatatttttttcttttcttcatactagaaataattttagatacctgaagacaaagttcattaaagccacaacccaaaaagtagaatatgggttccttcttatttcagtgatttgcattatcctataggttattggtgtcaaacccctttcttcccttcctcacaacaaaagccccaatttaacttttatagaaaggcatatggaacaggagtcatccaaatatatcccaggggttgcaaattgaccaaaagagtcacctttagggaagcctgcttctgaatgcttgtggaatttatcattcttctgaatggctgttgcatttatctgcagcttttactcaccagatgagacctcagacatttcaaattctgcggaggctggctacacaccttcataggaaagctttttgctgatttccctgttggtacttttctcttacacattctatggggtatggtaaacctggaggtagagtcatagccaagcacagataaagcaggcacagaatctctgaccagcctcacaaaagcagacaaacacacaatctttttgcacctgtttcttccactccggttgccgtgaatagtgaggtgttctcacagattcagcttcacagacagcattttgcaaacactcccctctcacagcaatggtttcttccctcaccggctcaatctacctgattacgttcccttctaatcagtaacctcagttcctctagaaataactgtgtcgtctgctttatataggatttatctgagtctgaagcagaaactggaaagtagacttagaggagctgattattatgaagacacctgtatttttgtctggtattcacgtgaactcgacagtgcactcatttatgcaaactggtgttagtgaaaaagaaaaagaagcagagaaggaagcaaaaagaagagactggacctataaagttgcgcacctgtgtgatgctaggagaagaaaataactctaaaaacgtccagtgctgctgaaaacacatttgaacttcctatgaaaaccaacagtgcttgacatacaaatatcttcctccagacacacctttaaaaatacattttaaaatctgaaacaatcttaaactcaatctaaaccacaatgcagaagttaattcttaaggcaaatggagattaagaacgaaacttcatccacataaaccctgtgttttaaaaaaagaattaaaaggaataatccgtataacttactcaaatttgtatttgaagttaaaccttgaatcctgcttcttgaaaaaacagaattgtgtcaggcttctgtaatgactgtttacccagagcataagattgaagtggattttcagattaaaaataaaactcttaagtatgtcaatccccatctgatcaaagcatataaactaaatttttccaaggacttcattaacaatataaccaagtagagctgcagttcttggttttctttagagtaagttgttaaaatgattgaagttcatgtaaaagaaatccagagttacagttaaggtttgctttttttttttttttttttttttttttttttagtagatccagtgcccggcaaacagtatgtgctcaacatatgtttatttaatgcgaccaaaagcatacaatataaagtgtcattatcattgccactgatatttttaaaaagccatgttctatacttatttcatttttacgtaagccacaattttacaaggtttcaaacaaaaaaaaaaacccacaccttgttttctttaatataaaatatttggcaattataagcatggaccgtgctggcagtaagttaaaatgtgactgattttttttttctccgttccctactctcaattttcagatgcggaaatttcatttggagagaacaggaggtgttggtgggaaaaatctcattaatcgtaccgtattcccttgtctacaaagagtactgcatccaaattacagaagaactaaagaaaccttgtagcatgagtataattagcagtgctactaagtgaatggaaatggaggttgcctaacttaattaactgtaatcattactcattgtcgtactgcttagaaagattagttgagggtatttcttctgtggtattactttaggcgtttctccttccctcttaaatgtgaaacaattacactataaagaaagaattagcatgccctttcaatcagatagaagcttttccgaacaagtaagttccatgtcctagctcgagggcggcaaaacaggaatgatgggaaaatatttagttgggccaaagttagagaaattaagaaaaaagtagttaattgcagaagttactgacttgaggaggaaaaaaggaaccctatatatgagtttctgtaaagaaattagctcttggccagggaagaaataaataacaaattaagatctaaagggaaaaattaaggataacacagtacaaatacgcagtactgtctgatgaagttgttcacaattgcacaacagtgcaagattccacaatgcaccttcaaggacactgtagctaaggattgctttctgatcatttatccttttagcggaagacacttggcatctgggaacatttgttcttttgaataaaaatcacctcatacctaaaaggaacctttataaatatcagaaaaacaggaatgtctgtgacgacgatcattggtggggcttggcctcattagctctggggccactagtgtaaaaaaaggttcacagggactctcttctagtagggactatatatatatataaatatatatatatatgacggagttttgctcttgttgcccaggttggagtgcaatggcgtgatctcggctcaccgcaacctctgcctcccgggttcaagcgattctcctgcctcagcctccggagcagctgggactaccatgcgccaccacgcccagctaattttgtatttttagtagagacggggtttctccatgttggtcaggctggtctcggactcccgacctcaggtgatccgcctgcctcggcctcccaaagtgctgggattacaggcgtgagccacagcgcctggccgggacttcatatttaatgaggcttttcactgttctaggaattaaactgagtttcaggtattgcattcaagaatcttctcagcaaacctgcaatattggtaatgttattccttaaactcgttttacaggtgaggagattggagctcagagaggtttttcagtcatccaactaaccggaagtgcttaagaatccagctctacctgactccctaaacaagtgtgtgtcaagagttaatgggcatacaaaccacctgggtatcttggtaaaatacgggttctgattcggtaattttaggtgggacctgagattctgcatttccaataagttccctggggctgctgcggctgctgctgctgctggtggtctttggacaacacatcgggtagcgaggcccctagacccgtggttctccaactttgctgatattagaatcccctgaagaacttctttaagaaaaaaacccagtgcccaaactgcacttcatatcaatgaaatcagagtctctagaaatgagactcaagcaattctaatgaacagccaagtttgagaatctgtacccattgacatgttgttatcaaattaggtgctcatcagaatcaactgacgagctcattataaacccagagacctacattcattaaagcagtgataagacttaggcctttgcacatttaggtagaccccccaggtgattctgttatccaacagtttgagaaccactttctagaccatgctccttcaaatcaatcagaccaagccctgcagacaaacttaccattcaggcaaaaaaagttgtgagtaggagcttgttttcatgcatatcctcagggttcatcggtacgataagatatcctccaagctaaaaattcatggggccctcacaccaccacatccccagttacagacatttttttaaacctcttttgtgagtatcagtgtactcattgtatgcttacactgtgtgtgggtttttatgcctgtggttgcgcattaaatctattactttgtcagtacttcaggggaaagcgtatcaatgttgtaagacatttaatatatgcccagggtagctgtataattaaaaggaattgattttgaaaaagaacctaatggtaacctgaaatgaatagacaaaatgatccctaagctcagtaacaactgcagcacaatgtatcaccttaggttaaaacctagttcataaataatcctcaactcctcttcaagggcttgtgaagatgagggtcattttgagaagtgacacattttggcttcaggggagttttagcataactgctgtcagattatatcttcttaaacattttcgttggcagtgaagggaagatgttagatcatgttagaaatgtaactaatggggtcaaaattttacttccttacagctcttaagagcacatacttataggaaactcttttggatatctcccttaatattatctagaattgtccaactattcctttaaatgagcacaactggggccactccttatggctctgggcattgcaccttgcacaaaggtgcttgagtatcatacccacattccccccagccatccctgtgatcctccaataaagcagagtcatactgaaaaaaaagcgtgctttctttcaaaattggctattctgtggatttgggaagtggggaggatgcctctttgtttaattttcaaagagtaccatataagcgggtagcagtcctgcggacaacaaagtgtaataaaaaatgtttgggatttcagttggaaggcattgggaactaattttatgacctagggcaaggtatttaaacttttagcatcaccaggctttccagctataaaatagcttggcaacatgccatagacaatcaacactcaggctccgaagtcaaagcaatttaactagggcttgaattccagttctcctatgtactagctgcataatcttggcacgttatgttatttatatcacatttcgttgtctgtaaaatggggataatatcaattccagcctcctgaggctattgttagtttccactacaaggtgtttaccacagttccagatacagagttagtgctaaataaatagtagctactatttatcaacaacaataataagatgataatcactcacatttcccaaggctttggaggaaattaaatcaaatgatgcatacaaaataagcctttgaagtgaaaaacaccataatgttgttgaagatgggttttcttccttttagtaatatgtttgccatatctttgattttaaagaaatagtagtggttaaaaaaaaagcaagtagtagggccaccaaagatctggctacaataattgttctgagaggttaggctcctgctgagagttggagctaaacctagcacctatatgtagtagtacaaacctaaatatacagtacatcagggaacaacgtagacttcgaatgtacagatttaaaactagaactgcaataacctggtgacatactgaataaattggaagtaagtccattaaatcttgtctctagagttattattcccaataatcacaattttttaaaatgaccatcttgaaaatcatgtttcctggagtcacctccaaatagcagtaagctacccatctcctattacaaaaagaaaaatgagaccagcttgtaaacacattacccaataaagtaccttacagtgcaagcagggaggcattattgctcaatggaagtcaatttaaaataagaggttaccgagctttctcaataagagtaaaggatcccggccataattgttctgcagtaactttggaaaggtgtacttttattcaaaccgtgctatgattttggcttctctcctagggaggaactttcatttcagtaactaagttcatgaaaagccaaactctttgcagctcttcagctggcagcattttttccagtttctacaatctcatcactgtggtgtgtgtctgtttacttaacgattttaagcacaattcttcatgacccatttatttttggatactgttcttttattttgattgcatatctttcccatagggttacagcaagtttgaaggaaaatcaaacaataaaacactcactcaatatcataggggtatttgctttcaaaagtcaaacagaatgaaaatctatctggttggttattttagatgattagtgttaatttttgcacctgatgaccaaaaatcattttagaatttgatataaggaacttttgcacagacatcttacaacatggaatatctctaagtgttaagttttacataaacatgaacatctggaagaacttgagccaacttgggagctattattttacccagcctccttcatcaaacagagctcagaactcccctccgttagctttaagcttttctcaatgaactgagtaatggaatcttgagggacacctttaaatccagcagtagaagcaaaaaccttccccactgataagcaaaagaatatttctggcaacaaaacccatcaactataggcggtatatatctaactcagtcagccttgagttaaacgtgagtcagtaacccctgaaggcaacaacaaaggcttagagtgaaataaaaaagttcgcagacatactgcagaagatccagtctcagagaatgatctgcttaacacttggccctgagattatctgagaatttcctaaaacattcaacacctcacagtgaccacagttaaaaataatgtattataggtttcaaaattgctaaaagaatagattttttaatgttctcgctacaaaaaatgataagttggtgaggtgatagatatgttagtcagctcgactgactctttctacaacatacacatagatcaaaaacatcacgttgtactcggtaaatatgtacaactattatttgtcagttaaaaataaattaattaatttttaaaaaacttcaatacttccaagatctgggaacaactacgtggtaagcccattaatttataactgggactgtaaaccaacagaacgaattcttccacttaaaatcagcctttgattaatggcatacccatatattacgtctcctatatgagaacaacatataatgtatggtatttattatcacaaaatttctagaaataaaataagtccagttcagtaggtataatcctgttctaaatccccatatgtctataatgctgccacatatatcttcttaaaacactagtttcttcatatcacctactgtcattcttataaccccaactcttgataagatagtttccatccattgtccaaacttcatcatctgcctttcatttctcagtacactaagcttgcttctactgaaacgcactattctacaggtttctctctccattagattataagatatttaagaacagaaagactggcttttttacagctttccagtccctagtgcttcctagcactgttcctggaacatagttaccacaaagcaaacatctacttcatgtttcacattgatatataccccactaacgtccaacacgtgttatttaaacaaatactagtctctaaatacttgtacatctgctcaaaaattttataaaatatgctagatcatttctattgtgaaaaattagaagcaaactaaatattcatgaaatagaaatgaaaacaattctggtacatcctattaatatatttatatgcagacataaaaaaatcacattcttatggaatatttaactacgttggaaaaccatatgatatattaagtgaattaagcagcttccaaaactatgtgtatgctaaaatactaaaatgtattattcttagtggttaaaaacctaggctctggagcctgaatgcctggtttagaattccggctccattttataatggcattgtgaccctgaacaagttaatgcatcttgttattgcaccaattttcacatttttaaaatggtctaataacagtacttatattataaaattattttcaggcataaatggataatatttaacatataaggtaattgaaacatgggtatgtaccaagtgctagtaaatattagctatcattatatagttctcaataggaatgtctgtgccaaacaggtaacactggttattcctgaatagcaaaattataggcaactattacctttattgtgtttttctgtattctacttttggcagtgagtgtatattattttgtattataaaaaatcaggctgggtttggtggctcatgcctgtaatcccagcactttggaaggccaaggccagaggggtggttgagcccagaagttcaagaccagcctgagcaacgtagtgagaccttgtctctacaaataatttcttttttaaatcagccaggcgtggtggcacgcacctgtggtctgggagggcaaggctgcagtgagctgtgattaagccaatgcacttcagcctgggtggcagagtgagaccccgtctcaaaaaaaaaaaaaaaaaaaaaaaaaaaaccacaacagattcctcttaaaatatgcaaaatatttactgaacattacattggtaagatgcatacattgttaatggaacaatgctgggatactagatcgaagaagtattgtcatcacgagtagcaagctgcctgtaaaatagtagacattgctctctaaaaatgctgtatttcattagtgctatgggttgaatatttgtgtccctccaaaattcatatgtagaaacataatccccaatgccacagtattaagaggtagggttttaagaaggtgattaggtcatataagcggagccctcatgaatgggattagtgcccttataaaagaggccaagggaacttgtttgcccttccagtatgtgagggtaaaggaagaaggcaccatctgtgaagcagacagaaccctcaccagacaccaaatctgccaacattttgatcttggatttcctgggctgcagaaacagttctgcagcaataaatcttcgttgtttataaattacacagtctatgatatttttattatagcagcccaattgaactaagacaattaggagtaagaagtacgaagaattaccatcattatatatgatgaggttaaaaattatagaaaagatatttctacagaagaatttttaagtggtacaagtttaatacatatataaatatacaagtttagtatatattttatatattcaagtttaaaaactatatacatatatattaaaatttatcacataaaaatacctctctagaaatatcctttctataatttttaacctcatcatttattggaatttgttatggagggagatcgtcccctgctcccttaaagtttatagaaataggtcaatgccatctttcggggctctcccaagactattacaataaaacggggtgtagcaagataaataaaacacacttaggcaaggtgtgctaggatttccaaccactttaacttggcatgaggactattagtctaacagaatgagatactgagaacacatcatcagaagcacttaagcataaatgttctctttttatagtggtggggggaggataacgggagaaatgagtaaaaatgtggtttcagcttctagtttcactaggaacggacaaattagaaagtgaaatgtgagacaatagaaagtttgatgtaattcagcagcactgcaaccatcaattattattttaacatttttggtaaagcttccttttacatccaagaggaccaagtgaaatcaccatgttcttatatttacccatagcatttcttttttatttttatgagctccttcttttgctgaatgaataactatttcagcacactaaaaaattgtgccttagatgtctttctaacagtgcctgtatatggtaagtgctcaataattgcttgataaataatatgcattctgcagttgaggcaaaaaagaaatgacccttttttggaatgaaccaagagagacagaactgaaaaagtgaggaagaagggaaaaataatgaaggaacagaagatgatgtcagataggacttttatcaatgtaagtaaatataattcctatatattaatgaatgtgatatgttacattcatattaaaagtttattaacaaaacatcaccacaatgaatatagttgagattttccttgctatgtgataggtactggtctaagtgatttttatttgttaattttctcatctcagcaatcctatgaggtaggtgctattattaactctatttttcagatgaagaaactaaggaaaaaagagagtcagtgtataaaaaagacagtacaaaaaaagtgtataaaaagagagtcctacagtacagtactgagagaaaatgaaagagttggatttccaacccagaaagtttggctttgagtctgtccttttaaccaaaatattcttaaacatctgtctatattgtctccatttatatatacattaactgaatatttttttaatgtcccttgagttagagaaataatactattacctattcgacaggaagaaacatcagacagaaatgacgtggcctgatcactcagctattatattggcagcaaagcctttctctggcattacttaattcgtattctcacagtaacagcattctcctatccctaattctcagtgctttaggctatttcccaggaacatgctatatagctggaaagagatataagtacaatttgccagcattaataatagggatattgctccttgcatttgctacttctttctgtatctgtctacttttattttttttcttattccctaaacactctatctccattgtgctgattttttgaagatattcatctatcttgattttccttactttttattttctttttgccttggagtagtgtttccttttcttttcatcctggaatagattattgtcatttcaaggcctcccttgtgagtacttttttctcctttttattgccattcttcagcatttttactggtacttataacagttctccttttcttgctggcttctggcgtgggtttgttgctatttcttgttctttgatgtttcgcatatctgattgttccctttctcacccctgctttctgccacgtttacctctttgctattatttgtttcctattttgaaggttgacaactaaggggacagtatcattccttaatgtgtttctccagcttactcatgaaatcagcagcagcctccttcacacataaaaccagtccgggagggcaaagtgactcacgtctgtaatcccagcactccgagaggccgagatgggcggatcacttaaggccaggagtttgagaccaaagcaggcaacataaggagaccccatttctacaaaaatgagccagatgtggtggcgcaactgtagtcctagctactggggaagctgaggtgggaggatcgccggaatacaggagttccaggctgcagtgagttacgatggtgccactgaagcctgggagacagagcgagacccctgatatagtttgaatatttgtccctgccataatctcatattgaaatgtaatccccaatgtttgtttgtttgtttttgagacggaatttcactcttgtcacccaggctggagtgcagtggaacgatctcagctcactgcaacgtctgtctcccaagtagctgagattacaggcacctgccatcacgcccggttaagttattcccagtgttgaaggtggggcctggtgggaggtgatcggagcatgcgggtggatttctcacgagtggtttatcatcatcccattggtgctgtcttcagatggtgagtgtattctcatgagatacggttgcttaaaagtgtttgacacctcccactctctctctcatgttcctgccctggccacatgacatgcttgctcccccttcatttccaccatgattttgagcttcctgaggctttcccagaagccgagaagatgccagcattatgcttcctgtacagcctatggaactttgagccaattactcttttctttaaaaattacctcatcttgcgtatttctttatggcagtgtgagaattgactaatacagccccatcgctaaaaaaaaaaaaaaaaaaaaaaaaaaaatgtctaatcaaagttggaaagtgaacattagggaaatacatattttgtataaataaatcctttggactcccagcttcttcctttgccgatcagctttaagggacagtggttctgtttgacttttgaaaggacagaacaagatccttatatatcacatttctgctatcaatagttaagagtttttgctataaattgaaagtatcatggacacattctttagtcagcagtcactccctgtcattaattaggtgttggaatgatgttctgaaatgctgtttaatttctatgaatttcaagtgggattgcccagcaagtacattgccagcatatgtagtaagtaggtaattttcttttaagattatgaatgttattctcaaaattttaggttgtttttataagggacagtgtacagtttgggcttttgtgttaattggaggttgacaagggaaaaagggatagttttccagcatgctttctaggtttttctaaatagtacaaagatgttcaggaggaagaaaatattgctattttaaatggaatattttcaacgctaacttaagcatatctcagtatttaagcagacatttggatattttcctcatctcagacaataactactatgaccttgaacaaatccctccattttctgattctcagttttctcatctataaaatatgggaattggactaaataactttgtttccatttagctttagcactctatgacttttatccatttacttacacaacactactcctgagaaacatacatttatgcaattatagggataaacacccaggacttcatttaatagattttccttataccaccactgtactgtactggtaacagacactttcccctgtataagtaagctatcctgcagatgctaatggggtgaccccaaaaggccaacagaaattaaagaaacttggcaaaaataaacaaacaaaaaactagccgtggcatacagattaagtatatttacaccaagttatgatttttttagtgacttccccatttaaagttactgatatatacgtgtgtgtatatatatacaatatacaaaatcatcagtatattttcccctagataataattgttaagtataattcaataattgttacatgctgtatacattttaagtgatataaatctttccaacaaacctaaaatgtaagtagttcttttcctaatttccaaaattaagagaggcagagttaagcaacttgcctaaggtcacagtcattaaatagcagcactgagattcgaactcagcaaacagcctggctccagaacccatgcgtctgataactgcttcttataatatggttgtgttcatccattttcttgttcatctattgtgaggttgccagcgtgatttcttcaaaggcctgctggagtcaggaatatgtccctaggtcacagagctcagcaaattttagtagcctaaaacttgactcaattctcctgagcggtactctcagtgtgacctcgctactggtcaaaagttgtaaacgagcagttacatattttttgctgctctcaccaatacatgtcttgctatgtatggccaaacgggttgacttgtgcactcaaaatgcaaaaaagtactataaatatagagtagaaatggaaattggcgacataatatgacaatttaaaaatttaaaatatctgattttcacaagtcttaagagcctcagtgatattcagtatgattggagagtttgaattgtgtaaactttattaagagactagctagaaactcagcagagttttcatggattgcatgacactactttcattttctttgcagtcatcacacaagtaaaattttataggttcaacacactccacatacacctaattgctctctagggtagtaaaacaaccaagcagtgaatccacaaaaacagttcagtgagtttcatttaaaccatgcatacactaccaaaaagtgactcacagcagaggaaattaatttactcgccatgaaaacacaattcttaatgatcccaacactatgacagtacctaaaatttcttgtgtgtatatatttggacacacatgtccacacattttatagcaagaacataaacatttcaaactgaaatgcctaagcaacccttaaagatagcttttgtcaagctaaaatctggtgagaaaatgaaagttaaggcttttattttattttattttttgagatggagtttcactcttgttgcccaggctggagtgcaatggcacaatctccgctcactgcaacctccgcctcccagcttcaagcagttctcctgtctcagcctcccaagtagctgggattacaggcatgtgccaccatgctcggctaattttgcgtttttagtagagaaagggtttcaccatgttgatcaggctggtctggaactcctgacctcaggtgatccacccgccttggcctcccaaagtactgggattacaggcgtgagccgctgtgcccggcgaggcttttaaattggtgaaaatgccaaccattcaatttttactttgaataatcaaaactgaagtgattcaagtagtgattcatcatccagtgtaatctagcacagcaatggagattttgtgtgaaacataccaaaggaaaggtttggggtttttaattgcgtaattgactaattcttgggcacctccttccctcaatcaaagatacatcatctgaatagttcacagcctcccccgaataaatgaaagtgacaggctctgtatttcttaatttgacgcctttcaaagataaggttaatggaattaagtaaccataaagattattgtaaattaaatgttatatccttagatgtctgagttaatttaatgcatttcaataaatatgaggttaggaaacataaaaaggaaaatttatggtactaatttaaatggtacctttccacatctcttgtgcgtgctaaagcataggcttttatgtttgtcaactcacaaatattgttgcagggaagagatagaggtcccaagttgtcttaagaatatggagtcagatgttcagtatgattttaggaacagccatatgaaatgaaatagtcatagctatgaactattgttaaacatcaatagagggagggtacataaatagaagttaatcacaagtaaaataacctaacagtgattatttttattatcataatcatcaaggttagatttacagagcaaaacaaatgcttttctatgttggtttagtgagtattttcacagctatatgtattttagtttttctttaaatttttatatatattaactagaacataatacaaacttcactttggtactagaattacatttttaaaaccattaacgttataatttttacaaggagaaaggtaatgttttgtgatgattattatattattatcaatattggttatctcagaaactgtgcttaatacttttctcatggcaacttatgaagtctttattataatcattttatttataaggcaattgagtcttagaaaggttaaatagatagtataaggtcatccttctagaaaatgagtgacaaatttaaacttagatgatttctaagcttattcttttgactgtagcattatattatgttcctgtagttacagaataatataacacagtgtccaaaaactagaaatcattttattcccttatttagggtagagggctgataataaccttggcaataaaaaaacccaaaacctactgtcacagttcttactgttgatggttttaataaaagaaaaaatgtctttgaggttttccttttatgtggcatctggtatttgcctatatccatgatctatttacagcctctttgaaaattaaccgaatgatattaatagatagtttattttatatagcgttaactcctcctaactttgtacacatttctctgcataatttgaagaataagaacagaggaaatcaacaccgataatacagggaaaaaaatacagttttttttaaaccaagcaagaaaatgcaatctgatgccaaaacaaataaatatgaagaccagagaaaaatctgatatccaaagactggaatctaaagtaaatgatgaagatattagcaatctgttttctgttaaatggattcctctttgttacctttgcacacagcatacattcaaaatattagaaaaaaatcaagtttcaactgtggtttgctttattggcagtaatgtgaaggatcaagtactcaaataatttaagcaaattttagaaataagaggttgtctaatcaaaacacaacctagaaagacaaatattgcatgttctcacgcgtatgtgggagctaaaaaattgatctcatggaggtagaaagtggaatgattgttaccagaggctgggaagggtagtggggagggggtgatgaagaggggcttgtttaatgagtataaaaatacagttagctagtaggaataaaatctagtgttctgtaccacaatagggtgattatagttaacaataattaattgtttatttcaaattaactggaggagtagacttggaatgttcccaacacaaataaatgataaatgtttgaggtaatgaatattccaattatcctgatttgattattacagattgtatgcctgtatcaaaatatcacatgtatttcataaatatgtacaactcttacgtacccacaataattaaaaagaagaaagaaaaacaaaacatatcacaaaggatgacgtagcttgattgatgaattaatagtgtatgcaactaagatgattggagagtgtagaccttagtccatgaaaggaaaatcagagttttcacagagagcaaaagggtgattctatcttgtctttggatttctctccagccatagatgcacacgctcgctacctttgcataccttactccaccatctaaaaagtttccttttatttcaataccactggaaaacccaccatttccttcatcatagattaagaaagagtgggtttttctgaagttccaactaccattgttaatgctttcaatctattgtctattttccatgcttatgattgtgtcagcccatgtgtaactaactcttaccaagttgaaatacgttcactaaggttcttttttgcataagacctgtatagaatagctatatattgaggaattaatagaacagcaatattttttatataccaaccacgagtgagatactatactaggtgttattcatgtatttttgtaacttcacaataatcctccatgttagttatttcatatatgagaaaacatgggaaggctccttccaggctatcttgctaactataaccctagcatttctaaacacaaaatataagaaattcagtgtcttagcactggctattctttccttctggaaggttcttcctcagtttttacatgactggttcctctagacagtcatatctcagctgacatgcctcttcagcaaagattctctttactactgaagctggaataactacccaatcactcactatctcaactcagtttgttctcaatgcaacacttttatctgatatgtttcttgtttatttatcacaagagacataatttctttttcagaaatgtaggctctgtgggagcagggaaatatatataagatccaattacaactcaacaatagataagtcacttccatcattgaagatctgagtttcatcatctataaagtaagataatatttatcagatatggttatcatataatgtatttatataatactaaatatatatatatatacagtaatgtccagtagaaagtatgctgaacaattagtgttctgtaaacaaattttttaagtgcactattctgaaatataccggtctctcatccttctcattttattttttaaaatcattttattgagctataactcacacaccacaaaattcactcttttaaagtgcacaattcagtgatatatagtatattcacatagttatgcaactgtcaccactttcttttttcctttatttatttatttttttgagacagagtctcgctctgtcgccaggctggagtgcagcggcgcgatcttggctcactgcaacctccacctcctgggttcaagcaattctcctgcctcagtctcccgagcagctaggactacaggtgcgcactaccacacccagctcattttttttaaatatatattttcagtagagacgggatttcaccatattggccaggatggtcttgatctcctaacctcgtgatccacctgccttggcctcccaaagtgctgggattacaggtgtgagccactgcgcctggccaactgttaccactttctaatataaaacattttcgtcagcccaaaaaagaaaccccatactcattaggaatcactctcctttctccacgtccccaggccctactaatctactttctgtctgtattgattagactattctgaaaactttatgtaaatctcataatttaaaaaatttcataatttttaaatttttataagttgaaggtattaacaagttaataataaaatacttcttgagagctaactcagggttagctgctttatatttcttcatgctttagctcatataatcattataacagagaaggtagtttctattacaatctttctacagatgcaaatggaaaaactgaggcacacgagtttaagaaactcccagaactacacagttaaaaaatgtagaagtcaggattccaagtcgggcttttcagtcttcctgtgtttgccagctctcacctgagtattgtgttactagtagagggacgtgctcacagtcgcccctatgaggggtatttggatgcagataattaacatcatttcaatccacaaaaataggcttagtcctcaataagtaaggaatcaaggtgagggcactgcagagttagtattttgttgaagacaaattaataaatcttttttttttctttttgagacgagtcttgctctgtcacccaggctgcagtgcagtggctcaatctctgctcactgcaacctccgcctcccaggttcaagcgattctcctgcctcagcctcccgagtagctgggactacaggtgtgtgctactacacctggctaatttttttattttttagtagagacggggtttcaccgtgtcagccaggatggtctcgacatcctgaccttgtgatccacccgcctcagcctcccaaagtgctgggattacaggcgtgaaccaccgccgctggccaataaatcttaaaatattcttcctgctctcctttcttttgtctgttatttccctggatatctactgtgaaatactgtggtctcacatacaaaccaggaaaaatgagagggaggtgcattttatctcaaatacagaacttctaataaaacagagttattttaaatgtatagggggatcaaaatacataaacataaacacttgattatttgatttagcattacattcattgtattcattgcatgcattttattctgctggcaatcaaaattagttccagaagaaggtccggaatggcagttgacacattcccctgctcaatagccctgatatttataattatgatttgaatacattttactgggctagtaaatattaaagcaaatttttagaaatgatgaaaaaattaatttaagcattttttgtctctaaatttacaaacaacaaacatgcaattttctaagtagaataacacacaccagggagtaatgatatttgaaatgactgtgaattttggtctctggatgttcttggcttttggtcatatgattcactacaccttctaggcatgtaattatctcttaacacctcacatcctgtcatacagtatgccattccttaaatgagaattggtctcgagtatcattgtatatttagatcttaataattttaatagaaacatcaaccagtaatttctgaagggcaaaatatataaattttatcacttaaaatatatcttttctttaataaaatctagctcttaaaattctattcagacctagaatgatcctttaagatcatttaactcctataattaaattgcaaaatttgaaatatgttcaacttaaaattcaacctaaaactcaaagctgtattttaaagttcatgttgcacttgttttactgcatctgccagagaatgcaccacaaaatcctttatagatattcagatgaatctctctaccagaaatgaagaaggaacgctgctaatcttgggctttcattggtttgattaccatttcaactctaaatggctgcatgataattagtgggtgtggaataaccagtactgctcaagaagcaattgcctttactgaaaaacaaagtttcgaaagaagcacagtaaactccaagagacaatcaattcaatcttacacacctccctgccatagttttaaatggagcagatgtgctaaaagccagtgagaagacggttgatatttcttagggttcaaacagaaatagaatatccagcacttgactgcccatatttttcacaatgatttattgcagtaaatagtctacacgagcgtcccagttttggactttttccctatcagtcaggtttttaaagccttaaagtagagttaaattaaataaaagaagggatggcttttatctaaaagttagagaacgaacaagaatgttttctagatattaaagtaaattcatttataattatgccatattcagatggatgccattcctatatattaaatgttcatgattttaaaggtcattggacaaaaacactatgaataataaaaaattagaaaaaatgtgaaaaataatgaatggaattatagtagaatctattttaatggatctccatttaactgaatcattagattaaccaaagctctccattccctttgttagatttactatggatcaagatgacctgctgaaaaaccttaactagaaatctctctatgagagataaatcgtatgctttggcggattaaagatagctgcgaatttttttgacatttcttcactggggaggtaaagtctttgtttcctcccttgaatttgggtgggttctgtggctgctctaatagaatgcagtagaatagtggtccccagcctttttggcaccagagactggggtttgatggatgacaattttcccacagactggggttagtgggggggaggtgagggatagtgttaagataattggagactatttcatttatcatgcactttatttctattattattattacattgtattatataataaaataattatgtaactcaccatatcatagaatcagtgggagccctgagctttctttcctgcaactagacggtcccatctgggcatgacgggagacagtgacacatcatcagtcactagattgcctgatactcctcataaagagtatgcgacctagatctctcacatgtgcagttcacaatagggttgtgctcctgagactctaaagccattgctgatctgacaggaggcagggttcaggcagtaatgccagcaatgggaagtggctgtaaatacagatgaagcttcactggctcaccgctcgcctcctgctgtgcagctgggttcctcacaggccacagatgggtaccggtgtgtggcccaggggttggggacccctgcagtgaaagagctgctgttctagtttccagggttaggcctgaagataccagaaacttatattttccgtcttttgtatcattcactctagaaccctgagctcccatgtgataagttcaacaatcctgggtctaccatgctgaagaggccacatgtaggtactagagtcaatagatctagttgacccaagtctccctgtcgtctccaccaaagcaacatacatatgagtacagctgtcttggattctgctgaccagctcatctgccagctgagtatcatttagggatcaagttgataccacatagagtggaaaatcacccagttgacccacgctcaaatttatgacccacaaaatcatgagctataaaaagtgactggtgttttaagctattaagttttataataaattgttactcagcaatagataaccggaacatagcaagaatcaactgtgattgttcccattcctgctcatgtaatgatctaatataattatatactacataatttgatgatacatgactataaaataaagagatgcgttctttctaaaaaatacaaattatcagtaaaaattagctgaagaataaacaggcctttgggagagggatattagaaaagtattgaaggaatcccctcttaaattgttttgcaaatgtctctgtgttctttctctactgcacagaaacgaaaacgtacaagtctctaatctgtaccaccaaatcctcttgattttatgatctcttactactttcttccttataaaagtcagtcttttttttttttttttttttgagagggagtctcactctgttgcccaggctggagtgcagtggcgtgatctcggctcactgcaacctctgccttcagtttcaagggattctcctgcctcagcctcctgagtagctgggattacagatgtgcaccaccacgcccggctaatctttgtatgtttagtagagttggggtttcgccatactggccaggttggtctcgaactcctgacctcaagtgatccgcccgcctcggcctcccaaaaatgctgggattacaggtgggagccactgcgcctggccagtagtcacagtcttaattgctattccttgaacacactctcacctgagagccttttttccactcattcccttaacctggaacaatcttctctatctagttggcttcttgtctcgttctgatttaacctgctcagtgcaactcatcataacacattatttcatgctcttttccaggccctagtattcctgatttcccttgccctactacttttattttccttagcacttatatttcactaacacacaacataacttattaacctaccaaattactgtcctgattgtgggaaatcagagggcttttaccctgaagcaaaccacaacagagaaatagactattttgaagcaaaggtttaggagatcacatatagctgtgaacaaaatatcaacattttaaaactatataccagactattaagaagaactcaaggttttcaacaagggcagtgataaggagaggtcagcatgctttgctatgttatgctgccctctggcatggagttcaaataggccaagataaagccctgttcatgtatttttgaatggataaacaaagtccctctagatgagtacagcgtttgatttttaactacactatttcaggtaacccaaagcttttcttgtctgaaacatataagttatgacaggtctctggaacaagttatatctaaatgccagagtcaggtagtataaggcaaaaagtatacaatccatttttacttgtgtcaccaaacatctcttacattttagctgctgacttttcactaatgtattaatacagaatattatttctgcttttcttcaatttaactaaagaactgaatacttacatttagtatcaaatttctataatgtgtcttcttttaaaaatacaaaggtaattgaaaatatcaattaaatctgaatagtgactagattttatttagatatgagagatacataaatactatggatacaaatcatggtctctgccttcaggcagctgatggccctgtgaacttgtatgtgaagcctgtctggggtcaaattctagctctgccacttacttgtagtcttaggtaagttactcaattttttctgatctccaatttcattgcctataaaagagaattggtgtatatgccaatcatacctcaataaagcagtttaaaaaactgaagaatcaattatttctgaagaaaaaaaagaattggtaagaactcctttatagtgtgtgataattaaataacaaaaactagaacaaagtggcaggcatgggacatggtccatattcagagctaaaagttttctctcactatttttattttcctaaaatgaactagtatttctagaagatacaatgagaataaaaccaattgaaaatattttcttttaataacagtgctttaaaattagcaaaaaaattaaaatagaattttgaaaaaagtaatcaaatagatttgctgtactactgactgtatgttctttacatttgtatgttttgtttttatattttggtatttttaagtattattagtaggtgttcttaaacatttaggtaagatattgtatagttattagctttactattattattattattattattattattagatagagtctccctctgtcgcccaggatggagtgcagtggcccaatcttggctcactgcaacctctgcctcccaggttcaagtgattctcctgcctcagcctcccaggtagctgggattacagggacccaccaccaagactggctaatttttttttgtatttttagtagagaaggggtttcaccttgttggccaggctggtcttgaacccttcacctgaggtaatctgcctgccttggcctcccaaaatgctgggattacaagtgtgagccactgtacctggccagctttcctatttttctaatgagaaaatagtagcttgttgagagccacacacggagtttgtgatttttttttttcttcaggatacgttgcatttatattgtatatcagcgtgtattaaagtgtgtggaagccctctggagatttttacatgtggaatatactagttacttagtaattctctgtaggcaagcggctaagttcacgtatggaaaaccattaagacccattgctgtaacacagacaagggtattactgttaagtgtattgccattttatggtcattccaaacgagaaaagctgcttcattccaggaatcatattgctattataattcaccagaaaacctacactttcttttcctccaatagacagtcacttaaagcaaatgtacaaaaaaaatacaatggaatatggtttaggaattaatgaaaatttaaaaagcagcaatcccattgagaagacagaaggcaatacattttaaaaactgagcattatgcaagggaaaatttgagcagttttcaagttagttctgtattgttctcattaacaaatgtagatggtgcagcatttactacagacaattgattcagacttaaacttttgggctacaaatcatttatatttcagagaaaaaatatgtggtcaaaaacaactaggcagggggcgttggctcacgcctgtaatcccagaactttgggaggccgaggcaggcggatcacctaaggttgggagtttaagaccagcctgaccaacatggagaaaccccgtttctattaaaaatacaaagttagccgggcatggtagtgcattgcctataatcccagctacttgggaggctgaggcaggagaatcacttgaacccaggaggtggaggttgcggagagccgagatcgtgccattgcactccagcctgggcaacaagagtgaaactcggtctcaaaacaaacaaacaaacaaaacaaaacaaaactgtatttcccacaagagacattaaactatttttgtttttatttactaccttaatgttacgcaatttttcaaaagaaaatataatactgtagacgtaaaaaatttaaaacgtatgaaaactgggatatatcaattatcttaaagaagatattcctgaaacatacttaagatttaatattgaaatatataattgtttaaaaatacattaaatattgtttaaagaaattctgttaaaagctgtggggcacattatgaaggcaatactcacttctttacctttgttataaaattaattttgtccatcaatttttcatcaatcaaggtttatctatacacttgaaaattcaaatccacagggatcttgaaaagatagcatagatagtatctttctcttttaatagatgaaaaacaactgcagaaaggcacagacatcttcagtactaaataagtcatacgatacaatatgtctaattgatataaagaaaaggtaatcttgccatactgctccttctggctagtttatttctaaagctatatccaagaatcttgctaaaaatatcagctgtgttattttcattcaatctatttctttcaaacattctatttttcaaaattaggtttcatttgagcatcagtaactttagaagaaaaaataatacttaaaaaggccctggccaggcacggtggctcatgcctgtaatcccagcactttgggaggccgaggcaggcagatcatttgaggtcaggagatggagaccagcctgatcaacacagtgaaaccctgtctctactaaaaatacaaaaattagccaggcgtggtggtgggcgcctgtaatcccagctacttaggaggctgaggcaggagaattgcttgagcccaggaggcggaagttgcagtgagcagagactgcaccattgcactccagcctgggcagcaaaacgagcactaagaaaaaaattagtagtaatatgcaaagtcaggtctcagagctcctgtttcttctaaattaggtgtatctcctcagtctttgaatttagtctaaattggtttataaataataatcctgaatctttctagctccctgccacaaagatggatatttagatatactatggaatatttcactattcctgttttatttctagattaaaaatcaccaaaacaaggagacagaaattttatatcttccctgaccctaatttttccccttgaaatcttgctatcaattatactgacctttggttgtaggcatttctttatatttgtgtttttttgttgctttctacataaactctattcatggggtcttttgccaactcattatattatcctttcagaatatggtcaaaggcaagcccattttacaatccaattgtcatttctaagaggatattggaattactcatgtacagagtaaaaggttattttcctcacctcctacttagcaaaagaaagtgaaaacaatgacattcttatttttagtgatttaattacattttcttatccatgtgattttcttcatctaatttaacaaaattatcagagacatggtctgattacatatcatctttcttattccagaagtacaagacaaaactaaccttgatttctgcttataatcttacattctccccatggattcacacagctctaccctgatttgtggctaataacaacaattttaattttcctattcttttaatgaaagtaatattcctctcttcttctctgaaaaatgaatgcctttatgatttgggagggaaaaattctcctttggtgttttccttccccttcagttgacccacactattaataatcttcacaatatcaatcattgttgcagcttagacatagacaatgtttatgagcctttctctttttttttttttttagacagagtcttgctctgtcacccaggctggagtgcagtggctcaatctcagctcactgcaacctccgcctcccagattcaagcgattctcctgccttggcctcctgagtagctggaactacaggtgcccgccaccacacccagctaatttttgtatttttaatagagatggggtttcaccatgttggccaggctggtcttgaacccctgacctcaggtgatccacctgctttggcctcccaaagtgctgggattgcaggtttgaaccactgcacccagccagcatttcaaatccagatgctaccacaggaggctctgggccttaaagaaatgcagccagctagccgggcatggtggctcgtatctgtactcctagcattttggaaggccaaggtgggaagatcacttgaggcccagagtttgagaccagcctgggcaacacagggagatgccatctctacaaagaaaaaaaaaaaaattaaccaggcatgggctgaaacaggaggatcactttagcccaggagtttgaggcttcagtgagcagatcgcgccaccacgcttcagcccaagtgacagagcaagacctcatttctaaaaaataaataaatgaataagaaagaaatgcagccacttggaaccaatgctgtttttcagatctttgagcctctcagtaacattaattaagaaccctggtaaataaatatactaaccagtggcaagaataattgactgcaaatggctgaatgttttattattttcactttttttaaatagaagtttttgacaacataaaggccttacccaaaggaataacaataataatgaaaagagcaagcatccattgtgttcacaaaatcacagaatacatgtacatcaaatgaaaaataatcctttttcatctctgagaatactccaaaacttgtccatctgagtatcaatggaaaatcttgctctttattaaaaggaattcttcactaatgttcagaaaagctgaggaatgtacttacatcactaccgtcactactagagtatgcactggtggctaaaatgtcctaacaacttcttcagggctcaaatattttagggctttgaattcaaagatgtgtaaaatagagtctctgtcttcaaggactttataacttctatgcatatggtatgtgctagcgtggatgatggaagagttacatttaaccttcaccatggcaggaagatttattgggggagataaaactttgaagataagcaagagagccagattaaaaataaaacaaagtagaaggaggaaagaatgggtgtttcaagaaaaacaaatataatgtgctcttgctgatgggtaattctttgtgtattttcatactcctatttagtgtgtacctatttttctcacagtatatcgaaatacgctattatctgacttcctcgggtaagtctacaagaccaaatatacaataacaaatctattgagaagatacagttatttacatgcacagaaggttattgtgagaaactctatcaaatgcccttgctgatattggcctgacccacaattcaaacgtttgggtaccttcaagaaaatgtctgtattttttaatgtcctttgaaattattactctagtcatgcattatacgataaaagatacacgaaactgatgtccaatggaacagtaagctttgacagttcacattctttatagataataagatgtttaaattcatttccatgatgtattagtttcctgcggctgctgttaaaaagtactacaaactgggtagggtttgtagttgtttgtttgttttttaggagaaacatattgtctcccagttctggtggctagaagttcaaaatcaaagtattagcagggccatgctctcactgaatactctaggagagagtctgttccgtgcctctttcttagcttctggtattgccagcaatccttgccattctttggcttatagacacgtcactcgggatagcctctgtcatatgggattctccctgtgtgtcttctctgtatttcttctcttcttcttataaggacatcagccatgttagattaaaggcccaccccactccaatatgacatcatcttaactaattacatctgcaaagaccccatttgcaaacaaaaaccacatttttgaagttccagaaaagacatgaattttgagggtgcactatctaacccagtgcacgtgataacacaatcctcaatgaactgactgctgtcaatctctcagttttcaactccactactcaactactacatccaacttagcagacaaacaaatatatgtattgaatgagaaacagtccctagctggtaaaagtaaagtagggccaggagcggtggctcacgcctgtaatcccagcactttgggaggctgaggtgggtggatcacctgaggtcagggttggagaccacagccagggtaacatggcaaaaccccatctctactaaaaatacaaaaattagccaggcatggtggcacactcctgtaatcccagctaccctggaggctgaggcgggagaatcgcttaaacccaggaggtggaggttgcagtgagctgagatcgcaccattgcactccagcctgggagacaagagtgaaactccatctcaaaaaaagaaagtaaattagagagaagctaaagagtaaatcaggcaggattttctgggcagagaagtcatgcttggctataaagctatgaaagtacacagaaatcaaacatagctcatttagatcaggcataattattataataaaaagtcattatcttatggcctcacataatattattgcctatatatttctgtgttggtccttcataatacttggatttacatgcagaattgtatatttctgtatcatattttaagtgctctgtaatgcattaattatttgctagcctcatgtaggctgcagctctccagcctttaagttcagtcatatgccaacctgaagaacgtgagggattgagagagtgtcttaaatgagagaagcccatggtggccagcttcatcagaaacctagtgtggctctggttttcgccaggttctttgttccttgtgactcattctctgccttgcattgtctattcggtcccctcaggcctgtcctagctggaaagagctctctttacttcctgatcccatctgttccttgacctcccctctgacccaccactgggcatgctcagaataggaaattgtgccataatagataatcctgacactctgttccatttcttcatgttagttaattaccattcaaggtcttgaggcctacattaactgctcttaaatgtcaggtctatgtacctattgcctgttatggagcaggcctgttggtgaccaaagcagcataacctagcatctgttgctcagatatcatgtcccagcaccccaattaattgccctagccctagtctagccagtcttcagaactgaatcattatttatttggtctgtatgcaaaccaaaccccatttaaatcacattcatctacccaggactctcatttatcaatcaaactgacattttaaatgtcagatgagttatggtatatcctttgagtgatcatgataacattccctcatatttaggagataaactgtctgcatacatcaatatttttaaacaccgaagtaagtgtcaaaggtctgaaaattaatgatgaaatttatcacttcagtattctgcatgcttaaaagataggagtcacacctaccttccaataacctattataagagccaaaaatgatagctaacattcaaaactaggtatctatcatacaacaaatattttacaaatatgttctcatataatattcatatcactgttattttcccacttcatagacacgggcttagtgaaatttcataactttttcaacattacaatgaaaaatatctgagtttctttagtggctttgcctgttgcagacctcaattttttttttattatactttaaattctgggatacatgtgcagaacatgcaggtttgttacataggtatacacatgccatggtggcttgctgcacccatcaactcatcatctacattaggtatttctcctaatgctatccctcccatagcccctcacccaccaacaggccccagtgtgtgatgttctcctccctgtgtccatgtgttctcattgttcaactcccacttatgagtgagaacatgcggtgtttgttttcctgttcctgtgttagtctgatgagaatgatggtttccagcttcatccattttcctgcaaaggacacgaacacatcttttttaatgtctgtgtagtattccatggtgtatatgtgccacattttctttatccagtctatcactgatgggcatttgggttggttctaagtctttgctcttgggaatagtgctgcaataaacatacgtgtacatgtgtctttatagtagaatgatttataatcctttgagtatacacccagtaatgggattgctgggtcaaatggtatttctggttctagatccttgaggaattgcatacctcaatttttaaatacaatttaaaaatacaatcaattttttatctatatcacattcaggcctacctctaaagtatataatgacaatccccgatttacaatggttccacttacaattttttgactttgcaatggtatgaaatagtgcacattcagtagaaaccacacttcaagtatccatacaaccattctggttttcactttaagtacagtactgaataaaagatactcaacactttattataaaatagaatttgagttagataattttgcccaaatataggctaatctcagtgttctgagcatgattaaggtaggctagtctaagctatgatgtttggtagattaggtatattaaatgcattttccacttataatattttcaaattatggtgggtttattggaacataaccccactgtaagtcgagggatatcagcaacgcgtttaggaaaaatagaggcaaagtgtcctctagggtggactcagctaccagggccacagcctagtcagggacactgcctttatgtgaaggaaggctctacttcctcagggcagacacaatcccatgagtgtgtcttggatgcctttacaaagggctggatttcagtcctcacctgccttctcagccgagcatgcctgggcatgcaaaaatagcacaatggtacatggaacccttaaatacattccattaaaacaaatacataaatttggcagggcaaagttaagtttagaaatctattattcaaaagccagcaaggattctaaagtccttcagtgatcttagattgcgatcttttgaagaagacattaaatatgataccaatatctgacctcatttatcaagaggaaatgtgagtttctctcaaagggtgttgagtagatatcacgtgtttactatctctaacaaacagaactcatccagatgataatcttggtcttgcctgccggtgatgatctagtaaacttatagacacagcaattttttagcaaactttaagatagtataacaaaatttaaagacaaaactaaggatttttaaacctttaatcttatttaaattagaactctatcaatgaattaaatgtccaacctaggtgttaaaaattctctattactctaataatttctccccaaattttgtaacatattcgatattccagaactctttgcattgtaatagcattttgttgcatatgaaatacgtcacgtatctcattaaatactaaagcaaaacattaaaggaaaaattactgtcccaatcctacagatgaggaaattgagtctcagtatagttagatcatctttctaagggaaacacaagacttttgtctttatcaattagtcacatcatttatatcatttattgagcactgttctaagggtatcacaaatggcggctgctctttgaatcatcaacagtccaacaaggtgtaggtgctgttattttccccatgtttacagaagaggtagattgaggaacagagaggttaaataatgtgcccaaggtcaaatgctggtagagaataaaaccattttttatgtatgagtgcctatttcttacaaaactctttatatatattatgttcagtattttaggaaccagaaagggtgatattgttattcccattttattattgataaatctgaggttgagaaaggttaaacaacacaaccaaatttacgtgactaatgagtgacaaccaggaatcgagcccaccttttgctgtttctgaaacatgtattcttcccagaataacctttaatctctcaataacagctcatacaattcctccttcccatctcacaaaacctattctgagctctatgtctaccacgaataagcccaagagtagagagaatttatctcacaaggcttaccgtataccccttttcaataatttttatcacattatttctctttctcttccttagtcaacaacatttaatttactcctgaaactatccctacactaatctgaagttgttaaattactaagttattttgcattcatatttccaaaattaattgtccaagttcatctctcaaaatgaaataatttcagctagaaatgagctgtggcacagtaagcctttggatggggaaggtaattataattgttctgtaactctggttatggaacatgatctggacagtgagagttggatagagagggaagccactgggggtagtgtgactaagacactgttttagaatctgaggatatgagttcaagttccacagctaacacctgctagatttgtagtctgtaagttgtcaaatttcaaagaatcttatattcctcttggataagagataggtaataaaaactacctggcacagatggttttgtagaaaatccaataaaataactgtggaaactttgaaattttcaagtgccattaaaatatcaaataccaatttaataattagcttatgatcagatggttagggacgttgactgccgaagtgtatattcaaatcaatgcagtataggctttaaagtagggccaaagcatgaaatgcattttaataagtgtacacttctaggattctttgaaagttgaaaaaataattagtaagaaaatggagatgaagccctacactaggatgatagcacttagaaaaagataaaagtgaatagatgtgtcaaaagcagatttaatgggaattgacaaaaagggacgaatacttgaaactgactcaaagattttgagtctgagggattggaagagtcaggggactgctgttggaagagtgggagcaaatagaatcagaaaacacacgcacacaccaaaaataactggttttggatattttgagagccatagcccaaaagctaaaggctgttctatgttgaattatcaaagccactttctgatctctgtttttatgctgtttttttttttagcattttcaaatttttcctcacttaagattctgtaaaatttttattgcttatatgcttgtgtaagaaattcatatcatgtgattgtgctccaaaaatttttagtaggataatagcattttactgcttctgaaaatgacctgcaatattaggttattatttgttatattaggtctagaaacagcataaactattgactgaagtttgacattttaaaattctctaataaactggaggaaagtccacctctgctggaactctgcagtgcacagaaggcaaataatagactgctatcctgccatggcttcgcttaatacaaatttgtacaatatatacaatttaaaaatgaattcataacatttctattttctcataaaacattgtgatatgtcaggccagtaacaggtgtgaaaatgatggaatcaaatcctcacagaatacgtgtttagaacagacctcttcagtaaagacaacttttaaaaatacaggccgggcacgatggctcaagtctgtaatcccagcactttgcgaggccgaggcaggtggatcacccgagatcaggagttcgagaccagcctggccaacatggtgaaactccttcactactaaaaatacaaaattagccaggcatggtggcacacgactgtagtcccaggtacctgggaggctgaagcaggagaatcgctagaacccaggaggcggaggttgcagtgagccaagatcgtgccacggcactccagcctgggcaacagagtgagactccatctcaaaaatatatatgtgtgtatatatatatatatatatatatgtatatgtgtatatatctatatctatatatatctatatctatctctatctatctatctatctatctatctatctatctatctatataaagttttaggagaaatctgctcagaattgcattcctctcttactcatagtgataaggggacctcgtagctaaaaagtcttgtagaggaggttaaaagttcttcaaagtaaaaacattctcaactccagaaaacaacatgtaagtcaacccactcatgttttctaagccaatatcttagaaagttgttgtcgactcctcatgagcctctgctacccacagccaatctgttgctaaatgttgtgaattcttttttattgtattgtatgtcttaataacttttttcttcacttgccaaaataaaatccatatgctccccccaccctactgcatggttctccagtaaagactatagatattttttctgcttatttatatatattaaatagatttttaggcagtaatttgaaaatcactttgtctctttgaagttgcaaattgttatagaccaaggctggttcatgcccataaaggttgtttaattaatcgaatttgatatgacagagtattacacacaaaatagtggacggaatatgcacaaaacaagtttttcacaaaaggaagtgaaaagcttgtgccaaattcatctgtgtaacactagaaataaatattttaaaaatatatttattgcttagtttaaaaaactggccatttctgagctttaagctatcattggaagctttataatttaaggttttatttgcttgctaaatataattgagctgtttaattgtaatccttagccttggctccttagccaatgtagagcttaataaattcacctttagattatcaataataaacacacatggtaaaatctaatattgcaatagtccgtaaacttccgggcttactttctaaaagcagataagcagagttattgaagaagaatcgtgtgtctatatttcagaggcataaactcattttaggagtcattattactacactactttcacagcatacctttaatcaagtatcagaaataaagtagaacacatcagaaaataagtggtctgataaacaatttaccacacctgaaatgcagactttcatacgaaaaatgttctagcacaacagggtccacaggcaatcaacaatcctgttctcttccttctcctgggctgatctattagcatggctaatagatcattgcactctcctacagaggccagatgggacttctccacattttagttcaagaagatactaccaattaattagagttggcacttgaggttattatttgctttgctttacttactttctttctttttttttttttttgcatacagacttagacagctaaattaaaatcatattgaacatctccttcaatgtgatattaggacatttctagaagtgtttacttgaatctacagattttgagctataagggacttgagtttaggaatttagtttaaatttgactaatagcatacagttttctacctcagcctaataaactcactgactctaataacgaatttgaaaaacaacatgtccttagcatcctgacaaacccacagaactgctgctccttcctcctacatgtcagtttgggtttcagcattgcatgacaaaaatctcaattttctttatgtgttagaagttcataattggaagtgtgaataaaagttaggggaaaaatgacttaaacttcagcagcaggaaaagataatctttactgtctgtctagttttagagcatccaataaacaagaacatccatcaaaaaactctttggtggcttgaggaaatgtggggagtgcctgagtatcacgctatccttcttgtgaaatttttgataatacatgtctgtagtaagcatgattcacaactactaactaaacaatttataattccaacaatttcacctaaattacacaaaggtgtgtttagaatatacaggagaatagccagtatgaaaaaaaaatgtattcagagaaaagacaaataatacagctcaggaatgaaatgtttctcagctaagggacgacataggatcacaattcatctaggtgttttttccgcagttgctttcagtacatatttatacaaacagaataaaagaagtaccggaaccaaataagtagtaaacaaagggggaaagagatgattttgtaatttgcaatgctcatgcacagaaaataaaatgaaggtaataatagcacaaaaagaaaacaagggcatcaagtaagaagaggaagaaaaccaaaacacacaggacaagaagatggggcgttaaaacaagaaagctctagtggagcagtaactgagggtaaaggaagcgctcaagttttgatgtataggaagcaaagaaggtaactgaaagtgattaatgatgttgttttggcaacagaatagcagattaagggcagctttctgaactgattggaaaggatgctgaaggaaggaaaggtgctcagtgtgggaaatcggagatggcaggatacaggaataccaggtcaagagagatctcagtagtatattctaggttttaaaaatataatggagtgattgatatagtttgaatagtagtctaggtgttagaaagagacacagctcaacaatatcattatcaatcatcgctgagaaaaggcaaggagtaatttaacaggaatgataagcttacaggaaattaaaagtgaaataagatatatgagaagatgtgagaaagagattaacaggattattctttaaaacatggaagtaaatttgagaaacatttccctttccaaataataacccatactcctaaattaaaacttatggtgaaataatacagcataattttctacatacggatgaattcagtaaggagaaatacttaatttctaaaaattgaaagcgcaaagttattttgatttgtaaagttttcagatcattcctctattaaatatcagtgactttgcttactactttttcaggtattgtggggtatgtatccaaaaaagtgtgttacctgatttatgcatttatgtctattttttaaaacattgcttcttctataatttctcctcttttcagttcaaagaatggaatatagtacaaagaaccttgaacaaaaagtcatggctgggctttatttctgaatatacatacatacatatatatatatatattttttttcctcagtgtgtattcattgagtgaacctgaatgagcaatttaaactgtctaggctgccttttactagtctatcaaataaaagaattaatttctactcaaataaatctagaaggctattaatgggatattaacacatttaaaagtggtttaaagtagaaaaagcaccatcgatatgtatcactgatttgcttatccattccacaaattaagtacctactatggagcagatgctgtcttggttctgggacaacatctatgaatgacactgaaattgtccctgctctcctatcaggtattggtattattaaaaactgacgtatttctgagaagtcctgagaattctttctgtagtaggaaacaacgcttgaataatttctgctgaagaacatttaaaaacacagttatgaaagctggagagtaatccatattattgtccttgcttcagtttatttttctattattattttatgcattttaatgtaggtaaactaacttcgatttaggtctttctccttgcacaacttcagggaggactgttcatagaaaatataacttgaaaattgtgtccttgaatttatgcactaaatggtactgcttcaattcatattcttcaattcgactagtaattatttgaaagatttttaactttataatttgaaagaaattagacttatatgaaagttgtaaaaattgaatcacatattctaatgtatccttcacccagaatttttttttactttatcttaaatataatttctttttgtctgtattttagagtcaatttctactcagaagaacaagtatataatgaaaaactgttaaaatgtgtgtggcacagaaaaatgattttgagagtaaaatttgagcatggaaaagaagatgacttaattattatacttatattcaagcacaggggaccaaaacttttctcagcaatatcatgtctagtaagagcagaggaaaatatttaaaagcttggacttgggaacaaaatggcccagagtcacttcccatttaccacttatgaatggtgtggccttcagcatgctcattaaccattcagtgtcttaaattccttttgtgtaaagagagaatattatcatatatcatttaaaggctttataaagattaaatgagttaatatttataaagtgcttagaaaaaatgtctggcacacagtaagcaccattaatggcttgataaaagtaatttgacaggtaaaccaacagtactctttctattttgtaatgtcaaatcatggctacacttgaactctgagataaagagaaagattgggggcatggaagagtagcgtgtgtgcatgtgtgtgtgtgtttgtgtgtgtatatatttaggtgttaaaatattttatctaagtttccggaattctgcacaatgtagtgaaaataaattggtaaaatcacgtttatggctaatggcaaacatatatacaatgtggcaattactacttccaaaatactgttgaacaaaaaataactttatttactatatattttttaacatcagaaagaacgttgggatcctacaatcctgccaaatcttgattttgacctgtatggtactgggattgtagtgggctcaggtgttttgttgacctttgaattattagccatactctgaaagttgtttttgaaattgaatcctagaaaattcctgatatatagcttttttttttggaaacttgcattcagataatttgggtcttaaggtaaatttaaattaaccctatttagaaacgtcaaggaaattaaacatattaaagagatattggtgtcacatatacaaacttacatgagccttctttaggaagaagcaagcagataaatgaaaattagaaaaatattgaattgtggaaaacagaagtcaatgaggaaaaattagtaattaatccaatgtagtactctgagatcattgatgatgccttgagtgtggctgggagtctacctggattattgatggggagaaacttttgatgatcatggtgacaaaatcaaagagaaggcgtaaaggatacagttatattccctaagtaaaataattagttataggattgagaatttcaaataaaaagcaatatggaaaagcatttattatataaataatgtaactggcacagaacacagaaatgcatgaataccttttgaatttccaaataagatagattcctgtcaactctctagaagataggtttttttttttgcctctattgattctcttgcatgcacaaagtctttgaatatttgtttctcatcagatttaccttcaacagtattggggcctcccaattacatacatgcttttattacccaatgaacagaaaaaaaacaattactgttcatattatttcaactgaaatcaagcttgttaaaagctctctcacaattgttaattttgtacatttgcaaaaatcaatagctagaaaatttactagacacgaaggcctctgaaacaatacaaatgatctttatgccctagggctacgaatttattgataaggttaacaatccttgggtaatgacagcttacttctcttctgaatctagcctaaagattccattaaatatatttctaaacaacaaaaatgtctagatgagagtctaaactgatttcaagtgtttgcttcaaaggacaaaacaaagacagatgctcccttccagccaatgacttagacaatccatattaaagattgaagtcaatggtcatgatatactaggttgggcaatctggcttgaatgtgacattgactggtttaaattttgaattaatgttctctcaaaatatttcatccatcagttggtttatttacacttattatttaccaattactgacataggtgctaacacgcagcaaaaacttttaaaattatttttatttgtatttcctttttaattttaatagctttaggggtggaagtggttttttgttacacaaatgagttctatagtggtgaattctgagattttagtgcacctgtcacctgagtagggtatattgtacctaatgtgtccttttttttaatcgctagcccccctcctagaactcttgatgaattcagaatctagggagaaagtcagaaaagcaatcagtcaatacaacgtagtacagaggaaaatctctgaatagacttccatgtaaccaatgcctactcaggtaatttgccagattaacaaacaccctgcatttcctctgaaaagtacattggctaatgcccagggcaagatggatacttttaggtaatactcaactcattggtagacccatgaggttccgctctcacaagttgagtatgtacccaaaagctaacttagttaagccagttataattatttctagagttacataaagattatcaactgaaaaatgtaagctccatgaagacgagggctttgccgttcccaagtaactagactagatcctgcttaatatttattaagtcatacacttacaaaagtttttatttatgcaaaatctaaactgaatgttgtagaaataatcaataaatatggttgcaaaatgattcaaatgcttggacagacaaatgtaaaattttattaaaaataataaaaatctttagttctatgtgcagattgcttcacaaatatcttttatttctcattcagatataaagaaactgaaactggaaattatagattatgctagctatgagcaatagaactatgatccaagccacataggtaattttaatttgtctgatacccacattacaaataatgagaaatgggtaaaactaacatccatactgtattttacttaaccaaacagatcccaaatactatcatttcaagatgcaacgcatataaaattattattgagatctttcatattatttttacactaagtcttcaaagtccagtgtgtattttacatttatagtacctctcaattcatgctagctacattccaatggccatagatggcaagtggctaccatactgaacttcacagaagtagacaatatggatgtgatttctgtaagaaagagaaaaataatctcactctaatctgtgaatttctgtagtaggtatgaggtctaggtctatgtacattttgtttgtccgtggatgtcccattgatccagcaccatttgttgaaaacactactcttcctccactgaatttattttgaaactttgtcaaaaatatgttgggcatatttgtgtgggtatgtttctagactctttattctgttcaattgatctatgtgtcaatccttctgacaatataacacaatatttgttgctgtggttatgtggtaagttttaaaatcagatcttattgtataagcttaacaacatataatgttactgaaatgataacttccgcaatttggggaaaaaacagaccagatggattgaacactcctttaaactctctctctctctctcagctgtctaaatgcctcaaaatggaaattcaacagatgagagcttcttattgagaaaggggaagtagtaggggaatctattttgaccacctctctggtttgaaacctctgggggtttaagagaaaaggagattcaagatatggcttagttttaatgttaatgctacagtagtacagctgggacttgtcctacatttactgagaactctaatttacgaaaactagatcctagcattctgaaagcagatttgagacctctaaagctatttcttttacagttttttccacctttggttgcagtctattgtattgtcctgattctttttttcacctactcgtaggttattcttaatcacttgaaaccaaccacttctatgtatatgatttttgcttcctttccctcacagatccctcaggtaccctgtcttatacttttagtaagtcatgcaaaataattgagaaatgagtcatgcaatttattgctgcattttattaaattagagtggtcagatatacttttactgacagagatttggattttactgtcttgaaacagaagagagagcaaaatggttaagaaggtgatgagaaaatgaactgacatttatgtaacagtgccttattattaatatatggttggtgctgtgctttgtaccctttgagagatattttgtgatccaattttatagataggaaaaggatctctaaatattcagttttggaactgatgttctaaccaggtcatcctgacttgaaatttcaggtgattccctcatgatgcatcttgacgcaaacaaaaaatgtactgaatatattattataaatgtgagtaactagaaatgcatgggaaagaagaggggaggaaaagagtaaaaaggaatattaaacaaatgtattcaacaaacctttattgagtgtctattatatggctggctatgttctaggtactggaggtgtggtaacttgggaaaattttatcaacatatattacagtattttctgcataattccccgccatacttttatttcctttgaattcacagtttccattaaaataatttattgagttaaagcctagagcatagacaggcaacttttcaaagataccataataagtttttatttactcatttttgaaagaaggactagtcggatgctggccataaacaggggctaaaatttcatccatctttccatttccaccaatggaggtgtagagttggaatgaagttaagtgaccaagcctcttgagagaggtgaaggatatctcaggaataagcaactagcaatagacaaaggagaaaaatcgaaacagagagaaagaatggtttggtgctgtccattccccatccaccactgccaaacatacttatacaactctggccactcaaactacctaaatgagccaacttcgatgaaacaaacactattgggagagattacactcccgtggtagtatcaagtaagatcttatcctgcatttaacgcattaggaggaagtatttcaccagtagctaaaaacattattagtctaacattaactgtttctatcaaagggatttaattacatgacattaaatagtacatgcacttgtatacaaataatttttttctcaacaaacacagaaataataaaatagagaaaagactaggtgacagatcacatatattgagatacttgccataaggtgagactgatcaacatccttcttcaaggatataaaaatttaatttacttagagggggtttcagaaattactaattgaaagatcttacttaacaaattttttttacattagaaaaaatcagaacttggtaaatcctcttgtcactattagtaaaatcatgttaattagtccaaaactttattttaatacactatacttttcctatacttcagtcaataacttagtttgtggttttctataattcaatcactaagtttatttagagaaaaatatccttaacttggagtccagtggtctttgaatctcccaaaatatatgcaatattttatgtccatgtgtgtacatcatgagtatagattctgtgtttacatttgatttttaaaaagatgcatgtttaccctccaactaaaatcatgaatttattgttttaaatttaaaagttggctaaatggctatgatgtttatgtattttcatcaaaagggtagttgtttgtgttttatttccaagtctatgacttgatgtacaaaaacctttacactgtatcgtaccccaaaaacatactcagattcaaaagagagaggaattagaaaaataatgaaacatttcagtttaaagtgtcttctcagtggcagattcagtgtattcattacttttgcttcttctagagattaaagtgcataatctaatctcataaacagtagctaattcatactggcttaatagaagatcagttgggaataataagctcgatagaatgataacattattactggaattctcagaagaacttggcaatccaagcaagatggataagactaataaaatattacaaagaataaagaaaaagttaagatttatgatagtctatttatgtttctgttattatgtcatataataccataagctgaggtaattcatatagtctgttctacatttcaccaaatcacccttaataactaaacgataaagtgataaaattcaagacactgtgttggaaaataagagggcagagggaaaggagcttggatgataaataataattaactccaatttctaaggaccttaaaatctggttgtcaataaacatcaatacacataaaaattattgtatctatataagattggtaactacaaaaaaaaaaaaaaaaaaaagaatccccagaatccccagaccctgcagaattgggattgagggtagaatgacaagggtcctcacagctgacaatcatgggaacgacaaggagaacaaaagacatttcacacttctcaaagagattactacctgttttgaggatcacttgtcaggagtgcatcttctgtgactatgcagggtggtcaggtaaaaggaagttactacagtaaaggatggtgatgaggaatggtgagtttccaggtcactggaaactgaaagtctcctatgaactcgagaagccgcaaaaccaaggaagagaaagagtaattttataataaatgttgctgtggatttcttcatatctgttttaacacttttgagttatttaagtgtgtgactacttaattaatttttgttattgttgttttgaatgtggcatctacccaaaattggactgcattggtctctgtatttacaaggcttatatttgcatatattaacttaatgcaatacataacaaccagatgaacaatccagatataggggaaagtgattacaccttgtactgggatggacaaggaggacttaattaaggaatttagagaagctcagtcatgaaattagggtaaacttcaaacaagaaaaaaataaaaaaggatgggttgaaactagggtaggattgaaataagaaggaaatagatgaacattagagataatcacttaagtgaaaacataaaattgagaatgccttatcatgaaattcatgcatgaaattctgtcatgcctgttgatctgtttaaaaaataatagtagccacaaatattctcaaatgatcatgcatcgaatcttgtggaccccaagagtaatcatatccctaagggagctaaataacgtatgagtgtagatgtctattgcaatgcagtttttcaaaatgccattgacaatttgttgacttccttcaaggttggcttagctttctttctcagcctccaaaaggctatcaagtttcccatgtagttctttgagatgatcgatctatgttttgggaggagttgcaaaatatatgagatatagccaccttctgtatcagaaggattccctcttgggttatcagaacaatcaaagaagctatctgattactggaggagagactgacataaaattgtagtttttaacttcttgtgaaagttgtgagagcttgacactgcatgcaggagtaacttaagaacaatcttccctctgtggctttgaaatcaccccatgtgggataactacaaggcctgttattgttggaagagctaagcaatagtttaaagagaactagatttgttacaaaaatcaagatggctgcctaaaattcaacatactaggcctatttacgtatattatgcccaaggcacttggctggtaatacaggggctaaacaaagaaagaaaattagttcttgcctagggaaggaggaaaaggaataatttattgagtaccaattatacactatgccctttatatttatgtcatccaatgcacaaagctttattatgatttaggaaatattatactcactttacaggaaaaaagcaccatgaagtgaaaagaacattgactacagagtcagacacacctgagtttgaagtgtggcttagcctcttaatagttctaagaaaggaatttaacctcttcgaggccagttttctgattagtaaaacagggaagcatattaccttctattgtgaaggagcaaataccggctatgctgttttgcagttaacattcatatgaaaggtataagataataataagtaaaatgtattattttattaaatgtatatcatgttccagaccttattatatgctaagacttttccatatattatctcatttaatcttcatagcaaccaggtgaggaggggccaggaatttttccattattttacagttaaggaaactaaagctcagatttaaagaaacctgggtgcagtcaaatcaaaaaagattaagtggctgaaccggcatgagctatatcgtgctctcatctcagagagcctttcgcatagacatctgaggaggaacaaagggtaacaataacagctctttctctgaccctcctgattttcaagccagccccttccacatgcccacttcaacccttgccaagattcttgtgtatgagtaactctgttacctagtctagttttgcatgaatccctgttcctcttcaagcacttctttagcttcaggttttctaatctggaaacttctgtttctgaattagacctgaactaatttaggctgtcaaaaggtttgtgtcttgaaacttcccctgagtcggaacaataaatattgtgcataaatagaaactcagctgaaataaggagaagagttaatgtaaaaaaaaaaaaaaccaggtatacgtataattatattgtcaactaaaaaataaaatgaaataaaagcttcggcttcatacgtggattcagggattcacaagagagcaggtttgcagccacgaaaaagcaagcacagaagtgtgtgtgtgtgtgtgtgtgtgtgcgctcatgtgcacactcaagctgttgatggaacatagcatttgtgagtgaagggatgaaaattagaataggccaggcgcagtggctcacgcctgtaatcccagcactttgggaagccaaggcgggtggatcatttgacgtcaggagttcaagaccagccttgccaacatggtgaaaccccatctctactaaaaatacaaaaattagccggtcatggtggcgctccacttgtaatcccagctactcgggaggctgaggcaggacaattgcttgaatccagcaggcggaggttgcagtgagccgagatcatgccattgcactgcggcctgggctacaagagcaaaactgtgtctcaaaaaataaaataaaaagagaaagtgctcaaaagagaaactgtgtgaaggggacagtttagggcttggggaaaacaaaacaagaatgcgatctcacctagagaccaatttccacatgatcccacagggagctctggagggcaaattgcatcccagagctgatctcaccttgtggcaaatgggttggactcttgtactttcagtcgttggttgcaaactgacctgaggtggggcacatatggcctttcaggctcctggctttcttcagggtaagaacaagtctctggagaaggaagcagctgtgggcaacaagcactcccagcagctaggggatgggtgtgctacctggtgatggggacttcagtagaacatatcagtgcccactagagtcagagagaattgatttgggtcttaaagacagtatacaaacggaaattttattttattttgttttatttatttttttgagacagggtctcactctgtcactcaggctggagtgcagtggtgcaatctcggctcactgcaactgccgcctccctggttcaagtggttgtcctgcctcagcctccctagtagctgggattacaggtgcgcaccaccatgcccgactaattttttgtatttttagtagagacggggtttcaccatgttggccaggttggtctcgaactcctggcctcaaatgatccacccgcctcagactcccaaagtcctgggattacaggcgtgagccaccgcgcccgaccttattttattttattataataagaagacaacataagatctactctcttaacaaatgtttaagtatacaatacggtattgttaactacaggcacactgttgtgcaacagatatccagaacctactcattttttataactgaaacttgatatctgttgacaacgggaaatattttctttagtctcatgatattaaaaatgtatctgaatttatgatttttagataaagcactcatagagactattgggcaaaatacgaacagatgtattgatttctccaagggttccaaactggaattttaaaaaacttgagttaagattcatgcatatttagtaacaacctagtaacacggatgtatgccctcagagaatgggaatcagaatctaaagtattgtcactagagattgaaacaaagctttcaactccaattgttataaaagaaggaattagactattttgacataatccactgcaagggaaagtaagcagaaatatccagtgggatttggaggaaagctgtgtaaagggcgcttcttaaattggacaaaccctttcactctgctggagtccttcctgacacctggaaagaggctggaggtccagcagccattttagacaatgatgttacatcgaagaccgaaagttgcacagaaagatggaaggttcctgggtccttgaccaccatggccctgctctaccggcaatgtactgcttccagctggagctcactcatgtggcaaggcaacaaatctctcttacttaacacacttctatttctggatttctgatacacgcagccaaacccaatcctacctgatgcactcattttttaatactcaaaatgggaactatcttaccattatcactttttgttacacctcagattttcctgaaaaagtgcattgtcaaaacatatcattatttttaaaacaaagagtgtataaatgtattattaaatacattaaaaccagacaaaggctcataaattaatgcaaacgtgtggaatagtttcatcacacaagtgaaaattaaattggactgctctgccataataaagctctgtttgcctgctttgaaatgaaaagcatcatgcaacttttactgctgcgtttctttgaaaagtaccaaatctctcttctgagttgctcttgtctttttgagtataaggtatttattaccactgggataaaaacagaatgttgatggtcacatgatgcaggcagctgggatttcaactcaaggtcagtcactggaccctcaggcagccagatagtgttgtttattttttgccaaattgatgatgcctttagcctttaaataaggagcactgactatgattaaattttgtcctaaagagatatttcacactctaatacatagaatgtatctcattaaaattgtaacagagtaagaaaagcttacttcagagatctctcagaaaaaaattggagtacagcctgaagttatctaaaataatcagcatggaaccatgcagatttgaaatcagatgacaaacatgtactttcaaagcatgaacatttgaaaacagtaacttgcatcagtttctaaacgagggatttaatgtaactatcagaataatcagtgtgagatactgaaatataaaattgaatttgggtcttcagaattagaaacttaacagaaaaaggaggtcattgtagaaatgttacgaaataattttgtttttatgcctaatttagaaattgaatgggccgggtgcgatggctcaccactgtaatctcagcactttgggaggccgaggcgggcggatcacgaggtcaggagatcgagaccatcctggctaacgcagtgaaaccccgtttctactaaaaatacaaaaaaattagccgggcgtggtggcgggcgcctgtagtcccagctactcgggagcctgaggcaggagaatggcgtgaacctgggaggcggagcttgcagtgagccgagatcgcgccactgcactctagcctgggtgacagagcgagactccgtctcaaaaaaaaaaaaagaaagaaaagaaattgaatgaaagttcattgataatgcagagattctaaaataaatgtagccaaaaataaagccaatcagcataccaaaactattacaatcttagaaatccattatgatttttaaaaagtgctttttttttttttttcctctgagatggagtttcgctcttgtcgcccaggctggagggcaatggcacgatctcacctcaacctccgtctccagggttcaagcaattctcctgcctcagcttcctgagtagctgggattacaggtgtgcaccaccacgcctggctaattttgtatttttagtagagatggggtttcaccatgttggtcaggctggtctcaaactcctgatctgaagtgatctgcccaccttggcctcccaaagtgctgggattacaggcgtgagccactgagcccggccgaaaagtgctatattgctattccctactatttattattctgaaagagacatatcacatgtttaaacatttaaataacgaacaaacctcctgggatcatcatatttatcacgcactttttaaagaaaatcaaacatgcttctgtttatacaaatttattcccattctaaatatttattttacaaacagaatactttcttatattcttgggctacatgaatcattattatcaacagaagggtgtctgtcattacaggaagcacaatacttgtatacttttgagggttactcacacacacgcgcacacacacatgcacacacatacacacagagtttgggacctacaagactttataatcttattatgcctgctacccatttcatcttcttcttcactgtttgtcttgttgtatctctgttcgttgtggcctacccacccctgctcctctctgacagttttgggttgaacttacctggctctggttccaggagtgggtgtctgatggaacctgcccaatcagaacactgtactcctgaactaggttgattgattcaggaatgtgtaggtgatttcttcagagtcaattacaagtaatcctaggtcttctgttggagagaatggtgttttcattttctattggaattgaggtacaatgatataagtctaagactaataatgggtcccatatcgagagataatgtctaagagctttttttttttttttttttaagagcctttgaaaacacagtggagaaagggtgagagaggtactgggctaggtgacatcacttgagatcccaaaactaactgtatctgaagtaagtaatacctcttcactttttcgttacatgagcaaaggaaacttttttttttcttaaactggtttgctaggtttttgtaaattagcagaaatggtgcttacatacacacatatatgtatgtatgtatattttggttgagattaagaaatagagacctaggttctaatgatataactgactaaagataaaattaatccaattattgaaagtttcagcacctcagttgcctctttaaacaatgagttagttagattacatgactgacagttgtctagatctaaaatcattggatccaatcaattgattttcatgaatgaacaaagacatttaaatctggaagtaagttctattaaacctagtatcttgataaccccaggccagataaaactataaaaaaaaaatgactggtctctatatcagtcgatgggcaccattttatagttaatttatttcaggaacatggcagttataacacaggtaactataggacaagctggtaaacctcattgtaggtaatcactgagctcagggaggtagcatgatgtggtggataacagcaagggatagggaaggagaaagtttgactttcaaagtctaattctaactcagaattcttcatctgtaaaatgggaacaataatagctctctcacaggcttgtcctaagtatttactcacataatatacacaaagctcttattacagtacgtagcacaaagtaagtactcaaaatttgccatatgtcattattagctgcggagctattgcactgaccaagtgcttgaaaaaacaaatcatttcctttggcgtgagtgttaatgcacagaggctttgaaaaatactatgtgaaagtcattaaaaaaagaaaacctctcagcagattagcttccttcaacctttgtaagatcctgcttttgacggccaacccagtgctttccacactttctcacacattgcctgttatttctggtcaggaaaataaataaataagtgcccatctggccaagtatttttccacctttatatgaaccagaaataccaattgtttctaatgtgtattccccagatgcaatacttatcctctatttacagctaagccactgattactgtggaaaatattgtcagcaaaccataccccaaaatgtattgctgtgaaaggggaaaaaaatattacaaaacaaaaccctaaaccgaatcgataacagcactcatgtcttggatagatttacagaaagagaaggacgtcgctatttttatttgctaagagatgttgcctttttttatattaaaatatttaaagttacttctctgattgatctgtttcttttgagacataatcttgctctgttgcccaagttggaatgcaatggtgagatcatgactcactgtagccttgacctcctaggctccagtgatcctcctgcctcagcctcctgagtaggtgggactataggcgtgttgtcactatgcctggctcatttcttttcattttttttttgtagagatgaggtctcactctgttgtccagggtggtcttgaactcctgggctcaagggatcctctctctccttggcctcccaaagtactggcattataggcatgagccaccacacccagccactctgatttctgagtcttaatcaaagtagcaaacttataaagtagtgatttcatcacatgccaatattaacaaagaaaaaggaagagtagaaaaaaaactccataactgatactgtaaaatatttttctaatttgcataaagatatcagttctaccctagtatatttacaagatatgacaattcactaacatttacattttaattcatataaccagtttgtaagagaaggaatcctatcaaggaaaataagcctacagaaaactaactttttgtgataaaatgattttataaagctgacaataagcatttaaagaagtactagaacatgaacctttaacacatatccaatctactgttttagaaaaaattaagaatgagtttttctgcaaaaatgtatgcaacgcaaattctagtttaaagcggaatatcctgtaatctaataaatatggagatgattttttatagtgatgtaatgggctagattgtacctttagacttatgggaataaaaatattatttcctaatttcaaaactattttaaatcttttaaattctactaaattaaataagaaaataaaatttgagttagccactcaaacaggagatttgttattctgatttaaaaacaattgcctttggtaacaatcactctcaaacagttcgagaaaaatatatgtatgtatatattcatgggcaaggagaaggatttagaaaaggagaaaatttttctaagtttcggtgatcaattggaatgaaagtgtgaaattaccttcagcagtgttgtcaactaaactcagcactttctgtctcaacaggtgcacactcaagcccaccaactctcagctatttgtcaaagctaaggaaaaagatagccagtccccacacagctgcgcctctggctgccactacaaaagaatgaggctcggctatttttaggtttggggtaggcaatcagccaaatctcagcagcaccacaagagcatgtgctgagataactgagactttagagttgaaccaggactccaccagcctcccaacttcctgcctagacacccaaccctgtgttctcatttctgtggtcaccaagtcacctgtggctttcatcatgatccgcgaaatctacatttctgtgcttttcccagctcctctcctgttacaactttcatttcttatctctagaccttgaagccatgaaattttccttattagttcctttactcaacaaggaaaaaaaaaaacctcagaacactctgcagctgcttctataaagaaagcagtgtgggtttaatttgtttataatctgtccttcatttcattaagcctctaagtcatggccattgctaccactgtgcttaaaaacaagagaaaagtgaatgcttataaagagtggcaggtacaataactgatgtacaaagaaggaaaacacagattactgtgttttgatagttaaaagggagccagaatagggagctaaggagtctgatatcaatagcgtacattattttacctttgttgaatgctgatccagaaggttaatatgtctaagaatgtgcatttgtgaaatttccctatgtgctagcataatctcactaggtgttgcatgatttccatgaggaaagctgggttttagtggaataaattattctacattagatttttttgtcttctcataactgttttttatttgtaaacaaaagtacatgcacacatttacggtatcctcaggtattgctatcaaaacagtaataaaataacgcactattcttttttaatgatttttttttgttgtgaactgacatgagctttcatatacgaaatccgattttgaaatataaggcacatttattttgaaattaatagggaatctaggtcaaacaaagcaaagccaaaccttaattttacagaactgttctacctctacaaaaagtcactcaaaacaattgtttaaattgtgtgcaataattatcttgaaaatgcattttaacatgttcctataaatataattccatatgactaagatgaaaataataaataaaataatagtggaataaaattgatactttatttcctattttgattttatccccattattccagaacaaattcaatatggcagataaattgcaaggatttattttttctttctttttttttttttttttttttgagacagagtctcgctctgtcgcccaggctggagtgccatggcacgatcttggctcaccgcaacctccacctcctgggttcaagcgattctcctgcctcagcctcctgagtagctgggattacaggcatgcaccaccacgcccggctaatttttgtatttttactagagatggggtttcaccatgttggtcaggctggtctcgaactcctgacctcgtgatgctcccacctcggcctcccaaagtgctgggattacagatgtgagccaccgcgcccggcccagcaaggatttattttcagggagccagtattatgcagagatcagcctgctttagaaaatacagtgtctctcatgaatgagtgcaccatttgccaaaaataatctattgtatcttcttctcaggccaataattaaaaatgtattatactccaaagaaaaacgtaaataaaaaagacaatcctgtaaaattatatggttattgtatctctacaaaaacgtttttaatattgtaaaatatattatttacataaatatgtaaacattcaaattgaggagcaagttttagagtagggctcaaaatctcatatctgccacttattagttatatggccttgagaaagttacttaagcactgtgcttcggttttgttttttaatctctaaaatgggaagtattctttcctcatgatctggttctgaaaattaaatgaggcacaaatattcacactcccccagggttctctaatcctttccttgatagtgtattccctccgttagaaatctcgttctcttctttaacttcaactatcatctatctccatgtaagtgattctcaagtatttctctcttaagtctaactctttagttttagtcctcccccacaaaaacttttattatctacccacctggatagcccatcaacaattctaagttgatgtctcaaaacaaaaggcccttttccccttcccctccaattttgatcctattcctggtttctctacttctgttaatgttaccatcatctcaccagttcctcacggtgattagctattaacaattttaagaattccaacatatgcttcattaaacattagataaatgggcatttattgactgcatgttaaagaagttccatggtgaaatgagtttgggaaactaggttaaaagttaaacagctgtctttcctgcaggattccagagcatctttgcatatgcattacattgagaaactctaaggggatttagtatgtagtattcccctcagttttatgactaaagaagtcttttttgggggcgtggggccaaacagagggggcccataatgaataattactgtgccatagagcactcttgggggattaatatcagggagtctgctatcattattcccttttcctcatctcccacaatttagcaacaacttactaccaaataatttggttctccttgttgaatccctatctcattctgagctactgcttttgtaaatctggcctaggctacatgtaggctctcctttcactgccttttcttattctaacatctcaaactctcaattcaatatcttctgtagaatttgagatctattttctgtaagagatacaaagatgggtaagacatgatctctattgtcttgggatctgtgagagatgggaataggccagcagagttcaaatatatattcaataccataggcatagacataccacataaatgttgtgaaacaagaaatagcagtcaatgcttatatgggaaaggttacattaggtttttttaaggaagtgggacctggataatattagtccaggaacttctaaatgaaagatttaaaagtatttatctaccccaaagactatcttctcatcttaaactaaaaataagtttaaaatataattaatattttcacaataaaatgctcactggagaaactttgaaaaaaataaaaatgtaaatataagaatattgaagtaatccagcgtgtaatttcaccctagatacatctactgctaatgatgggtgaaattttattttggatatttgacttgtctacaagtcaacaattctaaagatttagcttccagagctaaagttttctaacaataatgccaattaaatgttttaaaaggttaattataaaagatatgatgattaaatttaaaatatcttgtcacctcctgttcacaacattttgcttttcatttccatatatcttaagtatacatctgaaagctatgtgagcgttgtaaattgtcaagttgaacttaacaaagtatagtttatgttggggaaaactcattaaaatgggatccatttcttaatttccaaaagaatcatctatatgaattgaacattgatttaatatcattgaatattcaatacccatatacacattagaatgtttttatgatttacattgcttacagcacagaatattcaccaatattattgctaagagtagagatatgactcaaaagtatcaatatttaatccagtaagtatgaagctctatgttaattgcaatcactattcataaacaatttgcccaacattgcctaaacatttcttgccattcaagggtttattttttgccttctgtgaattagagtatgatagtaaatggtaataaatgatcttaagtgatagtaaataagtaatttctataacagaataacttttgttctagagatatgtgcaaggcacaatatcactacactcaactgtatccaaagcaggccacagatccttaaagagaaaacttaggaatttactgtggcaacaggagaggaaaaaagcaaataaaaaggaaatgtacaaatgtaggtatgaggaggatgtccttttctaaaaaaaataaggtagtttagcatagttgcaatgtgtggtatatgagtggggcaaaaaatgaggtaggaaggacaaataaaggaccagtaacgaagagcttttgaaatttatttcaggtctgggagtgatgattttgacttaattccctggttttctctaatactgtttgttgttgttgttttctgcatatatagaaaattggtagattttatacatgtgcattacatatgtattggtagattttatacatacacatatatatgtataattacgtatatacatatacaattgttgaatcattaagttgcaataattaaatttattactctttatgatgctgtgggtattacagaagcattgtaaggtactacatggtcctcttataccatagattttttctaaacctacaactgtatagcgtgtggtatgatatgaaaatcactggctgagaactagctgggtcttagttttgtatctaactgtttctgagaactggagtctcactttccacatctatataatgaggaaatggaaaatattctccaggttttctgcagttgtgatgatctatgaccttgttattcactgtagggtgttaagctggtgaaacagcaaaactgcagaccaaataccagttttcctttaaccatctctctctctctctctctctctgtctctctcatcatctatctaacatctactattttaaaaaatcatcagtcttctcaatgcatatcttactttctccattttcccattcttccagccctttgctcttttcggacaccttttatttacccgtctacagttcttttgccctctggtactttgtggttaccagttgctattgtacttcccacaaaggatcaatttgcactacaatcatactgacagcagtcctcagtaactcaggggaaaaaaaacagactcttaagcagcagtggggatccaaagaccatttcccagggaaccagtcgggtcacaggaagagtgggaagagaacagcaaagccccaagttattttcctcttcccacatatttcactcagatgccaatttttgtttgctctcaaagctgttttatttgacagggctccttgttatgggctaaattgcccctttcccaaattcgtctgttgaagtcctaacccccattgtctcagaatgtgactgtagttggagatagggtctttaaagaggtatttaaggttaaatgaggtcactaaggtgagctctaatccaatctgattagtatccttataaaaagatgagattagaacacagacaggaacagaggaaagaccatgagaagacagatggagagggcagcctctgcaaactaaggagggaggcttcagaagaaatcagccctgattatacctagcctttactactgtggagaaaataaatttctgtttaagaaacccagtctactgtggtattttgttatggcaatgctagcaaaataatacattccttattcatttgtaatgttttatatttgaattcagatcattctcattctcccctttgtatatatatatagatatatatccttcttgctgctagaacaataacaaaaagatgattaactgtaagcatagtgttacaatgaactctgttgctcacatgcccttagatatgtatttgtttattcaaaaaaagcattaaccaaataactttatatattaagccttatgctcatctctaggtatgggggagaggtgggaaacatgatgataaaataacagtatccgtgtaacactgataaacatgccaagatatttgtattctcatattaaagtaaataaattgacaaaatatggtgaaagatattgtgcattttgatgaacttatgctatgagaacactttaaaaccatacctaacctccattggcggagtcaatggagattggtgagaggggttaggaaataatttttcctgagatgaagtggaaaccaggctttaattaattaagtgattggtaaggagaaggagggtaatttcaggaagacttatccctgacaacacgaaagcatggtagtttgggggcccgcacataggagcctttggctaaagggttaggagtaagagatgaggagaagggtaggagaggaggtagcagcaataagctgggtcctgataacatgaccttacatacatcacggagttggcattagtctctagcaggaaaaaatattttccaacttttaagttaaggctaattttaaacttgtcacctgtagtaatctctttaaatgaatgaaatttccctgtcttcatttatagtaatcagcatctttcactgcaaggaaatttctaagtgaatgtacattttactcaacttctaatttcctttaggaatctaaactcattcaatattttcacaaaatgataactgtaatcaaggcagagagctttatttcagctaacaaagaatagccctacacaaaggaattgcaaatattctaaataatgactgttataatttatcttctctgttgaaggatactacttcctgttctgtttgtagccatgataaacaaatggtatcatgatccttatagtccaggaaatggactgttttatgtagatgaaatattattattataaaatctgtctcacattccaaacccagcctaggacaggatttatgataactgccccccatctatgctggatatcacactatgatgacgtgtgtatttgtatttctgtgagctcaattcataactatgcaactctcctgaagcataaacttggctacatcaaaatggctaaatatttggtctaatgtttttctttaaacttaaattataagtttagattacataccttaacttacttaaacaattggctggacatttgaaaaaatattgatctttctttctttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggaccacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccagcctgatctttctttctatacatataagctttctgtccaatttataaaaggaagtagtactaatatataatatataatattatatatatatatataatatataatattatatattatataatatataatattatatatataatattatatatatatataatatataatattatatatatatataatatataatattatatatatatatataatatataatattatatatatatatatagtgtacacctatactgccctagtaagaaatcaggaagtcagtattgatgatttgctctctactatttttgtctctctcctcattacccgcgcaaataagttttactaattaaatatctaaatatcttttgtttgcattttgtctttttcattcctaatgccctaaggctcttatctgggatataactgcaaccctcttacacctgcttttagaacagtggctctaaacacaatctgcacttggtgtgcctgtatgttctgatttcattggtctgcaagagttttcacaaaccctgtgtcatctaacaaatagatctgaacctcctcctttaaaaattcaagatgcaaaaataaacacttcttgacaacacatagtttgctttcttagcttttttacttttacttttttttcgttttttttgagatagagtctcgctctgtcacctaggctggagtgcagtggcacgaacttggctcactgcaacctctgcctcctgggttcaacggattcttctgcctcagcctcccaagcagctgggattacacgtgtgcaccaccacgtccagctaatgtttgtctttttagtagagacggggttacaccatgttggccaggctggtctcgaactcctggcctcaagtgatcttcccgccttggcctcccaaagtgttgggattacttgcatgagccaccatgcctggcctgctttatggttttattttgctcactgtctaagctagtactaggtgaggagtagatgctagaaacccattgtaatatgttgctcagagccagccatttctctttccaccattcatacccaaacccaaaccaaacaagaataatgtgagagatcagccatgctaggacctatcaattcagtcatcgttaagcaacaatcactagagacttagtacatgtgatatgtaacagcagtcactgtgtaaataaactcaccgcctattgtgagaaacagacctgtaaacagtggataaaggacaagaattgcatgcagttaaagaaaaacaggcaaaataccctgggaattcagaggaaggaatgccaaatcacccagttcacctacatctaaagaaggctttttttcttgttcatcaaaatactcgtgttggaactagcatgaagagtgtcacttcaccttctttggccttttttacccttttgtgtaaaagaagattcttgatcttcaaagcataacagtcatgttttattttactctatgagcagattcattaagaatgtgaaagtattcccattcattcaaattaacattaaaagacactctcccaatgaataagatgtcaaaaatcatgttagtaattgcagtcaatgaaatgaatgctctgctctcatgctgcatgcctatttgtactcatcgactgagcactaacgagaaatacacacctaacttagaacagcagaaggagcagatgctttaagataatatttctcagtaatatgcaacaatttaatttcaaatactgaacttctgggccttggaaattacatatacaggttttgcagtcaaatgagtattgtttagacatattaaatgtgctgagatctaaaatttcatcagttttcaaatttaagccagaggggaaatataccctaatggttcaaaaaccctcaatttaaattctggtttatatagcaatgatcttggttactttaaatttatttctaagccatgatttttttcttttagtggcaaatattacaataataaattcaagggaatgttaaaatcatacccaccaacaaaaagtaattcatacctctgaagttagctattttagttggacaatactcttaccttgcgacttatgctattagattcctgtgttcatctttttatagcacacaaatacacaggtgttcactcacacagatgcattcacgtacacactatgaaacttgagttttacaggaaaaaaatttctaaaatgtgtccaaataaattctaactgtaaaatttcttctctcggctgggtgtggtggctcacacctataaacccagcactttgggaggctgaggtgggcagatcacctgaggtcagaagttcaagaccagcctggccaacatggcaaaaccccgtctctactaaaaatataaaaattaggcgggcatggtgggacccgcctgtaatcccagttactcaggaggctgagacaggagaatcgcttgaactcaggaggtgaaggttgcagtgagccgagatcacacaactgcattccagcctgggcaacagagcgagactctgtctcaaaaaaaagaaaacatttcttctctcttatgtacaaatttctcactccatttttctccaatgggaatttaaatttggaaccactctgaagctaatgtaatcataccagatacataaatatttcaatatgtatagcaattgattttgttacagtctttgataaaagagatacagtgtatagacacaattttaatggtttcctgcaattggaaagatacttggtatattcatcaattagtatcctttttatacttctattagaaaggctatgtttttgtttaagtacccaagattccaaaagtgaatttgtatctatgaatacagtttaatgtgaacaattgaaacgcgcatgcaaaactcaaatgaattgtatacctggcaggcaggatgaattgatagcatgttatttttagaaatctgagtgtatgtatgcataattctagtttttgaagttatctgagagtctttccatatcatattatacccaaaaaattaagtgtcatcatctaatggtttgaaacaaaagaaatttataagtaacttataattctttccatcacttttggatattaattaattcaaaacacatttataaaacttcttcctagtacaaggaaatattcaaaactctatgagaatataaacacatagaagatgtggtttgcggcatccaggagtatataatctagtagcggagataatataatttttaaagttatatttcaaataatatagactcagttacctcatctgacaagtgagaatggtaatatattttttgccatagtttttataaaaccaattatatgtatattatctttattgtctttattatcattatcattcactataaaagataatgaatatatgcaaattaatttttcagtggtagaacttgatttctagatgtcatgaattagaactctactcttttccatttctcaatcagagtctatattttcaactttcaaaattgcacaccacatttctacaatgtgagccccaggcagaagaatgcttataagctttcatctaggcacaatatattatataaggcctggatggttttctggctggtcaattctctgcttttggcatacggagatcaaaattgggttatatgatctaatttagttgaagataatacaataatatacactttcattaagaaaaaatttaattatggaactatcatcataaaaattgtcatagataagaacaaagatactatatcgcatcttttctttggttgaaattttataagtcaaaatagattgtcatgtcacatacaagcctctttaacaaatctcctcaaagataaaatattaaagaaaaagttactatggtcttattagtttacagaaacttaattttattataaaagcaggtcagagggcctactacttcagtaaattaatgatatcactcaagctaagttttctcataaaatgcctgtgcataccagatctgtggatttctgtaatactttggaaattgaaagggttcaagacaccagtttttaaaaattcattattacatgaataatatgttaacgtaatatacaaaatatagttcatattcactggtcaataaaatattacaaacatttaagtgcaaaaataataaatatgaataggttgttagactggctctgtagatcctatttttgttttcagagtccattcaattccatgtatttgagtcatgcaataaacatttctcaccttgaatttgggcatacttgtatggggctccatgcttgtgcacacatatttatccagacactaagtttccttttataaatgagctcaatcccagattaaaacagatgaaagatttccaatcattgtggccagctcccagggtggaaaataagcttaggaatgcagcaaactgaaactgaatactctctggaatggacattccgttctaagtctccttcaggaaacctccaacaatagctcaagcaggagcaaacacttgtctttgaggtagtccaagccaaccattcactttctcagtaatctgtcctcagacacccactggacttagagctcctgtgcccacctcaaaggacagcagccctggcatgcatgcactataggagcagaagtgattctccaaatttctactctgctcacctctccaccactttgcatcaatttggcatctcctaagatatctcagctttgtaactcctcaaaggaatccccacaaattggggctcttttttaacttggacatttcctttgagactaagaaagaaagagaaaacaaagtacacagataaccaaaaacacgacagattatatgaatcatccaaattaagcaaccaacattttagtctaagatttataatttttacaatatattgagtacactggacaaaaaagtatctacttaggattatcccatcctgttctattttgtgtgtgtgtgtgtgtgtgtgtgtgtgtgtgtgtacaaaataatgcatgccagtattcataaggcttttccaatctgaatgatgcctgagtttcaaatatgtatacagtgatgtaatggctaaacaatagtcagataaatgctgtgtagtcattcatttgtgtacctacaagctgttaggcacaattaatccacatataataagcacaggctatctcctcaaggagcaagagagtgagtcagaagccgagaagcaaactgacagctaaaataggggatataattgcttgtctagaattatccatagtgagtttacaataagaatacatattggggccccattttctgacctagggtagtaaggaattcttttaaacaatattctataaggaaagataaaaataatattaatagtcattggtggaagagacatggtgatagtggtttttgggagaacattccaagaagtgggaacaagtcatagacacaaaattacatgaaccaaagttattttatttgctgaaccaaagtaattttatatctagacagaagtgttcctggtggggaacagcagatcaggaggtgagagacatgagcagatgccatactgtgaaagaccttgtacgttaggaccttggattttaccctgaagctagaagattctctaaaggacgttaagctggaggcacacaatcttatttgttttagaaactcaacgggggcagcaattacaaggtgggattttctgaagaccagattgaaagcaaggagatcattcacacacgcacaaacataaaatcagaggtagtcttttgatctatgtatctgtttatacaagttggtatccaaatgtacatttatcttttagagttatatacattagttatttgtgattaacaataatagttaaaataatacaaagaaaaattattctcaacactttgaccctcaccaagaaactttatatatcccccttttaaagccaacaataagtaagcttgtgaaggggcattatttttcctaatttcctcttgaggacagtagtagacatgctcagctcagtgccagaaatatggtaggctctcaattaatactagttaaataaatattggcttgtccaggattacttgcctttgtaggtagaggcaagtttaaaacccaggtagtctcaggcattgtcaagttaccatgcccgtggaccagcataacttctagcgcttgtcatatagggtttttggtcataaacaacctgaaacacaacaccttacaaagtaggacatatagaatacggcctccatcatcatgatattttattcaatcagtgatgcacgttcccatataatagaaatggattgcattctagcagattagcattaaaccatcctttgtaccttgagtgatagacttattaatttacaagacttatcctcgattaggtttggtgatgataccctagccttcagaaaaccaagagcttattaaaggtctaatgctgtatttttcaaatttttattttgcaatcattatagactcacaggaagtcgcaaagaaatatgcaacaatgtcttgtgcaaacttcactttacctctcccaatgttgataccatgtataactatagtacaatataaaaactgggaaattattgctataattcatagagcttattcgggctttaccagatagacaagtatgcacttgtgtgactctggtgtgtgtgtgtgtgtgtttgtgtgtgaagctctattcgacattatcaagtgtagctttgtgtaacaaacaccacaatcaaaatattgagcaggtccatcaccacaaggctccattgtggcaccattatatagcataccctctgccttattcctgacctctggcaaccaatatctgttcttaatatcaatatctgttcttaatatctataattatatttcagtaatgttatatacaagaaataacacagtatttaacctttgacttttttttgctcaatatggtgctcttgacatccattggagttgtgaatattgagtatcagtagttcattcctttaaattgttgtgtagtatttagtggtatgagtatataacagtttgtttaacagtcactcattgatggatacttgagctgtttcttgtttctagctactgcattcatgtcaaggtttttgggtgaacataaacatcaattttctgggataaatatcaagagtacaattgctgggctgtatggtgactgcatgtttaattttagaagaaactcctaaactgttttctagaatggttgtaccattttacattcccatcagcaatattagaaagacccagttcctttgcatccctgttagctttcagtgttgtcactgtttttctttttttaattttagccattctgataggtgtatagtgataactcattgtagtgttaatttgcatttctttaatggctagtgaagctgaacatctttttatgcatttctttaccatctgtatatcctcttcagtgaaatgtctattaaggcttttcccacatttttttccactagattatttgtggttttagtgctcagttttgagtgatatttatatattctagatactagttctttgagactttacaaagatagattaaggaaagaaaaaggacatgggttaaaaacagtaaaaaacaaaatcaagaaccacaagtgaaaagcagtatgggaaatcaaaaaagggaacagcacccaatgacaaaaagcaaatctttattatatatttatatatgaagctttaaccaaaatgaaagtgctttgtcatataaaattttcataaaatgcaatcaaaatatcattattataacatattatatgtaaacatctgtaattatgttcattaaagcattacacatcaagtaacttatttaaaaatatatatggggaaacctaatgtgtttggttccaggtaataaagtggtgagcaagaacagttgaggtgtcttggttcatagaacttaccacataatccgactggcaagtattaattagtcacgtacatacatatggaatcataacagtgctatgtgttatgaacagatgttacgtggtagaggaatttgatgtacttaggggattttgatgtctatccagaggtaagcttgtaggtggaaaatggtgtcatcaaggtaaaaaaggggaaacggggaggttctagacaaatagaaaagcatacacaaaagtactgtagataaaaaaaaaaagctatacctagtcagggaacaaaaagaaagccagtaagggggcgaggcaaaggaaacatgatgggaaatgagataggagaggtaggcagtgtctagactttgatttttaaatgtgttttgttttgttttgtttggctttcctagcaaccaagagaaactactaacatgatttaacaagtggtggtatcttcgaatttaattggctgcatgaagtttagagagtggattatcaagaatacgaaagagaatgcagagaaactggaaaggaaaggctgctgtattcctagtgagagaaaatatattgcgctaggatgatggtagaggagataaagagaagtggatgaaaatatattagaggataaaacccacagtgactggcaatgacttagaaataactgggtaaaaaagatcagagtttcaaggatgagatatgtttctggcttgtgaaactgggtgaatggttgcaccattcaatgataagaaaaacaatgagaaggaagcaggttttgtgcggtgaagagaaagttctgtttagggcatttagagggaggtgactatcacataagaatggagatgccacccaggcagttgaaatcacagttctggaattcattggagaaatctaagctagaggtataacttggttagttatctgtatataagtgttaataaagctgtggacataagtgcaatgatcgaggaagagatcattatgagaagagaattatgctaggactagatcccaaggaaacctaatttttaaaggctgagaagagaggatcagcctgcaatgcagactgaatacaaacaccctccaaagtagtagtgaagccatgagaggacagtgcacagatcttaaagacgacaacatttttaagaagggagaaaatggtcactattgaccttctgcaagttcaagaaagacgaagaaatttcattaattggttctagagacatgaagtcctctacttcacttgaacttagcagggtgaagcttgaatagaaaaataatgaaagcatgcaattaaaagaaaagagaatctcaatatcttgtccaactgatgcatataagagatagaaagaagataatactttgctttatttttgtatttttaccataacagaatttataatctaattttcttaaacaaattatcaaaaaagaaaccaacaaagttactgctaatgttgaatattaaagtactattattaatagcttcttaattaagaaataaataattatatgtttgttacaattgggaatgacatttgaatataataagttgtttttttttcccaaccgtgttgtagtgttctttacacttttcaaatggaaaaatgtattcagtgttgtattatttatcatgttactgatcttatcagtaaagccaaaaactttcatacgtaaaccacttaatttccaagtaatgtgtatgtatgtgtgcctctgtgtatgtatgatagacagaaagacaaaaagagaagatctatgcacactagtaatattgaaagaaatgagctaatttacttcattcatcacactgtcataaagactttcttttttcctagaaaagtggtatctcatacaacctcatctaatctcatacactagaaaaatggatcagcattgattaaaataaaataaattctaacaatttcttatttttatataatcacacatcttagtgtcattatagcagtaagttataaaaacaatgtatatttgtatatttaatattaaagagtagtgctacaaattaacctactgggtctccgaaatatatttctgaattaaggcttatttctatagcttatccaaagatcaataaccttacagttaagaagatgcattttaaataaatgttaaaatttatattatcctgatagttttatatactagttagttactggacaatactaaacaattgataccatggaaacgcacatgataatcaatagacttttttttttttttttttttttttgagacagagtctcactctttcacccaggctggagtacagtggcgagatctccgctcactgcaacttccacctcccgggctcaagtgattctcctgccacagcctcctgagtagctgggattacaggtgcacgccaccacgtctggctaatttttgtattttagtagagatgtggtttcaccatgttggccaggctggtctggaattcctgacctcaggtgatctgcccgccttggcctcccaaagtgttgggattacaggcatgagccaccgcgaccagccaataaccaataggcttttaatttgaaataaattattggggagtatttctgacttccctttgcctcccaccctcatttatacatcttgaataattctgttccatcacgatctctgacattatttttaaatatgtagatatgtgtgcattcattacctctttatgagatgagagaataaaattgcttgtgaagtcagagaaactcagtattatttctaatcatatatatgagaatgccaatgttgacgttatcgtacagagtgcacattgcttaactccaggggtgtcatttacctcatagcataatattaatagtccacgttactggtacactctagaattgtacagtgtacactatatgaatgtatgcaactaaatatcacactgtggatgactaacataatgaagataagagaaaaattagtttatgtaaaaaggcaacagtaattatagtaacttaaataacctactgtttatgccaagtactattcagaatagtatggcacgttaatctatgtaaaccatttttttacaatactaaatcatgttcaggttagcccagttcttagctttttgttcatgtagcacagttgcctgtacataactgaaataaactctaaaagaacaactagtgagaccactctaaggatggctaactgtagatgattacaaacaaaccagggctgcattagttttatttttgatctttttcatcttcacaaagtaagaagagtgagatagtaataaaattgtgaaacaagataactgttatggatattatcatagacagctccctatgcaagtctagagaatgggcatgagttatttaggatatctcagtttttatctaagaaaatataatatgccaatgtctataggctttgagtaaacaacccaaaattttaatgggttttatttttaaagagcatcctcaatgggacatgtctagttcttgttagaagatactatgattcctgccattttatattttgttctatcctttttagaattctattaaaatctgagagatcgtgacaactgactggttaagaatctttaatcctactgtcatgctgccaccattaaaatcctgactctaccacgtaccagctgagctaccttaagcaaattacttaatctccctgtacctctacatattcatctggtaaatttagatgattatgtttccccaccttctagagttaatatggaacttatcacatatgtatgtgatgtaatcagagaagtgcctgacacttattacaggcttgttaaatggtaaatacagtattatcattgaagattaggtgaatctagaatagtgctatgcacacacaaggtactgtcaatagctgtgtatgtaagacagatcaatgtttcattaatcctttttgcctcactgcttcttgcaatcattctctaattcacatctctgtatgtccatactcttatgcctatttataaaaatggattcttcaatgagaatgtccataatcacactattcataagtaatcatttatgattgatttgtaccatgctttataactttcttgatattttatagtagttgtacgcatatacatatgtgtgtgtatctgttctctgacttagagttgctgtctcataaaaagcaaagagaacataggtgttcaacaatgttgagttataagcaattaaaaacctaatgttaaaaaaagttgctcaatatcatattactattctatcgagtcttacttcctccaaagctaactgataagtacattacattcatccatgattagattgaattactcaaatgccttctatctctttattgtgattctggctttatttaaactgaaatgtcaatgttttctaggtatttttaccatttttgcagatattgggataatcactttcactaacggtcctccagaatttttagacatttctccaataagcatctatattaactaaactagcattaaataaagtgcaaacttaccttgtcataactatgcaattctgtattctctaaaggatgatttttcatattactcaacaattctgactgagcaattgaaattgagactatgataaatgttttacactgaaggctcatttcattatacagtagtcagttgaaatggggtttccgaagaaggtatttttaggaagtgcagagtacaggaaaaagctgaatacgttatacaatttaaatatttattgaagcttttctactaaggcaacattttggtaatattcacagaaatagcaatatgggaggaaattaggggtaaatagatggtagagactgtggaaaccaagacacctaatgctaaaagtgggatcctcattcatgaagtcattaaattggagatcgaaaggaacagacctctttatggaaatattattttccttagaatttcatcattttttctagatgtgtcttctctgattttttttttttagtgcttttgtcttctttattgaatttccgatctcctcttcacactctattatctttctagctggtctcatccactccatgagttgcatatttaaatccctaataatgacttcatttctaggcacaatacccacgcgctacataaaaatacaaaacaaaacaaacaccttagcatccacacccctaatccttcctgttgttccaatttcccttccaatctccttgcaaatggcaccattatccacccaggtgtgcatttcatggagcacacagcatgcaatacaacaccaattcctattgattctatctcatatacaaatcttgaatagatttacttctttcatctccactgtccccattctagtccaaatcaccttcttttggatgagctaccgtaattgcttcagattgatagtccttcatctaccctaggcacttgccaatctctttcacacaaaacagagtgatagtcttaaaaaatacaaatatgtttacatcagttttctacctgaaacccataaggctgtccattgatcttagtataaagagaaaaataatttctataaccttcaaggctctgaatgattggaccccagtcggccattcagatgcaagcttgttccacacttttctgccctcactgtactctaggaaagctgtacttgttttagatctttctccataccattttccacattcagaaacattgctccctctgacagggacatttttgctccctcttttcttttggacaactatactctaacctcattcttctttgccttgctttgaatattttttttttctcagaagtatttccccaatttcgaagactggtctaactctccctattatacattcttattacaatgtgtgctttattctatagcccttatctccaatgcaagtagtttgcgtgtgtgtgtatttaatatgcacatcctccttgaaatgctagtctctctttgagttcacttgtttagaatactatcgccagagcatagcacagtacctggcacaaaatgggcactcaatatgtgtatttgttacatggacaaatgaatcaataaatggataacaaatcatcagctgtaagtcccttctttaaactgtggtcacccaaaaccacacaatacaagttttagagagtcacttattttgatacttttatttttggatttattttgagagccaatccattttcagacatttaaagtaaaacactgcaaaagccataggcttgagcaaagtgaacctctgtgataacacttggtgctctctgacagcccattagagacggggtgtgtacacctaatccaaaggaatcctctagctcttcagcagctgttcacatggctcatgccctgcccttcagcgtctactaaatcaggattccccagctgtctgagcttcccgtaagcgattttagttaaccacctacaagccaacatttcttgcatctgattacgctctttaaagtctaatttcccttttgcttcctagttattttgcaacatgtgagtcattgggattcatcatttttacagattattattttttcacttactcaactagtttattaatattttgttcacttagtcaccaatttatttctaatacatcgttcttaagcaccaacataaaaaggaattactcaatttgcctttgatgaaaatacgtgggccattctgattttgtgatttttctttcttatttctttaatttttcctcacacagcttccaaggctaaaatctgcacttgtaacagtgtactgactcccttgccctttaagtcagcacttagctcaggctaaggtactattgcaaccgtaatctgataaaggaagagacaagttgagtgcaaataaagatgagtgccaggaatgagaaaaaagctactgatgtttatgcccttttatagtcctgattccatgacagtcttagccaaaagcagagtggaagaagggagaacgctttaaaacaaaacaaaacaaaagccaagaagagggtaaaaacatttaaagggtaagcattttatttgcccataattggaaataatatgggacaccgtaatggtaattgtgctcagctaacactgaccttttttaaaaatcaaaattttcatgatagtgaagacaacacatttaaaagttgacaaattagcaagagacttcgtgatatatatgtgaattcctcattgttgatatgcccatgtatggttttcatatttattaaatataaacaaaaaacatcatgattcgagcatctgattttttgaagtttctttaaaattatcttaatcctctccaaaacccattaagccatctacattctcatttcattacatggataagcattggctttaataatgcattttaatgtacctcctcttcgttgacacaaccacatttttctactaaaataaataactaaactaaaatgaataataaacaaaaataaaggcaaagctcttcctcagattcttttattcaaatggcaattagacctacatattattcaccagtcttagatatatttcagatttccaaattggcatgagaaaatcaattcatcaatttgctagcatttttaatttatggacaattattttcttaaaatggtatgtaatcaaaatactgagttaaaaattctgaaagagtcatttaagaacaacaacaaacaacaacagcaacaacattttatcagcatggcaaggaaatgacaactccatttcaattaaaggatcattgtccattctcccccagttcccattagtgaggaatggggttcataatgacagagtgaaagtgaggcattgagggagaaggcaaaagatcacaaaagaaagcaggaatacattgatttctaaaccaaatccagactactaagaacattggttttctcagggcttactatcattacatatactacgcaaagtcaccttcagaggttgtaggcctccagaaaattgctctgtgtgttccgttgcctactgaaattcccaagtattttgaacgagtgatatcagattaaaataaagatcgagctcagagttgaatagaaattatcccttaaaatggcagcctaaacagaagatgtgagctataaaagagggagtactgatctttgtgtttttaatgggaatgaggtagaggttgtatggccgtgagatgaggactctttttattttatttttttttaacttttaagttcagggctacaagtgcaggtttgttacataggtaaacttgtgccataggggtttgctgtacagattatttcatcacccaggtatcaagcctagtacccattagttgcttttcctgatcctcttcctcctccaaccctctaccctccgaaaggccccagggtgtgttgtttctctctatatgaggacacttttaagcataagacagcagagccatttcccttcctcattctcatttgtctgctgcctatcagaattgtgcttaagaaaatttatatgcccttaaaacgctggagccaaatgtatttttttggtctttttgttgggccatattcaaggaagtaatcttgaatggggaaacagaaaggctatgccctgggtgttaaagtatttcataatctctagaggagccatctggtttaagaaggcacattgaatgctataatatgctgtaatatatgagggaaacagactttttatactatcaagcctttcatgaaaaaatttcatgaaaaaataaacaaaatcattttagcttttaatcttggaactatatttagtataggagtgattcacaaatagcagagttactctcccattcgaaggggttatcagaatctctggaagacacattcacttttagtattaagtagagggagcttgaaattttgcaaggattttagggacaattctataagtgacataaatagaaaaaaccctccaaacttggtaaaataataaattatcccatggtgttgccattttaactttgatatctgtattaaaatgaaacttcagaactccaaacatatgtcaatattttatagcatgaaaccccaaggaagtctaactaatagatgttttacgtagggaaaaggtgaagactacaaactatttatttgcttggtttgtttgttttttgaagatcagtatactgcattgagcacactctacaaggggaaatattttcatgaaacctggttgcatttaataaaaacgtttatttcccacactgcagcccatgaccttccccagaaaatattccaatacgaaccaactgccttgataacagaacacaaacctcctaggactatagcaggactttgtgagaaagaaaaccattgcctctctctgaatccaatcaaaacctgaatgtactgtataaaaataaaccaaggtcatcattattccttgtcattgtgatttggcgtgccttcaaattatataccctgtatatttcaaataactgcaccgcctccattaactgagtttgacatcactttaatcaatgtatcttttcagaatgaaaggcagaaatgtcaaattcctaccattataaattcttttaactctctaatctgcattaaataaaaggttgtctttgagaaataataaatgctctaaagaaatataactagcatcaattttattttaaaatgtaactgggaaaagattaaatgtcaacacatctcttcatacagaggtgatttcccaagaaactattaaagccttacttacatgaggggcccctcccaaggctgtatccaattttctattatttttcttaaaatagcacccccaattgtataacctcaggccccataaatcctttcttcctggttcgttctgtgttgtcagacagggaatgtacattagtctcatttgtcaattccttaaaaaatgatgtgtgtttaaaatagaaaatttagaaaaatgaacagaaaattatctttaaagaaaggttaatttctaattagaccctcttaggaaactttataccctgtgatttgaatgcatataaatgtgcatatatataaatatatatactcataccaaaatactgtgtttcttgtatgtgtgatgaaataaagagttgatgaaaaagtatgataaatcatttttaataagttaggaaaatattacaatagaaggtggaaggagaaggaaagtttgggaaatgactttgttttactcttgagataaaattttgatgaaagataataaaatagaattttgaaaaacacctgatgtttccaagacaatgattttaatctcttttattaaactacacaagtggttaaaaacttgacaatttgtttcatatgtagcaaatgacatggagtacagggatttcaaatgaatgctataggaataaagaggaagctgtattaatatctgtgcccaaatgatgaatttgcaattcagtactgtctagctggaatagtgtcagccaacacctttttccccttaaataatgtaattatgcatagaacactttgtagtctttttttaaagtttagagtaacatctatatgacatactctattgtatttttcataatgttatgtcatgtaagatacaccaaaagctttgtattaacagtatatcatcaatttagatcagcaatctctttttcgtagttaagatgtctttaaaagattctgcagatgaaattctaaaaggtgattttattagacctcagatgacttacatcatttaaatatattcaaatgaaatgtctatttgcagtacactatttgaataattctttacaatgcattatttgagtaattctaaaagtgaacaatacaatatgtttgacaatacagtgatctcttttaaagggtaactgttttggttaaaaaacaacaaaacgtacttttgtaagtttatcaaactacggcaaatttacaaactggattcaaatgtcaaacatccaagtagcagtatgttgtcaaacagcaaaatttaatgtataatatagccctgagtatatctccgttttttcttaccaaactcattgtcatgttgcataggcattacttgatgattttttaaatgcagcgtgaaaaaatcctacagggcatgtcccaaaaagattacctttcttcgcattctaagaattgaaagttatttgaatatctatgacaaagcagagtgtagatttaccttgcttaatttcagcagaattgcatatattctttcaaaattgctctatatacttgtatatgatgttaattatgtagaatatatatatatataaaatcactagtgattttgatggtatttatgttacatatatcaaagaaataaaaacaaaaaataaaaatgtgtgtgtatattgcaaacaacagatatatgccatgcatatatttgtaatgatagtaaatataatagtttttcaatctaaaagtaataatgatgtccaccaaaagaaatttatgaagcaagccaacaatgtaagtaaatattgtattataaagtctggtagcttttaatgtgactcaatacatggacaatgttaacttatttccacaaagttttcccagtggcaaaacttctgcctttttttttagtagttgtggagcattacttatttggagagatttattttttcattcttaattataggcattgccctcatatctattttagaataactacactccacaagtcaaagatgggtggggaagagataaactcccatctcttcgggacacacagtccttatcatatattatttttactgttgtgccacagtccatttttaaatccttcattagtcatcatgactttcttaaaaataaacgaaatagttgtatttctatatgaaagacaaactaaaaaattgaactgaaaagctggctcataatagacatgaaacaacaaggtgactttactactaaatataattaggagttcctcaagtttgtatgtcgtttacccaagaaatcatctgatcatttgatagcatagatcacatcattatttgaaataattatcatgatatgctacagaaaagagcatttgaaatagtaaatgtgagtaagaaacattaaaattaaatctttatcaatacttttcacatccttcaattatccgtcccaactcattttattctttattttatccatgatgtgtcagagaaactttttctaacttttaggcctccatgtagttcctatacagtagttagttcaattgagaatatatgtcaggtcagtaacctttatgtaactgttactaaatacggaagtatcaactaatcaaaataataactcagatatacaaactatctcacagcaatcaaaataaatctgttatagtcaaatgacattctgcatattctattactgcagtggtttgttaatcaagaaatcatgtgtttagttctatcgcaaagaaaaacttttacactccatttctgttgaaaagttttcccaatgaaaaatatatattcctgaataaatacatatatatatgcagtatatataacatttatgcttctttgcaaactactgtgataatttaaaatcaatctacctaattagtgagcttgtcacaaactaaacgttatgccacagtaaaatatatttttagttactttgtacttacaacagtcctctacttcttcccaccaaagcattttgaaaagtgtatatcaaggcagcgataaaaaaaacctggtaaaagttcttcaaactttattgctccagtaggcttaaaaacaatgagaaaccaacaaacttcagcagctttaaaaaaagtaacacttcagtttttcctattcgtttttctccgaaggtaattgcctcccagatctgagtcctgtagggggaaagtgagtgatcccaacactgagtgagtcaacacagtaactgatgccaggattctgtagaggcccccggatatttcaaattccaggacctgcgcacaagcaagtgacccgccttctctctcaagttggtttcccataataggactgtccatggtcactacatataaggttgtgcttccagcatggcaagctctgtgaattcaaacaatgctcaactgtgttctgattaatatccaaaccagaatagcacagtggacatagtacttgcttttaaagccttctaaacacaaaaactattcagtacaaaagcataacaatactttctgtaactttcatgtgaatttattaacagagcagaaaatccggattcaaaattgacttttaaatgccttttttatcctctcaacaacaccaaaaatttcactctaccaaataaaaaggaatgcccagaataatccatgcatttgttatgtatccactgtctaccaaagttattttttccccttgggattcaatcaaaagttatgtattgatgatgccaacagtctgaataagagaagcagcagcagaatgcagcagctgaattctgaaggcagaatgtgtgtgtgtataggtctcatgggacatgttttcctgctaaaataaagaatactcttataatgcaggaaagaaatttttctcaaatcctaaatttcagttgtgaattatgctaaaacttctttactaacaaattattctttcttccatttctctggtgccaattcttaaaacaccatttttttagacattgagttaatgatcatttaatggttctgaatagaggcttgttttctgtattaagtgaatacagttgtattatgtcattcagcatgtaaatcattctttgccaatagaaagcttcttcatcttgttccttattacttttatgcaacaggcgagcccaaaattgatagaaaacattggaaacattttttaaagaaagatattctttttatagttataataatccctactaaaatttttgtttgagtgtttttattgtaccatttgttaaagtgacagactcatttttctatgtcaaacattcaactgcttgcgactgcaatgagtaatagataaaaattaaaaaaatattgagtcagactgtgatgtttaccttaatagttaattgtacattttgtgttttagaatattattgtcataacattgctattttccccagcaaaaggtgtatgagataaaacataaggcctaattttaatttaaaacattcttttccctaggtcacctcctttcctctcagtgtggttgtctaaatatgcatataagcaaaattttcataaaacaacatagaaaaaatgaaaaaattgttttggggctgatttggctctaagtctgcatgttagcatcagtgtccctctatgctgtgaggtacaatattgcccagagtataagtgccctttgtatcttgcactgtgagttttctacaaacataaacccttgtttaggccaaggcgtgaatacaacttgtcggtcccaaaccaacatcaatatcacgtgggaacttctgagaaatgcaagttgacacgagacctcaaaagtcagaaattctggggttgggacacagcactctgtgttttaccggtgattctaatgcatggtcaactttgagaaaccctaaagtgtatgtttctaaaaacaaccgtggttctaaatgtaacaaagatgtgtcctgggtaatgtctaaagcaccaaatcctgatagatctgaatgccctgagatacatttaattgccattcagccttagttgataatcagaatttatttggcacctataatgatttctgcattgtgtggaatgcatatacttcccttaagattttataatccaggtgcaaatatatgcttacaataactggaaaagtgaaaggcacgtaaaataaaatttagaccgaacaaattgaactccagttcagactgtgtcaccacagtactttcttgtgtcccttaatcacttatctttctcctttagtcctcagaataactacatcttgtaggtcttattagccccataataaaggaacttgctcaaatttccatttttaataactgtcacagaatttttaaaaatttattttaacttgttattttcaaatacttatagattcacaggaatttgcggggatagtatacagagatcccatgtacccttcacccagtttctcccaaagattaactacaataactacaattcagtatcctacaataactacaattcagtatcaaaaccaggaaactgacattgatatgtatacatatttctatttcatcactgatttgtgtaacctcaacctccacaaataaacacctgtttcatcaccacagagatttgcctcatgctacccctttacagtcacaacagtcaccctccctaaatatccctaaagcctggtaccaatcaatttgttctccatcactgtaattttgtcattttaagaatattagataaatgcaatgattcggtatgtaaccttttgagattggctttttttttttttttggcattctgtacttgagatccatttaagttgtcatcaatagcttatttccttttattgctgagtagtagttcatggcatggatgttctatagttactttattcacatactgtgggatattttcgttgtttccagggtttggtcactacaaataaagctgcaaaacaatcatgtagtttttcatttttcattcctctagattcatgtcccagagtgtggttataatttaccatataaattttagaataagtttatctacaaatagatctacagatctatctacagaatatctttcaggtagaattttgataggaattgcattaaaattatgaatacattttggaagaattgatgtttttaccgcattgattcctccaattcattaacatagtacatatgtccaatatttaggttatctttaatttatttcatcatactcggcttttttacacagtgctttgtgttgtgattagatatattaatatttctaatataatggcactactgtcggttatgcatgtgattgcacaaaaaaaggaaaacagcagagtttccaaaacccgttcttttcctgtttgtttttgctttttaagaaattttcatttaagagatggaggcttgctctgtcatccaggctggagtgtagcgacacaatcatacctcgttatagtctcaaactcctgggctcaagtgatcctcctgcctcaatcttctgagtagctgggtctacaggtgaatgccaccatattcagctaatttaatattttttttagagacagggtcttgttatgttgcgcaggctggtctttaacttctggcctcaagtaatcctcctgcctcagcctccccaggagctgggattataggcatgagccaccacactcggccagtttgtaaaaagaagcacatttaaaaatgtttacgttgttaaaaaatgttatatgcttgttggccgcttgtatgtcttctttcaagaagtgtctgttcaggccgggtgtgttagctcatgcctgtaattctattactttgagaagttgaggcaggcagatcgctttgagctcaggagttcaagaccagccagggcgacatggtgaaaccccatctctaaaaaaaatacagccgtgatgtcaggcgcctgtcatcacagccactcaggaggctgaggctggagaatcgcttgagcaggggaggtgaagtttgcagtgagccgagactgtgccactgcacttcagcctggactaagagcaagaccctatctcaaaaaaaaaaaaaaaagtgtctgttcatatactttgcccatttttaatgaatgtatttgtatttggtttgttgatttaagtttcttatagattctggatactaggcctttgtcagatgcatattttgtgaatattttctcccattcttcgtctgtttactttgttgatgtttcttttgctttgcagaagctctttggcttagtcaagttccacttgtcaatttttgtttttgttgcaatggcttttggggacttagtcataaattctttgccaagaccaatgtaaaaaagggtacttcctaggttttcttctaggattttttacagtatgaggtcttatatttaaacctttagttcaccgtcagttgatttttgtatataatgaaaagtagaggtccaatttcaatcttctgcatgtggccagccagttttcccagcaccatctattgaataggaagtcctttccccattgcttatttttgttgacttagtcaaagatcagatggttataggtgtgtcgctttgtttctgggttcactattctgttccattggtctatggtctgtttttgtaccagtaccatgctgtttgggttactgtaggcttatagtatagcttgaagtcaggtagtgtgatgcctcttgctttattcttttagcttaagattgctttggctctatgggctcttttggttccatacaaatttggattagtcttttctaatgaaaatgaaaaatgaaaattgacgttggtagtttgataagattagcactgaatctgtaaattgctttgggcagtatggccattttaacaatatttattcttccaatccaagagcatgaaatgttttgcatttatttgtgttgtctctgatttctttcagcagtgttttgtagttctccttgtatagttctttcacctccttggttagctgcatggtcatgaaaaagaatgaaatcatgtactttgcagcaagatgaatgcagctggaggccattatcctatgcaaattaacacaggaacagaaaaccaaataccgcatgttctcacttataaatgggagcaaaacactgagtacacagtggacataaagatgggaacaagagatactggggactactagagggggaatggagggaagcgggtgtgagctgaaaaactacctactgggtacaatgctcactacctgggtgactggatcatcagtaccccaaacctccacatcacacaatatgcccttgtaacaaactcctgaacatgtacccccgattcaaaatgaaagttgaaattattttgttaaaattttaatgaaattacaattgtttacagatgaattaattagacatacatttttcaaaaatataaagcataatttttattacagtgaactcatacacatttttttaaattacttttttttgtctacacttagatgatacatgttgtaaaatgaagactggcccatgattatattccaatattaaccagtcatccttgtgttattaaatagatggcatattaattagaaagaactgaatatggtaaacgtaaagtgaacaaggagttaattcttaaataattggaaaccctaaaggcattattttatattactttggaagtgcagggtcattttcccaacttgtttgattatttaatataattccaagcattatgattaatgcagcttcacaggacaaataagttgaagagaaacaggcttattaggtaatatacttatataaaattcacaaatttattgattagggaaaaaatcattatggatcatttctacttcctttttccacagtgatccatattggttgaaatgttacccatattataaggcatatatttcttaggtgtttaaaaaatctctttagttaagtccaatgggaaaatatgctagtttgtgagtgagtttataggcactaggaccagaaaaaataagacaaatagaattcaagcaatttggagggtgtccaaatagacaaaaatgtttcactgatgttttgataggaattgcattcaaactatagattagttttggaagaattgatatatttactatgttgtatcctccaattccattaatacagtatatatctccgtttatttaagtctttgcattatttccttagctttttagtttgtagtatatagatctggtaaatgttttattagattcataagtatttcattgtttcagagtgactgcaagatactatgtgaaaaattttgggtttcagtagttaattgcttgtatacaaaaatacaattaatttttaataatcattttactgtgataagatttaatatgagatctacccaacgaacagattcttaaattataatgctgtattgttacatatagatacgatgttgtacagcagatctctagaacttattcatcttatataaatgaaacttcatattcattgattagcaattgacttttataagttgatcttgtatcctaagaccttaacaaactcatcatttctaagagtaactttgtagaatacctgggattttacatagatcatcataacatctgcaaatggagacagtataacttttccttcctgatttgtacgcttttatccacttttcttgcatttttacactagctagaacttccagtactatgaataatagtagggctgaaagcaaccgtctttgccttaatcctaatattaggaagaaaggtgtaaattctttcattattattacaatgttagctataagatttctgtagttattcttttccaagttgaggacgttctcctccattgttagttttctgagagcttttatcataaatggggcactgaattttgtcaaacgttttttcccctccatcaattgatatgatcaagtgattattcttctttagcttcttaatataatgtgtaaaaatttgttaaggctttttgtctctatatccatgagttttattggtctgtaatttgttgactcttctactgtgcttacctggttttattatcaaaatacttcttcctcataaagtacatttggaagtgttgcctcctcttctattttctggaagttgacagttctctcctttcatcacttgaaaaatgtcatacttcttccttcgggctttcatggtttcacataagaaatcctctgccatttgaacttttttgcctatagataaagtgtctttttctctttcactgtttttaagactttttttaaaaaaaaaatataactagttttcagacatttgactatgatgcgtctaagcatgagtttctttgggtttatcctgtatactcagctccttgaatctgtagggttttgcattttacaaaatttggtatttttcaatcattatgtgcttgagtacttgttcaacaacaccctccctttttgaaactctgatggcataaaccgtagatcttttattataatcccataggacaactgagaatattttcattttaaaaatcgtttttttccttcttgttacgactgtgtaatttctattgtcctatctttctgcacacagatttcccctgtctcctcacctccattctactgttgagaccatttattgaacttttttttgattacgatatttttagttctaaaatgtcatgtcgttctatgtcttctatttctttctgacttttcccattttttatttgttgcaaaatgttttaaaaagcttactcaacaattttcgggatggctactttaatatccttgctagataattctgtcatctttgtcatgtcagtataagtgactactatctttttgcattccagttgagattttcttttttggcatttgggatattacattatcagactctggatcttatttaaatctattttagctcgtccccttctgactgttctggtggaagatagaggtagaagtgtgctgccttattgccaggtgggagtgaaggtcctggttccccactccatctatggttgatactttagagattattgtgtgtgtgtgtgtgtgtgtgtgtgtgtgtgtgtgtgtgtgtgtgtgttctgtaaataaattttacttgacaccatcttaattccctttaaaattagtaagtagatatctggaaccttgtgagttcatttttaaatgttcagatttttttttccactggacaaaaaaaaaaaaagagctttaactcacatttccatagacaatgaagcccatggcattcacataacgatgtgatttcaggacttggtactacatatcagtactatctatagagtcaagaaagaaaacatttgcttaccaaatataagcaaaactcaaaactaatttgcctgtgttgtgaaaataatgactcctcactttgtggattgattcccaactgttttatgaggtaaatgtacagggattaatgaagatttttaaagatttctgaatgtaagaaaggtattatgagtacaaagatagtaaatgcattgatgctagtgagctgagaatcagtaacatgttttaatagttgtatctcttatggggtattagtgaagatcctggtaggaaatataggtagcagattcaaaagcatttaacagataataattcggtgaaagaactatggacaaacatataggcaggctgatgagaacaaataagggatggtgagtcacctagcaagcagcaagagaggtaatttgtttctacctccaggcctaatatgtcaaggtaaaggaataatgttggaatagcaatagaaaagggcagtcactaccaggaccttagtgaggcatatgtgaagtggaacacaaatatccaaacctttttttcccttgccctctgatgtccagctggtgtcacataatttcctaaaagttagtgcacaagaggcgttggtgatacaaatgaagagacaagctttccagggcaaaaaacagggcagagaattgcaaaatgggtgtggtagcgaggagtggagccactgccactaatacaactgaagaatttttagcaagcaggctcacccctaccatttcagtcttggatggatactcagtactagtgtgataccttgtagaaaatatgatcaaggatgaatagatcctacgcaatgtagcctttgccttcattttcaaccctacatctctgaacttccttgagttatgttatgtgctttcctactattatatctcagattatttaaaaaattcatcatacatgttttctgagcatgcagctttactccctttttgcatgtgtgataaataaattgggtgtatgtttaaggtgtttcttacctgatggaaggcaagctccatcaaaacagttgtgtcttcctttttagttgctttatcactattgcttgtcattttgttgtgtgaataaaattgtctccacttgcaatttctttgtattatatcctttgtgtattatatgctccctcattcttctgggctttgtttaaatttactttatgaagattattttttttagcttctcctcactcccactcatagatgggtctaacaatatgaatgcatctttactactcagctgtaaacttcttgatattaagaattaattgctatttatattatgttgataactttagctctcaaaagcacattgggtgtaataggagtttagtgatatcagttggaaaaaaggaaacaggcaagagagggaaataaagaaatttatgatccagatcatcataaaatttaaaataaactttgaatgtttgagagtagcaaaccaaatctctttgagagtgtatgctaaaagaaattatgaaccttggtactatgggatgaccatagtgacaaattctcatttaaaacaatggaactgggccgtggaataaatgtgtatttatttatgaaacatttattagggccagattttctgcattaaagatatgagctaacaacttcaggtccctgccctcaaatagattataccttgggtatattaaaagaaaagttgacattttaatcgacctgctaattgataaacttcaataagcttgaagactttcgtctcagagaggtacctaatagcaagaccaggttttaaagataacaccgtatgcactgcctactataaaatattgtcatttaggttaaattaagcattgcgttttaaaaagctgctcccaaacgcatacactagacaagatgaaaagtctcagatcaataatcaaagttctcatctcaagaagaaaataataaagagtaaaaactaatcaaaataaaaacagaaaaacagtaaagaagattcattaacaaagagctattttttcaaaacggtcaataaaattgacaatgtgctaaaagtgacaaagaaaaaattgagaggacacaagttacccgtatcagaaatgaagtagggaatattactacaggcctggaaaatacaaagaaaaaaaaagacagtaagggtttactatgaacaattcttcacataagtatttaataatttagatgaaatagattgattcttcaaaaggcacaaactactgtaaatcaatgaatataaaatggataatttgaatggcctagactttggctatttaatagtaatttggatatactagataatgagtataactgttaaggaaatataactcataatttaaaaacttctacaaaagcaaacttctataactgcattggaaaagtatgccaatcttgtgaagaattaacaccaattctacacattcttttccagaacatggaagggaagaaaacaattctgagtatatgtgttgagtccagcaatagcctgatacccaaaccagaaaaacagtacaaaagaagaaaactataaatccatattccttacaaatattaatggaaaatttattaatacaatttcagcacataaaattcagcaatgtactaatggatcacttggggtttatttccaggatgtaaatctggcttgatatttgaaaattagtcactacaatctaccatattaacaggtcatagaggaaaaatcacacgatgttatcagtaaatgtactaaaagcatttgacaaactgatatatctaatcttgaaacaacctgtctgaaaaataggactaaaggagaatttcctcaacttaataaacaacatctacataaacctacagctaacttcatacttaatagtgaagtattaaatgctttccccttaatattgtgaacaaggcgtgaatgcacacgctcaccactcttattcacgtactgctacaagttctagccagtgcaatgaggcaagacaattaaatcaatccatacagatgggaaaggaagacataaaattgtcccttatatgtagatggcatgaaaataaaattttcaagctatctataaataatctcctagaaattattgataagtgaattcatcaaggtagcaggatgcaagataaatatacaaaaattgattgtaaccatttacattagcacctcccacaaatgaaattcttagatctaaaactagcaaaatacataccatatctatatgaggaaaactgcaaccctctgatgaaagaaatcatagaagataatccatattcatggatgggaaggctcaatatttttattatgtcagttattctcaaattgatctatagactcaatgtaatcccaatcaaaatctcagtagttactttgcagatattaacaaagagattctaaaaatgatatggaaaggcaagaaaccttgaatagccaaaacaacattgaagggctgggcgtggtggctcacacctgtaatcccagcactttgggaggccaaggtgggcagatcacttgaggtcaggagtatgagaccagcctggccaacatcatgaagccccgtctgtactaaaaacaacaaaaattagctgggagtggtggcacacgcctgtaatcccagctacttgagaggctgaaatgaaagaatcgcttgaacccaggaggcggagattgcagtgagccgagatcatgccattgcactccagcctgggtgacagagagagggagactccatctcaaacaaacaaacaaacaaacaaaaacaatattgaaggacaagcacaaagtcagaagattgagactgctctacttcaagacttcggtaatcaagacagtgtcttattggcaaaagaagagatcaatggaacagaatagagagcccaggaataaacccacataaatatagtcaactgactgatgtttgataacggagcaaagacaaccttttcaataaatggtgctggaacaactgggcatccacatgcaaacacctttcacaaacattaactcaaaatggatcagaaacttaaatgtaaaatgcaaaactataaagcccacagaagataacataggagaaaatctatatgggtctggtgatgactttttagatataacaccaaagacatgacctatgcaagaaataattgataagcaggacttcattaatattgaaaaattctatgctgcaaaagacattgtcaaaagaatgtaaagacaagccacagaataggagagaatatttgcaaaagacatatcaggtaatggactgttatccaaaatatacaaagaactgttaaaaatcaacaataagaaaacaaacaactctattttaaaaatgggcaaaacaccttaacagataactcaccaaagaagatatacagatggaaaacaggcgtatgaaaagacgcttcacatcatatgtcatcaggaaattgcaaattaaaacaacaatgtgatgctactacatacctcttagaatggtcaacactcagaacagtgacaccacccaatgctggtgaggatatggagtaataggaactcttgttcattgcttgtgagaatgtaaacttgtacaaccactgaaaatcagtttaaggattttttacaaaactaaacatactcttgctatatgatcaagtaattagactctttggtatttacccaaataagctgaaaacttatgtccgcacaaaaacctgcagatggatgtttatagcagctttattcataattgcctgaacttggaaacaacaagatgttcttcagtaggtgaatggataaataaactggtacattcagactatagatgctaaaaagaaatgagctatcaagacatgaaaatacactaaggaaacttaaatgcctgtttctaactgaaggaagccaatctgaaaatgcttctatatactgtaggattccaactatatgacatccaggaaaggtaaaattatgaagatagtaaaaatatcagtggttgccaggggttagttggcagggaggcatgactaggcagagcacaaatattttaggtcagtgaaactactctgtatgatattatcatagtagatacacatcactataaatttgtccaaacacacagaaaacacaacaacaagagtaaactctaatggaacctatggatctgagttataatgatgtgttgacgtaggttcatttattgtaacgaatgtaccactctggtgagagttattaataatgacagaggccatgctcgtgcgggcacaatgggtagatgggaaatctctgtctttcaattttgctgtgaacctaaaggttctccaaaaataaagtctattaacaatcacttgcattctgtgaattaataatgaacatatggacatggaaatttaaaatatagtatattttactatgtcacaaaaattaaatataaatctaacaagccatgtacttacatggtgaaagcaaaaaaaagttttagaagtaaatcatagaacatctaaattaatgaagaaatatattgtgctcgtggattgagagattcaacacagtaatgtcaattttacccaaactgttacacagtttacacaatttttatcaaaatctcagcaatatttttggaatttaggtgtaggaaaaatttatgtgaaaaggcactctaaaatttatgtgaaaaggcaatggatttagaatagctaaaacaatgttgaaaaggaagaatgaagtaagaggaataagtctaccagactgaagacttattaaatagctacagtaatcaagatagtgtggtgttggtgttgggatagacacgcagattaatggaacagaatagagacttcagaaatagacccacacaaattgctcaactgattttgacacagtgcaaaataattcagtggagcaaagatagtcttttcaacacatgggtcttagaacaagtggacaaaaataatggaaagaaaaaagaagaaaaagaaccttgacataactttacaccttatgcaaaataaaatgcaaatagatgatgaatttaaatgtgaaacacaaaataataaatattttacaaaaacatacaggagagtcttcaggatgaaaggctaggaggagttcttagatttgacgttaaaatcgtgtgccttaaaagacacaatttgataaatttgacatacaaaattttaaaattttgctctgagaaagatgctgccaagaggatgaagagacaggctgcacatcgagaaaaatacctgcaaaccatatatctgaccatgcactagtatctagactaaatgaagaattcatgtaacccaaaagtaaaaacaaaatagacacaaaaaaatccattagaaaaatgggcaaaagacatggagacatttcaccaaagacaacacatagatggcggataagcttgtgaaaagatgttcagcatcattggctcttagggaaattcgaattaaaacctcaatacgatataactctgtgcatattagaatggctaagttaaaaaatagtgacaacatcaaacactggcaagaatgcagagaaatgagatcacttacacattgttggtggaaacatgagatggtaaaggtactctgtaaaagtttggtgcattgtaaaaaactaaacatacaactaacctacagcccagaaatttcattccatggcattaatcccagataaatgaaaatttgctcataaaaaaactgtacatgagtcttcatagcagctgtatttgtaataggcagaaactggaaacaacccagatgtccttcaacaggcaaatggttaatcaaactggcatattcataccatggaatactactcagcagtacaaaggaacacattgttgatgcacattacaaatctggaagaatctccagagaattatgctgagtgaacaaggctagtcctaaatagctacataatacagggtttcatttacataacacttttgagatgataaaattatacaaatagagatcatattagtagttgctagagattaaggagtgcctgagggcaggaaaaaagtgggtctgaccatgaaagggcaacatgagtgatccttgtggtgatggaaatatcctgtattttatctgtgctgatgtcaatatcttgttgtaatattgttctatagttctgtgactttaccttaaggagggactgggtaaaatggcacacaggatctttctgtattatttcttacaactgcatgtgaatttacagttatctatctatcttttttttttaaaagacagtgggctgggtttagcctatgagccaaagtttacagactcctgccatacgacactgacattcgtgcatacaaataaatataagataaaactacattgtgaagcctgatggagattaggtggcatcaatgtcatgtttaacactgttgcacttgcttttttttgttaaaaggatactgcaactagattatataacgtaacacacttaaaagaattatctaattcaggaaaattttaaatatgcaaatcagaattctgggtatcgtttaaataaaatatttagagtcttgtaaaaacaggctctcagtgccattgtgttattgttaatactcaaaactgtttcataagtttatttattgaaagcctagaccaagttattactacacaagaaagagtaaagaaaacaatataaatctatgtggatgacattttagagtgcaacttcagcaaacttgtaggctcaaattaaaatcctttcctaatttctttctttaaaaaagcaaaagaaaaaaatcccctccctgttagaattatttttttactctgttcttaaaaccaccatttttttccatggcaaggctaagttttcatcctgataaggtttttctgaaggtttaatgtgtcatcctaagaaacaattggtaagaattgataagaacagaagatccaacgattgcggtgcctaaagctcgaggctattcttagttgtgcatatttttcgagcacgtgattatatgaaagttctgcacatatttttgaagacttctatgaaataaaggggcccaaaagcttaagcttcatttgcttcctgacaactcaaatcatctggaaaggagagaagctttgagaggatttatgtagcagatgaagctgcacatgctattttctctaatagtttttaaagagagagagagagagagagagagtctttgagtggcatcctgttttgaatacctcactacagaatgccttaaaaagaaatggaaagaaaacacaaataaacaccatttataatttggttcaaaattttctgagccccacaatgaatatacttactcactgaagcctgagagtcagagcctgttaatggaaatcagagaaaatatttgattcgaatttaaatgaggtttcacaaatggattgaatttagaggaggataaaaaaagttttatattggtttatgtctcaaaattctgttcagttttataaaatgtttaaacattgtgaagtctggttatttgaaagatagcttttaatctatagtatattaaagattagtgcttaaagtatattctgggtttaatagatgtctaaacaacctaaacaacctaaagcatttatatttccttaaacatttttaaaatattgaaaatcttatggtgaatctttagagttaactttatttggaatattgagaagtatgatgttattgaacccaagtttaatatgttattgaacccaagtttaagtgtgtgtgtgtgtgtgtgtgtgtgtgtgtgtgtaggcatatgctttttccatcacaaattatcttccaaggtacatgtctctctctccacgttagcaaatgaggtacatttaagggttttcatattctgaggtaataccttcaggaacttggagaagagagtaagattagaaatagtttaaaatctctatatttaaaataaaaaggggagggacttggagaagggctacttcgataaaacctcagtatgaaaacggggaaatctgagagtacaattggctcctagaaggttggttagcaaaaatataatacatttttaaatagaagcaatgataagagcagcagttaaatacattagaaaagataaagtatattaggctatcaggctctcacttccacctatattccccatttaaaaaaatttttcttcagctttttttttttttgagacagggtctcactctgttgcccaggctggagtggtaaacatacacagtgtttgtttatttttaacaaactgccaaactattttccagactgatattcttttcagtaatgtacgagtgatcccatttctccacatttttgctagttatttggtggtagtgtcactattttttatttcagacactctgaaaaatgtgtagttttatctcactgtggtttcaatttatatttgcttgatgtctagtgatatttaatatcttttccatatgtttgtcatttatatatactattcagtaaaatgtctcttcgtgcctttggctcatttcctaattaatttatttttggatttttgcttttgagttttctaagttcttcgtatatagtccctgtttttgcaactgatatgcaaatattttctcccattctgtaccttgtatttcacttcttaagaggatccttttcagatcaaaagttttaattttaacgaagtccaatttatcagtttttcttttttatggattgtgctatttgtgtaaagtgtaaaaagtctttgcctcagtcacaaaattttctcccatatgtttttctaaaatatttgtagttttatgttttatatttgacatttgagataattttgcataagacttaagttgaggctctatttatttacttatatatttatgggtgggctttgtttgttttgcctttagatgtctacttgctcaaacaccactcacttagaaaaaacgcacactatttgttgaaaaggctatagaaatggaaaggctgttaaaattcctccttggaattgctttcacaactttttaaaaaatgagtttgcacatatttgtgcgggtctatttctggaatctctattctattgcattgaactatgcgtctatctctcccccaattccacactgtcttgattactgtagctacataataagccttaatatttagtggagtgattctttccactttattcttctttgtcaagattgtattagctattatcaggcttgtacttttccgtataaatttagaataagctgatccaagtctactaaaaagaccttgctggtattttagtagaaatggcattaaaactatagattaatttggagataattgacatctttaccatgttgagtattccaatccattagcagagtatatctctccatttataagttaattttttatcatgctgtgtttttcaacagtgttttgcattgagattagactgtgttttcatatttctaatatacttacaatgtgctattgtctgctatgcatgtgattacacaaagattgcgaacatagcaaaaggtctaaaattatgatttagaaaagaaagcagattttaaaaacctaaacgactatagctaaatatacaccatatgtgtatgatgttgaaataattttaagtaataagattataattgtttatagagggattgatagagacctgtaatttttcatgaatgcaaaatatattttaattacattaaagtcatgcatcagagtgttttttaattacttttctttagcctacagttttatgatacatgttgtaaaatgaagactggtccttgcttatattgcagtattaacctgtatcataaaacagatgacaaactcttagaactaagagcactaaatttaaaagtgaacaagaaatgaattcttaagtatcttaaaaccctaaaggcatttttaaaaataaatatatattttatttcatcatacattgtggatgtagagtcattggtgagaaatatatcccctgcattataacaatataattattggaaagtataatattcttttaatatctaattcaacatggaataatagattttcagcaaaaggagggagttgcatatatctgacctttattgacaggcctttttgtctccagtaattacccaatctctatgcgattcagtgttcttaaggaaatccaacttttcttgctcttaattatttgtttccacaaaatactagccaaacacatagctattaggtctatgtgaggtggacgtatacatcaaaatttcttcacagccacttaaccaacgtgctaagttttccagaatccaaaacaaatcagtttaagaggtaggtatgcaaagaccctgtaatactctagattttaaaaaagtatccttagttaagtaccatgagaaaatgagctagtttatgtgctatgttaggaacataatagccaaaaaaaaaaaaaaataaataacagttggaatcaggcaccttggtacttcatgagtattttgcaacagtataatagggcctttcagtaatgatgtgcttgcatagaaatacatgaaaattacacaaatttgatatttttagtaactgaatttagtttagttttgtaaactcagaactcaagggtgacgtgcatatgtgcgtggagtgacttacacatacatacacaagcaatcatatgtacaacttgggctcttagaaagtagggcacattgtcaccagttgaattgtcatatgattcctgatttaaatgataagtcgttccaatttcttcaacccttacttcttgagcgaacagtccatatgcaaatcagtatggagtggcaaactttaatctcacgttctagtgagtattttatactaaaaaccaccagatagagtcatgaaaagtagaaattgtttatatatacacaaacgcattttcttaaagtaactatgagtttcatttactttcatcttatactttgttacttcaaagggagaagttactgatttttcttatctccctttatcagccatgtccctggcaagaaatagaattcaacatggatggttcaataaaacagtacaaaggaactactttcagaggtgtgaatgggcttaaagaaaccaaaaggggctatcgaggcacctagagacaacctccagtaggcaattgtgatatacctttcccagccttaccatgcctgaagagtcaagtgaaggaagtaggattttctaaatccagtaagagatagagccatagaggagattcttaacaggatagttagagatataagctgccatggtgggaaataaggcacaaagagagtggaggtcaatgtaaaaggaatgtcccagatctgctctctttctgcctttctgtcttatgtttatgccttccattggccaaaaccaacaggagactactcggcaagggagctaaggaaatgcaatttataggggtcagcttcacagtgacagagcagaacaaaaaagagcataaaatggattgggccaagccagcaagaaaagagtgtactgaaatatttaaaatttagagagaaaaaataaatccaccaacctaaaatgctgtattggtgaaattatccttcaaaagtaaaagagaaatgaatactttatcagacaaacacgctgagggaatttgctgccagtagatctgccttgcaagaaatgtcaaaagaaggacttcagagaaaaagaaaatgatgtaagtcagaaacttagatctacataaagaaaggaagtacattagagaaggaaaaaatgaaagtaaaacaaaattatctattcttcctattcctgattgatctaataaatatttgttcaatataataacagcaagaagaaacattggatgattagagcttatggataagagaaacgaatgccagtaatgttacaaaggttcaagaaggaagagttgggaatattctgtgtgggaaaaaacggattggagtgggagcagaaaaacaaaaatcacaattcctttacgtaaattaacatcagaaccatcctctaattaggagttcaagttcaacttcacttggttgtaatcataatttcaattctttctcttcttaaaagctaaaggagccaggtgcggagtctcacacctgtaatcctagcactttgggaggccgagaggggcagatcacttgaggtcaggagtttgagaccagcatggtcaacatgttgaaaccccttctctactaaaaatacaaaaaattagccgagcatggtggcgggcgcctgcagtcccagctactcaagagactgaggcatgagaatcgcttaaacccagcaggtggaggctgcattttaattatttattcatctgatgatggacagaatctaaaaaagttgaactcatagaaatacagattagaatgaagattaccacagaaatggcggaagggtcctaccgggaaaagaaagatgttgatcaaagggtacgaatttttagttaggtaggaggaagaagctttagtgatctattgtacatgatggtgactataatatatcataatgcatcatatatttcaaaattgctgaaatagtggattttaatattttcaccacaaaaaaaatatgaggtaacagattcattaacctgatttaatcactctgcattgtaagcatatatcaaagcaccatattgtaacctataaatacaaacaaatattaattgtcaatgaaaaagaaatttaaaaataaacgacaacatcaatacgacatatgagactaccattatagtccaaaaagtgcactcctgggcatttatcccagagaaatgaagacttatgttcacacaaatcctgtacattagggttcacagcaattttattagtaacagccccacactgtaaacaacaatatctctcagtcagtgaatggtgaaactgtaggatgtccacaaccataaataaatcagcaacatatattagtaataaaaagtaacaaactattgcaatatgcaacaatttagatggatcattaagcaattatgctggctgaaaaaagctagttcgaaaggattaaataccatacaattctatttgcataatattcttgaaatgacaaaattatagacatgaagaacagattaatggttgccacatgttaggcatgggacagggtgacaagaggaagcttgatgattttattaaaggtcaacaggagagatctttgtggtcatgtaacatccgtattttgactgtcgtggtggacgcactaatctacatgtgtaaaaattgcatttaactaaatatatacacacacatgagtataggtaaaactgggaaaatctgaattagagaggttaattgtaacaaaatcctcattataatgtttgaatataatttgcaagatattacaattggggataaccgagcaaaagccacacaggatatttcacataggatcttttatattattttttacaactgttcttaactctacaactctttgaaaataaaatgtttaacttttaaaaagtttctcaagcttgcttagcttgtgtcagagcttggattccaatgcagatatgaagccagagcccttgcttcctgtcattgctctataccggtcctcagagttcccaggacgcaggaaggtagattggaattgcactgcaggcacaatttaaccaccataacagatatcctaaattatttttttatttttaatttttgtgagtacacaatagatgtacatatttagcggtacataaattctaagctaccaatagattttagatcatatggtcttgtaaaatagtatgagcatgcaacggttaggatcatgctgccaacctctaccacttaatagatgggtgtgtgtgtgtgtttgtgtgtgcgtctatgtgtgtgtgtgtctgtgtgtatttgtgaatgtgtgacaccttggagaagaaaatttttcacacctcagtttccccaattgttaaatgagggataacaactgttgctaactcactgagttacaaatgacttaatatcgacaatgcacttagaataccacccagaacatactaagttgtatgtgttagatattattattactactactgattgcagaaatgataaaatatgaaaaatgttcttttagaagaaatgtggcaaacacactgacatgattcaatgaacagcagtctagattatgtatattgtcttataattttatcatctacgtgacctaagtattagccaccgctgccattccaagagtcgattttttgtaaaattctgggaaaagagattttgcttctcacatttactcctaagtcagaagtctattgggtaatcacttctctgggtttagatccctcctggccactctcagtgattctttcgcccaggccactgttcgctaagcttgtcaccacatggatttactggacaattgtccatttactggacaatggctcttcctagtgtgctgctgcccctcagcatgggcttcagccccacaccaaacatggaacaggctctcctcctgttactactcacccttatagtccccacaactccatcagagagttctgtaggaatactggcctttactggagggttgggattgggggtaactaagagaattacgttaagggatggagaaaggccaaactctatactaacaatggcttggtcttgtgttgtgtagcagaaaagcaggaaaaaattaacccctacacaacgttttttgtgagcacgcaccagttcctattcttactctttcctattgaaggctatgggcttcctttctaaaaggcctccattttcaagctagaaatgactgccttccttcagggaaattccaccccataataggaaacattgatcatttactatatgccaagtattgatctaagcaactcatcagaattaactactgtatttaattgattctgagatgacatttcacattttaacatttctaaaatcaatatgtcttaaaatcattagtgtatagcgtttaggggtatcctgttttttaatttgttagtcctacacacaacaatggtctatcttgcaatttattatttcttagattcaatgacatacagcaatatagttttcacaacagtttaatcatttagggacttattttatcaacattttatagatgtcacaatcgagtctcagaggtgatacacacctagcaacctcaaggttgctcaaggtcacacagctagtcaatggtagatttaatcccagatagcctgatccaagagcctgtacccttagaatataatctgctcctcccagattagcgccatctcccatgggtccccattaattagcaaggacagcctaatctaattcatagtgaggaagagaaacattttccaaagtttgcaaaacttgccaagctggccaacttatattattattattattattatttttttttttttttatgagacggaatctggctcagtcgtccaggctggagtgcagtggcgcgatctcggctcactgcaagctccgcctcccgggttcatgccattctcctgcctctgcctcctgagtagctgggaccacaggcacctgccaccacgcccggctaatttttttgtatttttagtagagatggggtttcaccttgttagccaggatggtctcgatctcatgacctcgtgatccgcccgcctcggcctcccaaagtgctgggattacaggtgtgagccactgcgcctgtccgttatagtattaagcaaaacgagtgccaatatttggcttctccttcctttttttttttctttttttttgacaaagtttccctcttgtcacctaggctggagtgcaatggcgcgatctcggctcactgcaacctcagccttccaggttctagtgattctcctgcctcagcctctcaagtagctgggattacaggcatgcaccaccacacccagctaattgttgtatttttagtacagatggggtttcaccatgttggccaggctggtcttgaactcctgatctcaagtgacccacccaacttggcctcccaaacttctgggattacaggtgtgagccaccgcgtccggactctccttcctctttcaagttgtttcctgggtgtggggtgtggtggggaacagaggcgtaaatagcaggtcctttacagaaccacctaccacaaagatgactacactttgcctacacaaaaagctggcagaagctttttgctttattttggaggccttatcaaacaccagggcagaatgatctgtaatctctgaggtgagaagctagtgaggattaaccacttttctctcctagcaaaaactcccaaatggtgaggctagtggggaaggaccgggtggtagtgttattgttcttccagttacatgtatttgtaatattattcaatgtaccttatctattaattatgtatattttatcagctcattccccatccaactgtgacagagggaagtgtgacacaagaagtagtgattaaatatctcaacatgttcatgcatccagcgagcaaaaacccagactactttgaagtaaggatagactatgtcagccccattaccaaatatttgagggaaacggttgtacaatataaaaccatttctgaattttagaggagtcaaatataaggtttccaaataatataaaacgcacgccattggtttcctccctccctccctccccttcctccctccttccctcccttcctcccttccttccctccctccctccctctttctttttctttctctcttttttttttgaaatggagtttcactcttgttgcccaggctggagtacaatggcgcgatctcggctcactgcaacctgtgccttccaggttcaagcgattcttctgcctcagcctcccaagtagctgagattacaggcgtgtgccaccacgcccggctaattttgtatttttttagtagagacagagtttcaccatgttggtcaggctggacttgaactcctgacctcaagtgatccactcaccttggcttcccaaaatgctgggattacaggcacgagccacagtgccccgccagttatctttctttggctacacctttttgaggtaggactttcataccactgggcaatagcaactgaatataggaatgaacttaatatttctcatacatgaagattatggcatttcatttctatttgtgaagtgggcacggatatattaaaaatatagaaaaccttactgttctcatttaaaattttttcacgatatacatcacatttcatacaaaatgaaaatatgtattgctcgattttgatatatcttgtacttgattgtcaattaaaatgaattaatttttgtattgaaaaatttagtaataaaaactgagaatgtgaactacacacccatatacgtgcacaacaaaagcttaacatggtatctataataagcctacagagttcttttaaactaaacataatagttgccaaaagggattcatagcttttgaattgatttaaaattaacctccctgtcacttccaaatgaatttccatttatgtaacataaaattgtcccatgacaaaactttcagccggaatacatttattccttcttgagtctatcatttgcaaagcactatggtgtgccacttggaaagggatctaaattagaatttttcccaaaagccataaccaggtatatgacatgcagcattttaaagggtactcttgaattcattttgatgcctgtactcacttgagcacatatgttttacaactttgaagacctccctctcttagctgggttctagctcacacaatgctccagcattgaagatgttgaaaaaagatgtgtctgaatattcacacacacacaagtgataatacctacataatactgggttgatggtttattaaaacacaagaagcatctaaactgccccacaaatatcatgcatatttagaaataccagattcattttgcatatcttgtggattccttatacagcaccctctctcccccctgtttgtgtgtgtatgtgtgtgtgtgttaatgtgtgtgtctgtgtgtagatgtgtagaaggaatctagtatttctaaattcacatgataattgtggggcattttagatgctttttgtgattgaataaaccattaacacagtattgtgtaagtagaattattcacattttgcagataagaaaactgagatttagtaagttttttgtccaaagctataaccgagattttaaagtcctgtgacgttaaaccctaaaacatatgcttttagtatcataatctttaccatggttaccagatgacatgttaaaaatctgctaagtaaaggataggacaccaataacccaaattattaaatgctatctaggtttaagtgagggcttccatcaatactgagaaaactttgcctgcatgcacccttgctacttaccaattaacagcatcgccgttatatatgagcttgttaagtaagatgttgaatactggccgggtgtggtggctcacacttgtaatcccagaactttgggaggctgagggggttagatcacttgaggtcaggagttcgagaccagcctggccaacatggtgaaacaccgtctctactaaaaatacaaaaattagctgggtgtggtggtgggcgcctgtaatcccagctactctgggggctgaggcaggagaatcacttgaaccccggaggtggaggttgcagtgagccgagatcccaccactgcactccagccaccactgaactccagcctgggtgacagagcaagactctgtctccaaaaaaaaaaaaaaaaaaaaaaaaaaatgtcgaatgtcaggcacattccaaacctactgaaacagactctaaaatttaacaagaaccccagattatttagacacagttatgtatgcaacagctatattctacaggtgtaacaagaaacaaagctaaggaccaatctaaacatttcctaaggaaaaaaaaggagggcaatacctttacttattcctttattactttcaaaaagattttataatgatttgctaaattctgttcgccctgatcagataatatgtctgcatctaagttaaaaaaatccagaatcaaaatcaaacttgtaaaattcttgttttcaagcttattttttaaatgaacatagagaattgtatgtatttattgtgttcaacatgatggtttgaagtacatatacattgtgatatggttaaatctagctaattaacaaatgcattccctcacatgttatcatttaacatccactctcttagtatttttcatttgaaaaaaattaggttgagcatccctaatccaaaaatacacactctgaaatgctccaaaatctgaaactttttgagcactgaaatgatgtcatacgtggaaaattggacatataagtatttaatgcaaactttttttcaagcacaaaactgctaaaaatactgtataaaattacctcaaagttacgtgtataaagtgcaggaaaacataagtgaatttgtgtttagtcttgggtcccatgcccaagataccttattatgtatatgtaagcattccataaaatcccaaatctgaaacacttcaggtcccaagcattttggataaggaatactcaatccgtatcatcattaactatagtcaccatattgtacaatagatctcttgattttatttctcatatctaactgtaaatatgtattatttaaccgttatcttcataatcctccctctctcttaactacctcaccttctggtaaccaacattttattctctactttaaaatcaaccttttcagattccgcataaagtaagataacgtggtattttttctttctctgcctggcttatttaacttaatatcctccaggttcattcatgttgctgcaaatggcaggtttcattctcttcatggatgaacagtattctattgtgtacgtataccacattttttcttttattcattcaccagttgatggacccttaggttgattccatatctcagcaattgtgaatgtgctgcaataaacttgggtgtgcagatatctcttcaacgtgttgatttcatttcctttcggtatatagccagtagtgggactgctggatcatatgttagttctagttttaatttttttgagaaagcccctactgttttcaataatggttatattaattcacattcccaccaacggtgtgcaagggttcccttttctctaccttctcaggaacacttgttatcttttgccttcttgatgtcattctaacaggtttgagttgatatctcactgtggatttatttacatttacctgatgtttaatgatgctgaacatgttttcgtattcctgttggctatgtgaatgtcttctcttgagaaatgcctgctcagatcttttgctcatttttaattgggttatttgttttcttgctatttatttgtttgagttactgatctattttggctactaaccccttataagatgtatggtgtacaaatatttcatcccattctgtaggttttctcttcactctgttgattctttcctttactgtgcagaactttttgagtttgatgtaatcccatttgtctatatttggttttgtttcctgtgcttttgaggtcatatccagaaaatttttgcccagatcatagtcatggagacttcccttatgtttccttctggtagtcttatagtttcaggtcttacgtttatgcctttaatccattatgagttaatttttgtacatggtctgatataagggtctaattttttctgcatgtggatatctattttttccagcaccatttattgagaagattgttcttttcgcattggatatacctggtaccattgttgaaaatcagctggctataattctgtggatttatttctggcctctgttttattccattggtctatgtgtctgtttttatgccagcaccatctgttttggttaccatagctttgtagtatattttggtgtcaagtagtgtgatgacaccagttttgttctttttgctcaacattattttgggtcttcaagctcttttgtggttccaatttctgtaaaaaatgtcactggtgttttgataaagattgcattgactgtagaaagctttgggtagtgtaggaattttaacaatattaattcttccaatacatgaacacagaatacctttccatttatttgtggcttcttcaattgctttcatcaatgtcttacagtttccaggtctttcacttctttggttaaatttattcctttttttgtgggggcgggtggacagaggacagagtcttgctctgtcgcccagtctggagtgcagtgtcatgatctctgctcactgcaacctctgcctcctggattccagcgattctcatgcctcggccacccaggtagctgggattacaggtgtgtgcctccacattaggctaatttttgtatttttagtagagacagggcttcaccacgttggtcagtctggtttcaaactcctgacctcaggtgatccgccaacctcggcctcccaaagtgatgggattacaggcgtgagccaccgtgcccggccagttcctaagtattttttgtagctattgtaaatgggattttttaaaaatttattttttattttccctaagttattggggtacaggtggtatttgattgcatgactaagttctttagtggtgatttgtgagattttggtgcacccatcacccaagcagtatacacagcaccgtatttgtagtcttttatcccttgcctcccccaactcttctccccaagtccccaaagtccattgtattattcttatgcctttgtgttcttatagcttatctcctacatatcagtgagaacacacgatgtttggttttccattcctgagttacttcacttagaataatagtctccaatctcatccaggtcactgcaaatgctgttaatttcttcctttttgtggccacagttataccacagtttctctttatccactcgttgattgatgggcctttgggttggttccacgattttgcaattgcgctttgtgttgctgtaaacttgtgtgtgcaagtatcttttacatataataacttatttttgtctgggtagatatctggtagtgggattgctgaatcaaatggtagttctacttttagttatttaaggaatctccacactgttttccatagcggttgtatactagtctacatccccaccagcagtgtagaagtgttccctgatcaccacatccatgccaacatctaccgttttttgattttttgattatggccattcttgcaggagtaaggtggtatcacatcgtggttttgatttgcatttccctgatcattagtgatgttgagcattttttcatatgtttgttggccatctgtagatcttctttagggaattgtctattcatatccttagaacactttttgatgggattgtttgtttccttcttactgatttgtttgtgttcattgtagattctggatattagtcctctgtcagatgtatagattgtgaagattttctaccgctctgtgtgttgtctgtttgtttactctgctgactgttccttttgccctgcaaaagctctttagtttcattaggccccagctatttatctttgtttttactgcatttgcttttgggttcttggtcatgaaatccttgcctaagccaatgtctagaagggtttttccaatgttatcttctagaatttttatagtttcaggtctggatttctttttcagatagattgctatgggaatgctactgatatgttgattttgtatcctgcaattttactgaatttgtttattatttctaacagtttttggtggaattttttacaccagtcaaaatggctattattaaaaaacaaataaacaaaaaaatctccacatgttggcaaggatatggagaaaagacaatgcttaaatacggttggtgacaatgtaaattagtacatctatgaaaaatagaatggagatttctctaagaattaaaaatagagctaccatttgatatagtattctcacaactgggtatctacccaaatgaaaagaaataattatattaaaaagatacctcactcatatgtttactgcagcactattcacaatagcaaatatatagaatttacttaagttgattggatgaggaaaatgtggtatatatacacaataaaacattatttagccacaaaaggaataaaatcatgtcttttgcaacaacatggatggaaccggaggccattatcttaagtgaaacaattcagacactgaaagacaaatactgcatgttctcacttacatgtgggagcaaaataatgtgtacatttgaaagtagagtgtggaatgattgacaatggggaatcagaagggtggaggcatgggagggggttgtatgatgagaaattacttaatgtgtacaatgcatattattcaggtgatgaatgccctaaaataaaattacacttgtattccttaaatatatacaaataacatttttaaaaataaaaataggggttctataacattatgtcatcggcacacagggataacttaacttctttttttcctatttggatgccttttgtttattcttcttgcctaattacttccaggactgtgttgaatagaagtggagacagtgagtatcctcgtcttgtgccagatcttagaggaaaagctttcaacttttccccatccagtataattcttgctttattgaagaaaatgccatacttctgtcaaccactggtatagacagctgattatataagttggatcttattaataagtgagaaagtcagcaaaattaaagtgttgctgctttttatataattttaaaggattccgaaaacaatatgattacgataaaatctgaaaaaagtaaatggatatctataccagtttgctcagaactatataaggatggtatcaggttagcttggtcaaatacaagtacataacaaaaaagtaaaataaatatttttaaggctgagttcaactcaagctatttctactctgagtttgcaagtttagttatttgatttcaaatgatccttttgcttggtttgattttccccgaaatggtcaattgtgaataaattgtttgatttgattcgtagttttttaactgagtaggcaaggtctcagatttacttctcttgaagactaataaagaagacattaatatctaacctgtttacaggaacagagtttcttgagcacagctgagcttcccaaatgccatagaaacaaaacgaaatggaagaatttatctggtaggagtgtattttgatgtgacctaatagaattcaatgaagcttcattttataacttgctatacaattaatatatattgacaagccctagtgtcttcaagtcatgcataaaatgcttttgaaacaaattatcagcatttatttgtgagttaaataacttttctaagtgtatcatgagaaatgggttaaacacaactttttggcatattcttcctgctaccacttaaaaaagcacatcatttgtatatttcattttcaaatatgtgacttccttcctgttcatgatttaatccatatttttaaacataaaataagctagcttaacttttattacaacagaagtctgtttatctggagtgaggttttaaatatagacatttttgctccttcagtattgttttaaactaatgcatttcaataagactagtttattatacattgtactgatagttaaagtaactgttaatggctattttttcagggctctgaaaagtaaaaaaaaaaaaagaaaaatcactacccgaaatatcattcttaggaaaaagctgggagttaattggaaagtgaatagaaacactcactctgaatagtcaaaactgatgaaattaataaaactacatatgttgcatttatttatgttctttgttaataatcagtcactaaacctataatttttccattattcacttaccaaaaaataaaaggaaaatttagaaggtgaactagatctattctgtgttgttgtcttgttctgctgaagttatgaatgatttgtgatgaagtccaagtatgggcctcagtctagagaactggctggccaaaacaactatgaattttaacagaattgcatgaagtgctagaatctcagtttaaatgaatgcagtggctacttctaaatagtcagtagactctactttgtatcatagaagtaatacttgtaaatttacaactttgttgatgagttttgcatgattccacatttttaaagaaaaatttgctaaactgaacatatttttgtaatccattaagaacagaatgaaaactgaataacaatatgatctatgttgtacccaaaacctaatgtattttcctgtaaaaaaataaaaatctagcttctgtaactaggaacactacaaaactgaaactgtagactctttaatttcagggttcatgaaggaatttttttccatactgacatgttacattaatactctaggaattaatgttagaagtatttgaactagtattcaatatatgttaatgaaatgtagtacatatccccattggttgtgacctaatcgtttttaaatacgtacattacatttgatagatgctcaattatgaatcctgctttttcaaggtggaatatctgagaaacttgtttcactgatcaaatgtcctgatgtgatattaagatacagtactaaacagcctgaggcagtgagcatttagtctaatctggccagtgcagaacacacctgggcctccctggggttgctgtggtgaccattctgccatctagtcctcagcatcatcagggtcaacaagctaacagtggcaacagagttgtttcatttatacagttccagtgatatcgttgccttcctggctgtgttgtgtttctaatgttgctcctagctctttgccaccatttctaattcttctgctccccaagagtctttgatattatctttagtgtggcccttactgtttaccctagagatagtgaattctgttacttgacaatttaggacactgatgaacagaataaagtataattgtatcaatgtctataagtagccatttaaaaatttatacataagaatcattctctcaggcattaaatgaaattagagaaattatttcatttttggttttttttgcttgtttgtttgttttgttttgtttttttgagatggaatctcgctctgttgcccaggctggagtgtggtggcgcgacctcagctcactgcaacgtccaccttccgggttcaagagactctcctgcctcagcctcctgaatagctgggattacaggcgcacaccaccacccccagctaatttttgtagttttagtagagacggggcttcaccatgcttgtcaggctggtctcgaactcctgacctcatgatctgcccacctcagcttcccaaagtgctggcattacgggcatgagccaccatgcccggccaattatctcggtcttcaaactctgttttagtacttaaacaaagccttaaactgcttcaagaacactgaatgataaatgaattattctacattgaaaatgaacttttatcaattttagttgaatatggtttcttcttccttgagtccagttaaaggtagcttgggagcaatactcaagtcacatcacatgtagttaaacttttatattccgaatcagtcctttaagtaagacagccaggggttgataaactaaccaaaatcctatccgtcacatccattacaagcattacaatgtaacagataacctgaattttcttatatattttgtttcttatattcttaaaatttagtagcaaatacatgttcattcaatttgcctattgaaaatttatcatatttagctttggggaaatatttttaatttttgagattgaaatataaaatactctgttagtacaattcctagaatatatttaacttctgtactccatatgtttagaagaatgagaagtgtattgaaaattgtatcttatagttgttctactataaaaccaattgtaaatatcattcaatggataaattattattatcattgttgttattgttatttaatcccaaattggtctacttaatgtggctaaaatttctcatagactctaattcagaaaatatattttgttttaagttatttgcactaactacttgtgatagatatttaaaaatatatgtgactcatcctgaatagtgattttatgcacagctgtagatgcaaatgaagtatatttattaactaacaaatgctataagcatttttatgttggtaaattaagactgggttgcatgatagttgaatttaattcatagaacacaattatcaactaccctaaaataatttacataactatgacaagttatatcaaaatttactctcaaattaagttggttattcaaaatattcatttttatgtccattctgtataaatacaagtgattgccatactgtaagactcatgctcataatggagaataaataatattttattgtatttatttatttatttacttatttatttttttgagatggagcctcgctctgtggcccaggctggagtgcggtggcgcgatctcagctcactgtaagctccgcctcccgggttcacaccattctcctgcctcagcctccccagtagctgcgactacaggcacccgccaccacgcctgactaattttttgtatttttagtatagacgtggtttcaccgtgttagccaggatggtctcgatctcctgacctcatgatccgcccacctcagcctcccaaagtgctgggattacaggcgtgagccactgcgcctggccgcgagaataaataatattttctaagaaaattaacttttaatttttcacctaaaaatcctaattttccatttttttctatgaggaaattatcattattttatttttgttttaaaaacaagtttcacagataggagtatgttgtgtgctctattttattttttcacccatttttattctcacattttatttttagtaaaactaattgtcatttttttacagaccagaaactctgaaaattagaaagtgacattcatgaatgtagttattaaaaaatactctccatctttcacaggaataaatgttagaagtatgcttatttatggcataattaccagaggaagagaaaattatcctatcaattgaattttatctagaaaatgaaaagtattgttagtaattcctcagtaaatgatacagctatacataataatatataactctaatttagatatgttcttaacgatttgctgaaacaacccagaaatgattgatccagaatcatgagcaaattagataaatcattggcaacaacttaaaaaatcaacaatttgaaaattaaaattatttttggtatatagtatgtgccaagcttagtattaaacataaagccaataaatgcaattcagcatgtgaaaatgtaactttgaattaggaaaattgcagaatgcagagggttgtatttattactctatgtttcttcaatcttgttattgacagaaatttgtatgtatagaaagctgtatgaaaataagtaactttccatacaaagcccaaataaccaccctttattatcgctcaaatttatttatttttatttatttatttttgagatggagttttgctcttgttgcccaggctggagtgcaatggcacaatctcggctcattgcgacctccacctcctgggttcaagccattctcctgcctcagcctccctagtagctgggatgacaggcatctgccaccacacctggctaatttttgtattttcagtagagaccgggtttcaccacgttggccaggctggtctcgaactcctgaccttaggtgatctgcccaccttggcctcccaaagtgctggtattacaggcatgagccaccatgcctggccaattgctctcatttaaattcaaattatgtagcatttatgctccccatatcattattgcatttacttcataagacatacttacataaatttgatttgattgggatattacttacgacattatgttaaagatacattgcactcttggcctgcccatttttaacaacgtaggaaacagctgcaaacactccttactcctgcaaaaatgcaaggaattgaaaataacctatgtccaatcatgttgcacttttgcaaacattccctacctctccccaaatgaagtaacacagttttgaataatttcttcatcatttcttttctttttatatgtttattaaacacacacatattattcctaaagactaaaattttattttcaatatgtttggctttatggagatgatatttaccatgtagtatgttccattcaggtatcaagggatactgtactcagagaatgcaccatctgacatttttattaaatttattggatttaatattgggttttttgaattataatgttggatttatttttttctttggatattatactgctaacattcatcgatattgttttgtgttgttgtggttcttttttcagttctgtataatagcccacatagtagtaaactattcattatatatatatatatatatatatatatcaatgtacacttgtatgtatgtatgtgtgtgtatgtgtgtattagaacagtggtccccaacctttttggcactagggaacagttttgtggaagacaattattccacagacaggggtttgggggaggtgaaaatctgggggtataggggttgtggtttggggttgaaactgttccacctcagctcattaggcattagattcatataaggagcctgcaacttatttccctcacatgcgcagttcacagtagggttggctctcctatgagaatctaatgctgccactgatatgacaggaggcagagctcaggcagtaatgtttgctcaccttctgctcacctcctgctgtgcagctgggttcctaacaggccacagaccagtaccggtccttggcccaggggttggggacccttgtattagaagacacacatatacaaaaccattacaaatcacaaacatatatacatatatacaaacacatatataaatacgtattgtctatttttaattcaaggtaagttttggcaaatagaaagtaatgctttcttaactatcatatttattcaaatatatggaaatttgcctccaaatatcaaatttgttaaacaggtggagaatagaagtaactattcatatcaaaaccatttaaaatataaatataattatcaaaactctactatatattctaaattatatattttttatttgtgcagaggaatgcagttgtaaagaaaataaataaatttatattttgaaatggggcaaaaaagatgtcaaatattgagatataaaaagtagtaccagataaaagatgcatagataaccctaagaatgagaatcacattttatatgtagggctaagccatttcctatatatattttctggctgactaattagcaatggtaaagatcaagttttacatcaatgctttcaaatcatggtgtttattttttctacttgctgagcccgtactttggaattatatattactatattttattgtgtgccctcttgaatgtatttattcatgtagcaaaaataaaaattaattaattaataagataaaggtaattatgtaagattaagaaagtcacagaaacatagaaactgacctaagttagtgcgtactataataaaacctacttatttctttgtctatgtctaaaaatgcatttctttctctatgtctaaaaatgcacaattcaaattccagataaactctagacctgcccatccagtttcctcctctttgtcaacagaactccaattccattcgggtatcaagggagactgtgcacaagcaatgtactcatcccaaagaacaaatcatgattggccaggctaatcatgttgatcctgttctttttctgccagggactgcctggaatggagtgaaattgagatgcctaaaccaatgacagaaaagctacctctgcactccttgctacatgaaataattcaccttttttcccgagctacatttatctggtattcaggtatatagtgttacatgcaatagatatatgaccatcagtgttatatgcagtagatatatgaccaatctagttttttaatataatggtatattggatattttttatactatcaagggattcttctccccagagataccaactgagaaaacctgtggttggcagtgcaggtggcttgtgggccacatcttgagaaaataatgtcttaaaggaattccagtgaaataaataaataaggaaaatatgtttagtttaacttgtgaagaaagcagcaaatgttaatgtgtgaaataagaactttctagttggggatacccttagagctacaatagtttacatttactgaggattcaaacaattccaactgaaatagaaagcaattttatgtcaatacttaaactactcaagcatttagaacatgttactaaaatgttagtatataatctctgaggtagcctataaaaatgtttcagctttctttttacaaatggaaataaatatcttgaagatgaagctagaaacagcgttttctcgtgttcaagaggcatggtattgagaaacaatttacagaatgaaatgagtgaaagaggaagctacagtcagatattttgagatgatttacaggaaagcataaaacaaacaaaaataaaacaaaacaaaaacaaggcagctaccagagagagatactgacagatttttttcttaagtactatctccttttgtcttttagtggggtctatccacctcactcacttcctttagcttaagttgccttccctttaccaaattttgcctcttatcattaacagccacctatctgtcttctctctgctctccacagggctttctttgttccttgaacttgcaaagggacagttaactaatctcattaatggacatgacatttaaaacttgatgttctacattctttgctttaaaacatgtggcattcatgttagccttaggaagaactagtcctccctgagaatgtaggggatttggggttgaatggggggggtgacaggtgactcatcacatcctggagaggatccaatgccacattggtttgcattttgctattcacaagtcactatgataatttcgctacttaaaaaatgatataccatctgaaatttttattaaagcaatatatacatacacacacatttagaagatcatcacacaaataaccatttatttgcttagcttaatgttgcttaggtatttcctcataagggaaaaacccagaatcagtcatttatatttatatttaaaatgtgaaagaaacttcttacatgtttgtatatgacagcaacaatgctaaattttttcttgattcactttagccaataatactttctgttatgatttagttggataattctggattatgagtcagtttgaaatgaggccatgacaaaaataaaatcaaagtaaaactaaaaatatcgaacatcaagagagtatccatctcctaagggtttgaggtgatgagtatcccaattatcctgatttgatcattatacattacataaacacagcaaaatcttatgtgacctcaaaatatgtacaactattatgtatcaataaaaggatccacctcctattgagaaactatacttgaacccattttagtatgtatatgtcaggtacatactgcaaataataattggaactttggtatggaccaagaataatgaatggacatttatctacaggtttatttagacatattagttcttgataacaattgattatgaagacacgaactacttctactaatttaatagaactagagaatcagggaaagacaagctgtatagaatttaaagtggaagaatttattatagagttaaagcttcatccattttattaatgctaaaaatagatacatttatcattatagagtcaaacaaaaaaatttcaatgagtgaattttaatgtactgtagactgtggagatattgaaagtttaactgaagaaaatctgtctagctttacttctcatccattaaatagagcaagtatgcttggcaaaagaatacctaaaaaaatttccagtcccttctctaagtgacaaaattctgatggcctctcgatattttacaacaggtataagcggttatgaagtaaaaatatcaccgtctctgatggtcatctagtctctaatgagggaaaccaataaatccataaatactaatgaaatttttcaaactctaatccccattcttagttatcaatttttgttattttaatagtaatttattcatgtataaaactggaaaatcccatcattaattagcaatagctctttattaatattttaaaatagtttccaaactaaactcttaatatgcctaatgtcatgatccctttaatgagaaactagccattaaaagaaaatagcttatactcatttctatatataagtacatattattttgtaaacagttagcagaaaatttcaccgttaaaaatgaaatattttccatttttgcatttgaatatctgagaatatgttcccgatattcttgccagtttataaacctatattttaacagtactggtaatgcttaattatacacaaatttgctttatttcacatcacaaggctttgtttgtctggagcatacactattgtttacactgtacagttctttttgttacgatttggatgcttttaaaagagattttaaatatttgctctcaggtttattaaaaaacatagacttgaaaaaagatatgatatattcaattataaaaattgtattaacaaattctaaaagtttatcattatcctaaaatttggggtctggggcaaattagagatatgcaaaaatggttagcaaatttttgaatgtgtcttagaaaaaaaattttcacttgcgaccttaggcttttccccctatattttgatatagacttcacaatatagttcttataatagtggggagatacaaaacatttgaaatcaattttaattgacaactttaagatttattatttgatgtgatgattcgaaagaaataaatcagagaaaaaacagcatgctaaaatgtaaatcttatacagactgattgctttggtaaatatataaaataataagagttattaaaacttgtttagaaaaacccaaaatttggacaagattgaggaacaaaggtggttttggataaaggttttgatttcatgagttaaatttttttttcttcttattgcaaaatgtgatggtctattcatatgattttcatatgacaaaagctcctttagtaacctaaaagatatttgaatgattttaagaaatagtttgacataaaatagaacacctcacgtgtgcaattacaccattttattttcttatatattatccttctttatatttgtgcattattttataatgtggagaggttatattacttttgaatatctattatatgtttacacataaacacagagaatgcacagtaagtgatatctatggcactctattgaaagtaaattcttggtgtaacactcttgatcatgaacagatatttaccaactatcaagaaaaacttaagacattgagcaaatgtcattagttaagtcattcaaatcacctcatatttaacaaatctaagtggaagtccaaggggaattccaaataaacatcactgttatactgaatgtagtcaatagagaattattatatcattggagttaaatgaacacatccattacatttctaaataaatgtgggaagtgctttttatcccagacggaataacaatgctaaaggagattgtcatccgtattttataggaaaggtactccagaaatgtttatgttgctaacaatcaaatttactaatattagtcaaacttgaccatataaatcggatttatataatccatatcttaaaattctaacttcttaacaaataccacttgattattttaaaaccatagatgaaaagaacactgagagggaggtttagaagcaggatatatgtatgattttgatgcttcaataactgcaaagccttggacaattcacctctgtgtttccccagatttcatatctgtaaacagactagatgatctctcaaaagaattccacatctaaaactctctttttctgtgtcctgcctttcagtatttttcctttaattgaatcatttattttcttctttgatcttatgcaatgctacaataaaaacaaaaacaaagccaatttgataaaatatcacattctctattagtgatttttgttatctgagctgttacaaaagtggttggatttattccacaaattaggccatccatacctgcctttctgtaatcatatgcatgaagaaagaaaaacttcacaacttgtgtaggagtctaatttttcaatttagtattgacagtctgaccatgggtttgagtgaaagtttagattttgtagatactttggtttcctgataatctcaaaagctcagttatactttataatatttatgtttacaatcaagaaagtctttacatatatttctataataagctataaatattatcaccttctctgaattgtctaattattgtccttctgcatagacaagctagcatgctatacatcatatggataaagccacaaatttcttgccagataattttgaactagtttcaaatattagcaaatatattagggacaatttcatgtcaaaacattgagtagtcatgatataataaagtataatagacaattcctaatgtttaaaaattagtattcaacagtcacagaaagaggaaattatgctttagtttgatggtaacaccatcctagcgtcaagcatggttacatttctcttaatatttttcctagaaaagcgtggcttctagcttatttgattaatacaaatccttcaaaatctttttattctgttctaggatgagaggaaatataacatttatattttaaattaatcataaactatacattaatcttgatttaaaatagaaacctacttttcaaccgagaatgtacacctgtcatctcaaaagaaggtatatttacatattaattttatatttcagatataaacatttattaaattctcattttttgtttcacctgaactaacatgtagttagagaaatacattttagaaaaaattaatagtaagtgtatcttactcaaaataattcactctagattttctcaattattaaatggcaagtgcaatgtttcttctttacagtattatgatattgttactatgcagaccactattcatttttcctgttacttcctataactgagtttcttctttagtattaataaaatgcaacatctatatctcttcagcccctttgtaaacgtgtaacggagtaacacatcttgaacaattctagtcaccattttacgatatgtgcaaaaattcagggactgtaagtataacctacctacaatttttctattttcagaaagccatacttgctcttttggtgtgatcaaggggtttctggagaccgagaagggaaaatgtgtccatttctgagaaacactcactgtaggaaagaaggtgctatttgcatttaatgtaaataccactttcgttccttttaattaaaagagaaacagaaacccttctatattctaaacataaaaaataaaagttttttctcaatatggtagttgattgcaaagaccattctgtatgtagagatggtcctccctccaattttttttagcatcatgctattttcatttagaaaggtcacatgagtcttttgctgaaaccaatgtgattttcctaataagctcaccatgctaagtgatccaacagaattgctctgtttgttaataaggagagtaaatgacattacttgacagaaacgctctttcaatggtggtttattccaagagattaattcatccttacttgtccagtgtcacatatacgttattaaatatgcaatgtagcatccttcttattcaattatgataatttgctgttttattaatacttggaaataaaatatatcactccatccattagtaatcacggtgatgaaactatgtgataccatattagaagcaagtccaaggtattagagatccatgttcaacttctataaaatggtaagttcgataagccattttgcacagttatatttttccaagcttcttgtccttcagatttagttagtggtcaattcactattagaggaatgtaattattttctggttggcactgaggatgagtaagacaaaaatcaccctatcactgaaggtgccatagcctcaaataccctactcactccagctgcatttatatagaggctctcagttgcacaaaagatcaaactgttgtatctaaagatcaagccagaatgcttttcaaacattagatccttcccaaagcaattctttgtgtaaccagtttccaaaaaagtctgaggaaaaatttccattgtttcctatcgttattagactgttgggtcctactgacgtaataaatatacaaatcactattgtttcagcacaatgttttatgcatgacattttaagaactgtacaaaacacaatattaaaattctgaagtgaaaaataatagcattatggctcattacattctatattgtggtagtttgaactgtgagtaactgtactgtcatcctgtcaactcactttaaaagatccgctatattgttttacacaatgtcatttatttcacaggtataactataccaaagtgttccggtttggaaacatagtgtaaatgtttaaaaatattttcacacagttacctgaaaaatacttgcactgaaagctaatcatcagttacagaaccaccaacaaaagttctgctactacaaatagttttgatgaaacaagacaaacaacgtactaaacattttggaataatttttcaatattattattaccttctgatttgttcttagactttaaagattccctaaaatattggtaaatgatgatggaaacctttttctaaaaatattgctttgatggtaaaacgactggcaacaaaatgacagaagatagccctagagatgcctttctccactttatcctagtatgtctttagagccctgatataaatatatatgatattccaagaccctttgctttcatcattttacacagtcactcctacagaagctttcctcataactgtaggatcatctgccgctgatggtttgttcggatcttaattgtcttatgtagtacatactcaattaaaactcatgctggagcaggactgtctagactttggtaactgcttattaaatagttaagatgttgtatgaggagcaagtgacaaattagcaaacatatatgaggctttgaataacagccagagtaataccaggctgaattaattaccatgttaaatatatgcagaatgggaaaataaaatacctgctatgatatggacaaaacttatcttaatatacttgtttgaagatgggcgcttccaaaggaagctcatgagcatatggcgctttactgtgcgtttaaaaaattgtgctaaaaacatgttttgtcctagtaaatgtttttttaaaaatagactttgttttttagaggagttttacgttcacagcaggactaagtggaaggaagagaggtttctcatataccatctagccctacgaacatacagcttcccccaccatcaaaacttcataccacaatggtatgttacaattgatgagcctacattgatacaatgtcagccaaagtccatagattacattaggtttcactcagtgttgtacatgctataggtttgggcaagtattcaacgatgtgtccaccactatagaatcatacaggttgaacatctcaaatctaaaaatctaaaattcaaatgctccaaaattcaaaacttttgaagtgctgataagatgtccaaagcaaatgctcattggagcattttggatttcaaattttcagatttgggatgctcaactggtaagtgtaatgtaaatatttcaaaatcgccccccccccccaaaaaaaaaaaggaaatctgaaacacttctggtcgcaagcatttcggataatatataatcactgccttaaagatcttctgtaatctgtctatacattccacctcctgccgcaacccctggcaaccactgaaaccactcatctgtttactgtgatcatagttttgccatttctagaatgccacatagtcgaaattcaacagtatgtaaccctttcaaattagcttctttcacttagtaatatgcacttacagttcccccatatttgttggtcttttttcatggctttatagctcatttcaaaggtcctgaataatattctattggctgcatgtacctgttcattcattcattcactcacctatggaaggagagcttgattgtttacaagtttggtcaattatgaataattataaatatttgcactcaggtttttgtgtggatatgttttaagcttatctgggtaaataccaaggagtacaattgctagatcatatgataagtgtgtgtttagttttgtgagaaactgccaaattgttttccaaagaggctgtacccttttgcattcccaccagcaatgaaagagattttgttgttacataacctggtcagcatttgatgttgtcagtgttttggattttggccattctaagaggtgcttaacaggtaaatatttttaagtaacaataatgatgctttcttaaaaagattttaaaaaaattcttcaagaatcagcgacacactcctaaaatccaaatactgaacaggagtgcatgttcacattctccagtccagttacttttcagtaacatagacaacagcactgccctactaaaaatcttcaagtgatgtgttctcaaaacatcatcagagaattaaaattagcgaagacaagagaaaaataataacctctgaatcaaatagataccttttaaagggatagtcattactgttacaaaatatagagaagattgtatacttgctattatatttacataaatattattaggaaactcatcaaatgcctcactgagaatttaaaaagtattttgtatcagctttatataaaagcctatcaaaagtgaaatgggattaatttactattacacattcttattcattctgttttcttgctcatcactttatacaattatatatttttaaaaagtacttattgcctttgtattttgtcgatgataggttgtaaggtactgtagtacagaagctgcatctatgcctgtgtgtctcctaaacagtcattgattcaattaatatttgtggacctgttttccagctatcatgctagtttccagaagtatgatcaaaaattacaacaaaagcgatccacacttacacacacaacagcagtcctaattctcaagaacctgtattatagacagtaatatagatacataaaaacaattaaaattcagctttaataagagaaacctctggtgtttggttttatgttaattgtactgtgtcatgatagtatgtgtgtatttttccctaaacataatgatcctagtttgtcttctattagtattttagtagtatatgcctgaatgtgagttttaatttgacattgtaaagtcaataaataacgggagattaaatataaaacatttaaacctcttcagttaagatggcatggaaatttcatgacttgacacttatttaatatatagaagaataagaaagaaaatataaaaaaagaaagagtgttataacacagtaggacttagacacaatcttggcacctccacatatcagacacagtagctgcagtcctgacagactattttccccccatgggtagtggcttcgcatttagattccttcactaagagtccacatgtacaggataaactagaattaagatcactgcttgaagtcacaagttatggcaaaagttcacccagcaatcattcttgaaaagaaaaatgtcttaaaaattttgctgacctgctgcctgagagcctattatgttaggaatctgttacactagagatacgggaagaacacacacacacacacacacacacacacacacacacacacgccatgaaggcagaagcagcccaaaacaaatgaatttgagtactgaatcttcaatatttctaattaattatcaccacaaacagcactccacgtggtagtagactatctgaatctaggcagctattccaggggccagatggggacaacagcaaagtggtggaacagatataataaacacaatgacaataaaagcaaacccttttactctaaatgctccagaaatctgtgaataaataaaggcctaaaaaaggcagaaaaccaccaccaccaccaccaccaccaccaccacaaccacaatgattcaaccatgagttcagtctagatgaaattattctcatatagatgtctgaagaacatttttaaataatatgtttagaattctcaacaataaaattaaaagataaaactcaataaaaagaacaagtagttataaaacaaaagcatgtagaaattaaaataatttcatattgagaagaaaaaagctataaatgttggaaatgaaaaatgtagtaaatgaatcaattttaaagaaataaacagcttaagtatctggattgaacaagaagataaaattagtgaattagaagatactaatgaagaattcatccagaacgtaacacagggaggcaagtaaatgttaaaaataaaatactaaggacataaaagatggacaatattatacgacaataagagttcctaaagaagagaatgaatggaattgcagagaagccagatttaaagataatggctgataattttatagaactgatgatagacaaagggcaaggtttatctaagaaagttttgaagaaaaacaagttagggtgtctggccctaccacatgtcagggctaaatataaatctatggtaattgagacatattatagtactggcacaggaattggcaaatgaagaacagaacaaaaaaagatgcccagaaatactaatgtacatactaatctaatgtacatgtatatactaatctcgatgcaaaacagaggtgacactacaggtgaatagagaaaaggtagacatttaaacaatgatggtaggacagttatttactctaaaataattcacaaaattattcactattcacaaaaaaacccctaaaaattatttccaagtttatttagagaccgatgagtgaaagggaaaaactgtaatacctaaagaattacatgaaaataagaaatagaccaaaagtcaattgaaaaattggcaaaggacatgaacagatgattcagagcaggaaataataaagggtcaatgaatataaaagatacattgatcaaaaaacaaatgagatataatttcatactcatcaaattgataaaaattataaagtgtcaatatctagttgataagaatttgaaaaatgggggatgcatacactactgttggaggcataaattggtaccaccattctaaaatcaagtacggcaaaatgttatattaatattatttttagtcatcctccagttgtttgacatatttcataataataaaatatatacatgtatcaaaatagctcaatttaaattagaaaatgaatatacatgacctatctttaagaactagtctgtatgtttaccatttccatttgaacattttttattcatttctcttatagatcctatatatttaatgtgttcttgcttttgctgttaaaggcaagactggagacttctttaaattacagtgctttatcaacatgcatcattttagattcacaagcatccttaaccagagtcagagagctttttaaaaaatatatatatatatatatagaaaactgctcccttttactttctgtgttatatggattttgagtttcttagttttgagctatggaattttctttctatgggtttattctttttaaaagtagtgctatttagatttccatttatatattgttctttagccccttaagcaaatcatcagacttaagggcaccattcataatactattattacatattattagtcaaatatctataaaaagatgaatatgacaccaagtgatagaatgtcatcagtctctctaaaaataatagtaataaaaatagtaatacaatcatacaagaagttgtttgctcaggttaaatttaatttataccctgaaataataagaattatattgctttgcacgtctgggaaacagaacttacaaaaaagggaaactgactcataaagtacttatattttaaaattatttatctaattctcatttgttcaacaaattgcacaaatatacaagttgaaaacagtataaaaataatcttacacttaagatcttctttcaaatctagtctaaacaagtctactggaagactttggatagtcttctatgttagtactttgcctctgctggatgaaagaacacaggcaatcaacacagttaatgaagaaaaatgtacatattatagtcattgtttggcctgtatatacatattggaacttactctgctaggataaattgcacaaatatacacgccttttctaaaataaatgcactgtcgagtccatggataaagtcctatccttgccagataataattctaaaaacaagaaaccaaaaataaaaaaataaaattttgaaaggaaataaaacttcatgtacctttcaagggagtaggtgacgaagatggtgctagaatgactctcagcctagggtggtgtgtcataagattagaaagatgtgttctaatctctgtaagccaagtggtagttcatcagcaaaaattatcagttcattgttaattcctggtttatttctctttcagtttttaccgcctaaagtcttgtttaaaacttttgactgggccagatttaagattacacatgttgttaaggggcaaggcaggtcctagtttaccctaggattagaatgttaagccaccaaccagcaaaataaccctagggacaaaataaagtcagttggatcagaattgaaactgaggggtctccactcttctttccccaaagaattttctccttcgttatgaatctggaggatatgtattttagtaaagataaaggttttttttttacatatattgattggagggcattcataatcaattttcaaagaaattagcattgaaggaaataaggagcaggttacaatttctttacagtcatagtaggttgtgggagagatgctggactataaactcccatattctgagcttgttatcctggcacagaaattatgatgacattgaaaaaaatattttcataatgtagtccattaaatttcatgtctacattatggaaactcagaggtttatggtcacataagagtgaaagggcaatcaaggagtaaggaaaaattatgcagaaaggagaaaagcaatgatgcttggtgagaacaatcatactaagtgtgagaacaaagatgatgtacctagttcagattttctagtcacttgaaatattactgacctctaaaacttagggggactttaggctgagtccaggaatttttttttccctaaagaactgtagacttggcaagtctatatttagtgtactcactgtttttctgaattttgcctagatcctgactgtcacaggtacagatgaattcaacacacccggagggctcttgttggaaacctgaagaatttccatgaaatctccaaaagtcaaaagatgccattattacaacactctagaggttggcaaactaccttttatttatttatttttttgctacaattgaaaataaaaccaacatgtattgttccataggccccttgtaaatttatttgtataaactgctgagaatttacgttaatgtcttttacttcttctttttgcatttcaattgaaatcctaggaaactttggcaataaaagatccaataagttattgataatttaaaaaatgattccatagcatcaacaaactatattaaattccaatatcccattctatgattcagtcttggcccatgtaaatctgtgatagaaaataagctgaaaataccaatatgggcagaacaaaatacgtaaagataaatctctcaatttttatatcatacgttccaggatatttaatgaaaaacactttgagtcctaagagtccatattaatagaattccacgttaaaactcctgaacttaatataagctttatcagcaacatagctttcagttaacataaaataaatgtaaataacattgacaggtcattttagtactaaatattagtgctttataagcaactaaattatttagtcagctttattccagataagaagacccttggatttattaaattatagattaaatactgatgtgtctgactattcctgagaaacaccgaagccccactatgtctagaatattgatatttactgaggttcatacataagtcgctatgctagtgagagattcaagatgaaactctagctttctctttattaaatcagccttggcctccccttatttttatgtaggtattgatttccttgatttgaagcaaactttcctcttttgagaaaaataaatcacaactcattgctttaccatctctcccacttcttctaccctaaagatagctgacaaggctggcaataaaaaggtagaaaaagtaaagagtcttacaacgtagatgatttttgacccaggaagtacaagtttaatataattaaaagtgcaatgttgaaatcagcaagagtttgtatttttgaattattcaaccccattatgttctctatagaaaaccaaagaaaaataaataaccaaaagagaagctgcaaaagtgtttcattgagtacagcgttcaatacctcgtcaaataggagttaaagatttagtgaaagttgaaagggtggttaacttgaaagaagatagttggaggcaatacaaatatgaattatgatgtttgcaggttttagaagaaagtcttggattttttcatcaaatgacagatgagagacgaagcattttttatttctgtaataaaaagtatgggtggctatactgtcacttaaatatttttaattgcgaagaaacatctcatcaagtaaaaagtagataagaataaacaagacgctaagcatagacagaaagtgtcctattttaatgcagaaaaaagttttcaataaaatccaacatcccttcatgataaaaaccctcaacagactaggcactgaaggaacatacctcaaaataataagaaccatctatgacaaatccatagccaacatcataccgaatgggcaaaagttggaacgattcccactgagaactggaacaaaacaaggatgcccactctcaccagttttattaaacatagtactggaagtcctagccacagcaattaggcaagagaaagaaataaaatgcatccaaatagaaaaagaagtcaaactatcttttttcactgacggtatgattctatacttagaaaacccaaagactccaccaaaaggctactagaactgataaacaattttaacgaggtttcaagatatacaatacataaaaatatatttttatagtaaaacatataaaaattaatagcatttctatacaacaataatgaccaagctgagagtcaaatgaagaacacaatcccatttacaatagccaaagaaaatgaaatacctaggaatacacctaaccaagatgctgaaagatctctgtaaggagtattaaaaaacattgttgaaagaaacacagataaacgaaaaagcattccatgctcattggaagaaacaatataattaaaatggctatactgcacaaaacaacttatagattcaatgctgtccttatcaaactaccaaggtcattcctcacagaattagaaaaaacaattctaaaattcatatgcaaccaaaaaaaaaaataaaagagcgcatatagccgaagccatcctaagcagcaagaacaaaattggaggcatcacactacagtacttcaccctacaataattcacaccacagtacatcacactatagaacttccaactatgctacaagactacagtagccaatacagcataatattggtacagaaacagacatatagaccaatggaacagaatagaaaacacagaaataaagccatacaccttcaaccagccttcgacaaggctggcaaaaacaagcaatggtaaaaggacttcctattcaataaatgatgccaggatcactggctagccatatgcagaagaatgaaacttgatccctaccttttgccatatacaaaaataaactcatggtggattaaagatattaatgtaagacctaaaactacaaatcctagaaacaaacctaggaaatgtccttcttgacattggcattggcaattttttttttttttttgacagagtctcactctgtcgcccaggctggagtacagtggtgtgatctggactcattgcaacctctgcctcctggggtcaaacagttctcctgcctcagcctcccaagtagctgggattacaggcgtctgccaccacacccggctaatttttgtatttttggtagagacagggttttgccacgttggtcaggctgctttcgaactcctggcttcgggtaatccacccaccttggtctcccaaagtgctgggattacaggcatgaggcactgcgcccggccggcaaagaatttttggctaagtccccaaaagtaattgtaacaaaaataaaaattgacaagagggacctaattaaactaaagagcttctgcacagccaaagaaactatcaacaaagtaaacagataatctacagaatgggagaaaatattcacaaactgtgcacctgacaaaagtctaatattaaaaaatggacaaaagacatgaacaaacacttctcaaaggaagacatgcaagcgaccaacaaacatacgaagaaatgctcatcatcattaatcatcagagaaatgaaaagcaaaaccacaatgagataccatctcacaccaaacagaatggctattatttaaaagtcaagaaaggctgagtgcagtggcttgcgcctgtaatcccagcactgtaggaggcttaggcaggaggatcatatgaggccaggagttcaagaccagactggccaaaatggtgaaaccccgactctagtaaaaatacaaaaattagctgggtgtggtggtacacatctgtaatcccagctgctagggaggctgcagcatgagaatcatttgaacccaggaggttgaggtgcagtgagccaggattgccccattgcactccagcctgggtgacaaaaaaaaaaaaaaaaaaaaaatcaaaagataaacgctggtgaggctgtagataaaagggagtgcttatacactgttggttggaatgtaaattatttcagcccccgtggcaagcagtttggagatttctcacagaacttaaaacagatctatcattcaattcagcaatcccattactgagtatatacccaaaggaaaatagatcattttatcaaaaagacacatgcactggtatgttctttgtcacacaattcacaatagcaaaaatatcgaatcaacctaaaagctcatcaatggttgactggataaagaaaatgtagtacatacacaccacggaatcctatgcagccataaaaaagaacaaaatcatgtcctttgcagcgacatggatggagctggaggacattatattaagcgaagtaatgcaagaacagaaaaccaaatgccacatgctctcacttataaatgggaactaaacattgagcacaacggacataaacatgagaacaacagacactgtggactactagagtggggagggaccggcggggaaggagttaaaagctacctattgggtactatgcttactatctgggtgcaatataccgttttaacaaatctgcatgtgtactccctgtatgtaaaataaaagttgaaattaaaaataaaagtgtcctactttaaagaaaacatgccaggcacctattacacagcaagtatcattattcgctcactacaattattttcagattgaggcaagttcatagttaaaaatttaattggggtgatataatacaatgtggtttgtttagtagtagattttattttaatagtgttatatatgacttaagtttatacaatcatcaagagtctgatggggtctctgtaattagccatactttactgcattttatgagtagaattatatgccttagtgatgtttgcaaattcggagttttgcaaagatcttgggacaaataccctggggctcttcagagtctaatatatacgtaaaataaaaggtcataataaataaaatcatatggagcttatatatatgtatatatatataatcacagatttataatgattaccaagtggatcgtagctataagtgatttaacaggggcaatgctttctttactctaccctgatcaacacaatatttgggtttatgtctctagtgagataacgcttatgtttttatcttgatacttttaaaattcccacttcaccttctggtccttatttttttcatatatcatcaatgggtattcaaggaaaagaaaattattgtataagggttgaaaacatcaagaaacaataaatagtcagatttttaaaacattttcccaaactatcttttgagagccaaaattgtagctgtgagtaaagtaaggctgagtttatcctaaagcaatagacaaggaaaaaaaaaaatcagacaaagaatggcaactctatacctctctaccctgagacacacctgagaccaccctaaaaatcaccagggctgagaataggaggcacccactcataaaatgtatctacccactctcatttgcatggctctacgtgggtccttctgcttttgcaataccttgggacatttacaatcaaccccctcacaacagagagttaagtgccttgatttccagacagtggtgagttttagtagggaacgcctcagcttagacacttgagaagaaactagacggcagcaaaatccatcccgttgcacacgtcctcaactaggaaatgttaacaccttccaagattatctaattttatggtcaataattggtcttcagaaaaagagagcaaatataagcaaaatataagggaatagtatataaacaaaaacaatttcaacacaggaagctgaataaactattaatttttagagaaagggtcaacataagatcactgcttttttatgctataaactatatatatggcccccaaacataaatgaatataatcttggctgtatttatttttattgctttaaaaatgaattatttatattatcaacagctgtggctaaagaaaaaagacttttgtcatccaaacaaagaactatttataaccctgatattccaaggtgtatttaaaaaggtgttatttgtggcaatattgtatctattttctcgaagatcttaaaattagcaattactatcaatgaacatttattgaatataaagtaactgtatagcatttgtatctaatgcatttctaattgctaagttacagttccaacattttcatagtgtccaagtgattattttatatatttctttttaaataataaaagtatcataaactttttggaaaaactaaacttcctattttattgctacttattgcctattatttaatcttttatatgttaacatgatcaaaggtgtaaaaaattaatgatccttaattttacctaaaactaaaaaaaaaaaagcaaatatttatcaaatgctgaatattttttaagcactgttagcaattatctatctgtctatcctagaatctccactctgaacactgcattccatgtgatgaaacattagatatgaaaacacaaggctgggcgcggtggctcatgcctgtaattccagcactttgggaggccaaggcaggcagatcacctgaggtcaggagtttcagaccagcctggccaacatggtgaaacctcgtctctactaaaaatataaaaattagccgggtgtgtggcgggtgcctgtaatcccagctacttgggaggctgaggcaggagaattgcttgaaccccagaggcggaggttgtggtgagccgagatagtgccaccacactccagcctgggcgacaaagcgagactctgtctcaaaaaaaaaaccaaaaaaaaaaaaaccaaaaaaaagaaaacacaataagaccattcaatgatttaagttaaaacatgaatagtgaccatgtgagtggcaaagcaaatgtgtgttctttttcatttttattttttttgagacagagtctcactctgttgcccaggctggagtgcagtaatgcaatctcagctcactgcaacctctgcctcctgggttcaagcgattctcctgcctcagcctccctagtagctgggattacaggtgcccaccaccacgcctgactaatttttgtatttttagtagagacagggtttcaccatgttggccaggctggtctcaaactcctgacctcaggtgatccgcctgcctcagtctcccaaagtgctgggattacaggcgtgagcctccatacccagcctccctgatccctttaagatcttttcccccatttttccaatgacatcttatatgcatatacatgagatagaatttgtgttctaaattcaaagaaggaagagttcattggatttggggagaacttggacgatgttgagttggttggtattgatcagagaggaaatgtatttatagagaaatccatgtagagtgaagtaattatcaaggttattttgtgactgatatgaattcaaggggcagtttataattcagtcacatgttaaagaacaaaaaggacgaaagaagaataaagcagatagaatcgtgaaatgggttacattatttgcaccataaagtttaagtaaatcaaattattgggaatattctgagatagagctaaagtctttctcaagagtcatggttgaaaccacatgttgtggaggaactgatggtgattgttgccccattgtgggattcctccctatggtaatgacatcaaaatgaaaaaaaaaaaaaacacacacacacaagaaaatgacgcagattgtaattagaggtggagctgtttatgatctggttatctccacattgttctgggaaagaattgagacattactgggtcaaatcatgtctgtgagacaaaatgaaaggtaaaaatagtgaataaaaagagaaagattagaaacaagctttagtcacttgctcttccttgcggtaggcccttggaatattgacaaatcctaaaataatttaaaaaaaaacagtggattttaatcaccatgagggtaaaaatagtcttgtttaccactgtatttccaacacatagcgtggtatctgaccctccctaaataattattgaattattgattgcacattttagactactatattagcatatcccacctctaagcattaccctgagatgtaactgtgcaatacagcaataaagggtgtcactgtgtcctcagtccaggcctaacacacagttgagctctgaacaacaatgtaacatcaaacagtgaccctgttgtaacatgttctggacttgtctaagctaaagttcaaatatgatacttccaaccctggttataatctctgaatgatgcattttatacatagcaatgacttttttattttttaaaaaagaagcatttaccatgcaagaaaaaggacaacattgcttcaagaatagtaatcagtcagtggcacccatcttaatgagaggatttacatcccattgttttcattttaaatgtcaatgtgcatacatataaacatttagaaaaacaggtttccagtagatcatgttatgtaaaggtcatacagaccttgcaaatattcctgcatctctaactaatctaatccggttcttgacttcaaatatcaaatgatatcccttactgccacccagaattttgaatgtctggtattgagtggtttctaaaagtttgactttttatatttgaagggcccacatgaagccatacgcaattagcatatgctgtattgtggcaagttctgttaacatcagctctttgattgaggaagaacactaactgttgaatcatcaaaacactacagcagtattttacaacctcagttatgcataatgtgaagtaatatgcatggcctgccctctgtaaatatgagaggcaatttgtttggctccacattttattttgctttcaggattatactacttactaacttcaacaaaagcaatataataagaaatattgcctcacaataccacagctctgtccatcaatagcaaaaattctcaatcttagcaccagtgccaggagatgaatctcattatgataattcagtgattgtatacggattcacatttcccagcatacataagagaatacaaaacaaacacaagtaggataagcaatcagataactgaagttttttttgtcaaagatattaaagagtatgttaagaatcatctaatgtcatctccctattactggaaaaaatggaagctcaggatttatataattagctctaggtcacacaggtagtttgatggtaaatcctagagaattctactgttcatatttcttaaacacatattttcttcattatactttatgtattacagtgatattagccactaccaagtcagcactaattataacttgatagatttaaaggtctaagctgaaaatatttagaaaattcatgttgagaatattgagaaataaggtgggatccaaggtggcatgaaaggtcagagtcttagtctgaactagaatgcatgcatgtaaggcacatgctagaaatttgtgagcaaaggaagaagtgagaaaaaaatgaatatttagtaaggttaatttgtaattagtctataggataaggtggagtgtagaaaccattctgccagggagatgaaaattagggaattgcatgtacaaattcattagctaaaataaggttctgttgtttgagtctctcaaaagaaatcacttctcaatagttatgtaaatactgaaatacaactttgaaaataatttttagtactagccatcaaaatttggggcttatgatgtacaaactgtgtgtttcaaacactactgatgggatctgccatcgaggagcccatgactgagattcctggtatgtgctatatctgtatatctgcctcctccaggaagatttgagggcctcagaaactttttccaaacgtttataacaaggatcctaagactattgccttcatagcgaggaagccagcaatgagctggatcctggacagcatgctggcccctgacatgggcaacaaattagatgggccacagaacctaatttctatagccttgactcaccacaggtttatgctctcccgcacaatggcattggggcaagtttatgtctttgtcgtgttgtgctgtttgttttctaagcaaagggcagtctcctatctcatgccaaatttaaaattcaggctgcatgaaatcttagagatttcacttaagcttttgtgcaaattagttggtttgattgaatcagtgtatggtacagcctagtaaatgtcattcttatattcattcaaaagaatacatgcttctacaaatttgctcataaaattagcaatgaatactggtggagagtcacacatgggaaagagaaaacctggctataaatctcagctctaccactgactagctgagttaacacgaactttaagcccttttaactttggcttttctcatctgaaaaatgggcagaaaatgtgggattttgtgaggaatagaattaatactaagcaaaagttcagatccgttttaaatgtcagcaattatttttctatttaaaaaagtatatagcgtatgttcatgtatcactaaaaatcatttctgggacaagctgagacataccataattatgtgtcaacacctgaggtacgtgtaattaatgctagagaaggtcagaagaagggagcttaacattggcaatttgctatttaggaagtgttccaaagaaaaagtgggattgtgatggactatggaactcagattagtaagacttggactaaatgaaagacatcctaatgattcaacaggactaaaattaaatatggaattgagcaaaagagactgagtgttaacatcctagaaaattgggaaaatattggcataatcatttgcccatgggaaagcatatgacatgtacttgcatacacatatattccatatatgcatgcatctctgtgtatgtttacgtacatatacatatcatttgcactcagaaaacactattactaacactacaatcatatatatgtggtgtgactatacaattgtatgattgttttctttgaagttcattaaaatcacatatattacttgcaaatttccgatttatgtacatatgcatacctcttaaaatgggatatatagtattccatctaataaagatgaaatttttgtcaggcttggaattcaagagatcttccttttatgtattatatttttactcaaatggaccactgctagttaagtttctttcaagttttctctgattcggtaaatgccatttgaggagttcattaacatgcgtttaaattcaggttccagtgcatgatgacggtcacatcaggccatggtgaaacaggaaacacatgaagaggctggagtatttttttttaattatttcattttttaattctgtgatcaggtccttccaagttttggtgctgatagggtctttttcttttatattacaatggtgagaagccctaattagcaaagtaagaaaatggcaactcaaggttgatctctggtttgtttctaacttgttttaaatttagttgaatcatgaagtctaaaagtccagagagcacgaaactaagctacattaatttgaacatctgacataagttagactagtatttttcaagttgtattctatagagctccccaattaaattcagcaaaatgatactggtattgtaagtaaaaaagaaagtaacaacctattacatttctttctttgtcaaaaatatgtaatctacgaatcattggggtgagcatcaatattatatacatgggatgaaaatgaatttaatttcattaggatcaggctttaaagatctaaactaaggctgtttgaatttttctttttaatttgataaactacaagttcacaggaagtttcaaaaaattgtatagggaggttgaaggtcctgtgcacccttcacggaggctcactcaatatttacatcttgcaaaactgcggtataatatcaaaagaattgacattggtataatccataaaccttcttctgatttcaccatttatgtacgtatacatttgtgtgtgtatgtgtgtgtgtatatatagttatactcaattttaccacatagatcacttcacgtaagcacaacacaagtggtagatgtaccatcacctcaagacaccccatgttatccttttataggccacctgccaccttcccccaatccatatcacattatgctgagtgaaataaaccagtcacaaggggctgcatacagcatgattccattgacatgaagaccaggtcacccaaatccttagagacagaaagtggtttcgtggttgccaacagctgggtgagggaggagtgtggactaactgataaatggatacagtggtgcctttggggtgatgaaaatattttggaccaaaatagagatgatggttgcacaccatcgtgaatgtacgaaatgctattgaattgtacactttaaaatggttacttttatgttatgtgaattttacctcaatttaaaaaatgcaacctcatggccctctgactgtccatgagagaggccagacttgcagggcagggtctgcagtttcctgagaacccacaagcagacacgtccttatgagatgcatgccctggaaatttctttcacaacgtgtttatgactcctggacattttgggctgaacagtcacaagagaagctagtcatgctcaatcatattttgcttccatggcattttcccaccctcagcctcctactccttttcatagacacacacacaaacacattctgctatatctatggatccagcctctgagccctcaaggtggaggagttcacaagcgggcaaccactcatctatttgccataataatgttacttcagaaatgttacacaaatagagaccagatgcagtggctcacacctgtaatctcagcatttcgagaagtcaaggcgggaggatcgctggagaccagggatcctggtctgtcaccatagtgagaccctgtctacacaaaacaatttttaaaaatgggccaggtgtggtggtgtgtgcctgtagtcccagctattcagaaagctgaggcaggagtattacttgagcccaggacttcaaggctgcagtgagctacaatcgcaccactgcactctagcctgggcaagagtgagaacctgtctcaaaaacaaacaagcaagcaaaaacaaatggaaacatgcaatatacattcattttagattgttgcttttccttttttacatttcaacttttattttacatccagggggtatatatgcaggtttgttacaagagtatattgtgtgatatttaagtctggggtacaactgaagtcatcacccaggtagtgagcatagtacccaataggtagcttttcagcctttgccccttcctccctcccctcgattgtagtccccagagtctactgttctcatctttatgttcatgtgtactcagtgtttagctcccacttataagtgagaacgtgtggtgcttggttttctgtttctgtgttaattcgcttaggataatgtcctccagctccatcaatgttgttgcaaaggatatgatttttttctttttttattgctgcataggatttcatgatgtgtatgtaccatattttcttcagccaatcaaccattgtgggcatgtaggttgatgccacatctttgctattgtgaacagtgctgtaatgaacatcccagtgcatatgatttttggtagaataatctattttcctttgggtataaacccagtaatgagattgctgggtcaaatggtagtccttacttttagttcttcgagaaatctccaaactgcttttcacagtagccgacctaatttacactcccacaaacagtaaagtaaaaaaggacaaagaaggtcactacataatgataaagggtgtaattcaacaagaaaatttaactatcataaatatatatgcacccagcattggcacaccaatgtcctaaatcaagtacttttcaagacctacgaaaacacttaggaagccacacagtaataatgggggacttcaacaacctactgatagtgttagaccgatcactgaggcagaaaactaacaaagaaattctggattaaatttgactcttgaccaactagacctaatagacatctacatactactttacccaaaaccacagaatatacattcttctcatctgcacacagaatgtactgcaagataaaccacatgctcagccataaagcgaatctcaataaatttcgaaaattgaaataaaagcaaacaaattcttggaccacagtggaataaaaatagaaatcaataccaagaggacctctcaaaaccacacaattacatggaaaccaaacaacttgctcctgaatgacttttgggtgaacaacaaaattaagcagagattgttattttttttcactcagtataaattacaccaggtttatccaatagttaattcctttttattgctgggtaatattccatggtatgcatgtaccacagggtttttttttttttaagcaattacatatcaagggacttttttgtgtgttttggtactataaggctgctatgaatatttgtggatacgtttctgtatgaaaacaagttttcatttttttaagaatgattaagagggcaattgctgtgtcatatgctaagtccatttttagtttgaaaatgaactgccaaactattttccagtgtggctataccatttaacagtcccaccagcaatatatgatttacccagtttctccgcttccttgccagcatctggtgtctattttcttattttagccattttgactactaggtaataatatctcactttggttttaatttccattttactaatggttgttgatgttgaacattttttaatgcatttatatatgccatctgtatatcttcattggtgaaacatctgtgcctgtcttttgtccattttcttattggatttttaaaatgttgagttttgagagctctttatgtagttttgatactagttcttgatatctagatatatggtttgccaatattttctcccagtctgtagctcgtatttcatttttttctttttttgagagtgcagtggtatgatctcgactcactgcaacctctgcctcctgggctcaagcgattctcatgcctcagcttcccaagtaggtggtactacaggtgtgcgccactacgcccagctaatttttgtatttttactagagacagagtttcatcatgttggccaggctggtctcgaactcctgagcgtaagcgaccagcttgcctcagcttcccaaagtgatggtattaacaggcacgagccaccacgcccggttatatttcttcttaacagaatattttgcatagcaaaagttttttattttaatgaggttcactttatcaaaatttccttttatggatggcgactttggtgtcaagtctaagaacactttaacgttagatcccaaatatgttctatttttgagtaagttttacagtttaagttcttctgatgtttagatcaaggtgttttttgtttgttttttgcctatgggtgttggattactacaacaccatttattaaaaaggctaaccctccttactggattcctgcttcgtccaaaacaaagggacacaaggaaacttttccagggaattgatgtttgttatttgattgtggtgatggtttcacaggtatatgaatatgtccaaactcatcaaattgtatacattaaatatgtgcagatttttgtatatcaattatactttaagctgtaaaaataaataaattgggcatatttgtggatctatttctgggctctctattctgtttcactgatatatgagtctgtacaccaccagtatcagactgtctagaatactgctgctatataattaactttaacaacagtaagagtgatttctctaattaatttttccttattcaatagttttggctagtataggtcctgtgccattctatacatcctatataatttttataataagcctgtgtaagttcaaaaacattgctaaaattttcgtaagaattgtcttaaaaatagatcaacttagagagaattcacatctttactatggtgagttttccaatccatgaacataatgtatctccatatatttaggtcttctttatttattttactagcacttggtaacttttatcatacagattctgtgcatgttttgttagttttatatgtaagagtttcattttctttgcagaaatcataaatgctattgcattttttttttttttttgagacggagtctcactctgtggtccaggctggagtgcagtggcgcgatctcggttcactgcaacctctctctcccgggttcaagagaccctcatgcctcagcctcctgagtagctgggattacaggcacacaccatcatgcccagctaatttttatatttttagtcgagacagggtttcactatgttggccaggctggtcttgaactcctgacctcaggtgatccggtcgccggggtctcccaaagtgctgggattacgggcatgagccactgcgcctggcctgacttctactttaaaattcttgtcagataatttcaacatctaatttatctaagtgatagcattagtcgatgtcttttctcattctagttttgtttgtttgttttggttctcagtatgcaggcgacttttgatggtactctggacattttgtccattatatatgcagaatctggatcttatttcaatcttttattttagcaggtatttaccatacgtagttcaatacacaggtgccattctacttttatgggctgtggtcccaaagacagttttattttcagagtatttctcgtgttattgaggcctgcttggtttatctagtgatgctggtactctcaaaaatccttgatggtacattctgagtgggcagaaggagttccccagactagggtgctggtgctgctaggtagagtaggggtttcttagatctatagagataaaagtgtttcctagataggattattgtgttagaatccctatactggtaccctccagctgctccaatgtctctgggtaaaagtggagggattctcatggccatagcgtccaacgggcttcccaggctagtcactctttgtggtggatagccttaccagtgctctgtgtttgcccaggtatctctgggtggggaagagaagtcctaggtccatatgaccaaagatgctttctgaaccaggtcacttattatgattgtgtctcttgtaatttctgcctttccacctcgatgtcttcctgtcggaaaagagagcctcagttctgcaggtatgaagaggcttcagtagttaggacacttgtggcaagatctctgtgcctattgggaacagacagtgctttctggatgggattttgttcttgagggatccctcttctagtaccctgtggctgccccagtatctctgtacaatagagggcagcctcagacccacaggaacaaagaggcttcctgcactaggccacttagagtggtaaaatcccttgtggcagttgcacccagccacctaagtatttcctgttgtgagtgagagtgagtgagagtgtcttaggcctgtagggacaaagaggcttccgaggttgggccacttgctgtgacaaaattcctctaaacaatactgccacttgtctatttttcagcagagcatggtagtcctaaatccctgggaaaggagaggcacttaccctagctgcttaatgttagatgggctcccattcaatagcccttgccagttataccaggctcatctggtattgtctgagagactcctattcaattcagagaggaaactagctgggctgccttctgctactaggcttgaaagttggaaaatgacaggtgggggtccccatcttctgttggataggggcacatatgagaatgtgctgcagtttattttcctctagcgcgaggctctcaaagcagtttgcttttctctgactatcctttacaattttcttttgatggcctcttgttttgtttctaggttttattgttcttcttcactatgaggagcagggaaaaatcagtttatgccatcttgtccgaaatggaattctcagtcttgttttaatatgttttaacacgtgattcagataacttggtttttaaaatgtgcacaacttttaaaaagaaatgttccaaaagctaaatatacatttaattgtaccatgctgcgtgtagagtagctggtaactactgaaatcataagtacatgtcagcctttgaaattaataacaaataaaacatcaacttggtcaaatgcggtggctcacgcctgtaatcccagcactttgggaggccaacgtgggtggatcacctgaggtcaggagtttgagaccagcctgaccaacatggtgaaaccccgtctctactaaaaatacaaaaaattagccgagcgtggtggtgggcactcgggaggctgaggcaggagaattgcttgaacccaggaggtggaggttgcagtgagctgagatcgcaccattgtactccagcctgggtgacaaagagcaaaatttggtctcaaagaaaaaaaaaaaaaaacatcaactataccaagtgatgagtagaatgactgtactaggtatgttcgttttcattgtatatttagtatttatttaagcaacctaactaaaaatagtgccgacaataaaaatatctcaatttacagaaatatataaaactttaatatgtagattgtattttattatttaattttatgaaaacatctgtcgaggccaggtgcggtggctcacacctgtaatcccagtactttgggaggccgaggcgggtggatcacaaggtcaggagattgagaccatcctggctaacatggtgaaacctcatctctactaaaaatacaaaaaattagctgggcatggtggcgggcgcctgtagtcccagctactcaggaggctgaggcaggagaatggcgtgaacccgggaggcggaggttgcagtgagccaagatcgcgccactgcactccagcctgggcgacagagaaagactgtctcaaaaaacaagacaaaacaaaacaaatctgtcaaaattatgcaaacaaaaatgtctaccaacttgaaattacagatgagtacatgactataattttatatatatatataaaatacacatataacatatgataaagtattcattaatcatttatgtctctagtttgaacaacacagggagttcaacatgcacctagcacactgcgtaagcctttctatagatgttttagccaagatcaagactgtctattaataagacatctaaaacatttaatcaagcacatttggtttgaatataaaaagatgatagagcaatcaggtttttctcaacaattagtgttttttaacaaaaggacataacagtgcatagccaaaaatttattaatttttggaacttttagtttccaaattcttcttcattaaacacaagataaaaatacttaactttttaagacaggtgaatagaaggaaatttttgctgagcctcttctactttttatgttaaatattttattctatgctttttatcatggcttacacaaaccttcataatgttgctgcaatatatttactgactatcaatgctctcttcaaatttggtataggtatatttttcagcctttcccccttcttgtctccagttacaggcccttttatgggcctataacgttggttttctatctcaattcaaaattcaaaagaaaagactttaaaaatcatctttttttttttgccctaatgcttaatttagagcgtagcacatagatattcccaatatgttctcattaaaggtattgatctttgatttttaaaagtaagtaacaacaaaactgtgagagaggagcagctttttcctttgagaactgtggtttaaatgcagtgaggggtattaatgactacataaatgacttcctatttcagtgaagtgtttaataaggtctttaaaacagtacttcatagcatcctgctcttcaaagcaacatctgtggctctttttggttccaataagtgataaataacaacaggattttggttcacgtaaggacctaaaacaggagagttggttaagctattcatacatgttgctttgtaattgggctgatgtaattttattttattgtgttcaaaatttacactggtattttgtcaattaccttttttctcaacttacaaagtacatttttaaaaaagaaaaccatatacaaagcataggttgtgtaatataatgaaccagtcattattcttcttatctctctatttaaatcatagatttcaaaaagtttaatacgaattcatttgtgtgtgtgtgtgtgtgtgttataatgtagtggagaagcaaacttgatacatttaatgctgtaacattacatattgatgcattcataattcaaagtaacatgatagaaagaaacatacatgtgaaggcattaaaaacatttttgtttgtaaggattttgaaacttggaggatcaaataatataactcagaattctttctgtcaaaataatgtggaacaagaaacacactaaacaagagatatttgggaagttctactcagtccataatttttctcccttctctggcgactatcaccctccagtcaaacaatccataagcagagtccttgatatcatgtttgtattgtgtgatatttgcctctaggacaaggctgactggaccaagattgaggcctgattcaacttggaacaaacagatgcacttcctaaaatactttacctgagactcataaaatgagaatttgtgcaatgagtcattcttagtagcataccactatggagatggcctatggccccatcattcccatggcctgtaggttaaatttttcttgggttctaccagtagataatccagagtatgcacaaatacaccttgaattttgaattgtattttgtttgggtttctgtttcttgcaagaaagaaagacattattgatatttacaagatgacttaaaaatcaggtatattctaaaagaaaagatgagactacttgagataccaaaataaacagggaacaaaaatattaccaacatattatcgtgatgtagataggatttttttcaagaagcttgagagcatattagtattgcatttggtacataatctgaataggaccatacgataaagaacactgtacaatgttccaccaaagtataccttaataacaacaatagcttttataaaaattcttgttttatatatctagaattttacataaatgtaaaaaataatgtagatgttatatctcatttaaatatcaatataaaagttaattggctgatacaaatacatccaacttactcaacttatttattttcttttgagaaaggtaaaattagagaagtccagagacttatacaatgagtacatatctccaggaaatcataattatgaataatctgtcctaatttattgtgcataatctaattataaaagaaaatgattcaaatacatgtgaaaacactttacttccttatctccaggcctgttctcctgctctcgtctttataagaggccatgatatatgaattttatgttcattaatttagctcaattgttctgcttttcacatacattcctatatccataaacaatacataatgttgttgttgtgtatgtatgtgtgtatgttctttacaaatttacttgagtgcttggcatccttcattgagctaatgagctatccataagaatccatgttgatccactccatacccaggtagtatcgctgacaggctgttcagcctctaattgtattatatagctcttcttgcatgcaggtgtggttatttgatttgtttctcccagtagaatatgagtggaagtaatttgtgtcaattcagagcttcagattttaaaaagctaatatatcttctctgctgtttctttcccattctatggatgtatgcagatgactctgaggttgaagagatgcgggggagcaacaaaatggaagacgtctggatccttgcatcgtcacatgcaggaaagcaacacgctgccatggaatgccatggactgtgacatgagcaaacaataaatatctgttgtgttaaggcactgaaattgtgggtttggtttgctatgctagctagcattaaaagaatgaatatactatcacgctttgcaatcgttctacaactttcctttttcactcaatattatatatttgggttacataattattgtgagatatggatctaattaatacagggtttttcaaaagtggcacttttaacgttttggactgataattgtttgttcgggggaggccgtcctttgcattgtaggatgtttgccagaatctctgtcttctacctactagatgccagtacaatgctaccacttccgcagtaattacgataaaaaaaactgcagacattgtcaaatgtcttattcatggccaaactcatgcctggttgagaaccacttatctaatacactctttttagctgcttgatagtatttcaccacaggcatcaaggatatttattatatttttacactattgaacaatgaaaatccttgtaactgattttgagctgaattatgatacccatactagctgcttaagaagaagaaatgccttttcttcaacatcaataaaaagtaaagcataaaattatatagatctgaaaagtaaggaacggttaaaaagacaggagtagaatgtagagcactaggccagtgcaaaaatagaagctgaactctaaactgggacacaatcacaccttagttgttaatttaagtaatggatgcttctgagttaggaatattagctcactcacaccacaatccatcatcaggcaatcctttatgattcttaccttctccaaaacaattcctaccattcaactcatctgcaaagcctgtcagtgctccctgcaaataatacttcatgtgaggctactttctttccttcataagtgccactacccttgtcaaagccaccccgcaaaagtgaaagagcctcctcgaggtgaatggctttccagccttctggaaagctggctgagccactgatgatgatgtggcctttttattctaggtttagtttaaggattataaaaaaccagatatttatataaatattctcttgaatggaagcacatagatgattagttcaaattctttcgaagtggtgatgtaatatcccagttgaacagggtaaggtaaaaataaagattttactttctataactaggcagatctcacattgggcctttagtgtcatgggtgccattccactgggaaatctgatggaccggggaagccatatttccgaataggttatctgttcctatttatgtggtcatccagtttttgaaattttttaactaaatcaattgcaaacttcatctaaccttattgtatagataaacacaatttacttcggccaacctgtacccaacataaaactctgtatctcctgagatcttgccctctctatattcttctcactgcaaacagcatcagagtaatgcccaagtgtacatcccattgtgacatcccctcaaattgttcaatggcctcctattgaccttaggatgaagttaaaacactctagattcacaggtgtcccgtcaaactttcctgcctcatttcatggctccacagatgctggcctctatcatttccctaagttcgctaattcttcgaagcttaagagccattgtacatgttatttctctgtactgaatgtcttccccttctctctccctccaatttttatagttcagaggatctcagcgtaaatatcacctttccagaaaggtcattagaacattaaggattgtaaccaagagacaatagctgttggttttattttttattcttgtggcatatgccaactaacttgcacagtgcctaaagtcgaaaagggctcagttactatagacacaagcaaatatgacctgagctaccaacaaaattacatccgaagacaacaggaagacgagactgtgaggtttccaagtttatagacaaggtcagacaaggaagtcattaggctcgtctctgtcaattttgaacaacaaagttattatttctatcttgcaacaacaaaatatagtttttttaattaaaaaaatcttcatttaagaaattgctgcaggaaaataactttgaattgcaagtataaagaaaattttctgagccctagatgctctttttttcctttgaaaaccattattttcaaaggaaattgttttaaaacataattttttaaaataaggtgtaaacgctcattcacagaagagccctaagtcatgctacaataaagatgtaagtagaatatgggatttgagtcattttttcaatccaaggaaaatttcagaacaaaatatttttggaggtgtccaatatttgtttagtttcacacagaaagacactatttacattcaatatattttaaaaactgtacacatgttctataagattatcaataccaatttactcatttttcaaaaactattttttaagtgtttgtttgacaataagaaaattcttttaggtggtgtttcaaggaaggccacacattttaacataattctaagttgaggtgaattcataatataagacattttgatatctgtcaacaaagactctttacttgaagaacagtcattcaaggtctgtgtccttaaatataacattccagatagcttttaatttcaagtcttttatttccaaaagattttctgtggattatctattatagttactaacaaaataataattcacaccaggcaattatatcctggtatttgataaaacttggatgtttaccatttcaagaatgatttcctgaaaaagaaaaagaaaacagctgatattcaaagtcagccattttctgcagaatgagcaattatttaaaaggaaataacttttaaatgagcgcatatattccaggcacatattttctgctgcttactgaacaagtccacttcaaacataacatgacatgaataaaaaacaaaagaaaacaaaacgaattccaccccaaatgtgctcctccttatatatttctcaccttggtaaatggaactactatttattaaacttctcttgtcagaactttgtatcatttaagatttctgtcttcctcaccttcatttaatcaagcttcaagacacgtagattctaccactaaaaagtgtttttaaacagtgtctattgttactattctaatcaaaatcatattacacttatgactttataagtactacgacctcctactggtctttcatctttcctcagcctgttgatcctccaatccctatataagtacctctattcccaataaagtctctctgccacatgaactcacaatgagctttaaaaagataaagatgatgatgttattccgtttgactaaatctcataagcggctccttatttttttggttataaaatccagaatgctaaacacgaactataggatgctgcatgaggtaatccctgtttacatatctcccccaacccatgttgattcattcatctttcctcattctagctgtgcttgactttagttcctcaaatatacttgcttctttatgtctcaggtctttaatacatgcatgctatacaagccagaaaacatcttaccaccaccctcaagtaatataaactagacaagtgcatacaatgtctttaattcctggtcaatttttatcttcaagtgaactttactataagtgaaagcttttgtttgcttgatttatacatggtcacaaaataagctgccagaaagtcgaatttctttcctcctagcttaaaaatacatctacccctccttcatccttaaaaaagaaaatgcatcttcataaaaagattacaacttttgaatataaaagtcatgtttttcaaacaacggatatattctcaacatatatgtatttcccaccaattatgagacacaacaaaaaaagaaaatttcaggccaatatccctgatgaacatcaatgcaaaaatcctcaataaaatactggcaaactgaatccagcagcacatcaaaaagcttacccaccacgattaagtcgacttcatccctgggaagcaaggctggttcaacacatgcaaatcaataaacataatccagcacataaacagcaccaatgacaaaaactacgattatctcaatagatgcagaaaaggccttcgataaaattcaacaccccttcatgctaaaaactcttaataaactaggtattgttggagtatatcttaaaacaataagagctatttatgacaaacccacagacaatatcatagtgaatgggcaaaagctggaagcattcactttgaaaacccgcacaagacaaggatgccctcgctcaccactcctattcaacatagtattggaagttctggccagggcaatcaggcaagagaaagaaataaagggtattcaaataggaagtcaaattgtctctgtttgcagatgacatggctgccatttatccccatgtaatgccttctaatcacactgatgttctcgttattttgtcttgaattaaaaagtctttttattataataattattatttcactggaaaaagctacatataaataaaaagagaaatacttataattttattgccaagagatagacacccaatttatttgaagactatttccaaacgacagttttttctgtgtctccgtcttcatctttcccacattctgcttcgatatatgttaccctaaaaatcctactacatatattgttttgtaactcacttgtaatatttttcaatagtttctggccatgtttctacttttatatactgaaacaattcaataatttgatggctgcataatttgctattttataaatcttatataatttatttgaccacacttgtattagggaataagatgtaacccatttgtatattcatgcaaattatatatgccaattttaacatttaatacacattgtccacattatctcaagcaaatttataagaatgtatgtattccactactaatactgcacaagactttctattttcatcaatcttaggagtaattaccacggtgggtttgttttcattcccttccccaaaacttccgtaacaatctttggggttttgtcacatctcccttcacacctacatcacctttaaaaccaagagttaggactcattttggaatcatttttttatacagctcaaagtcagttacattatatttagtaccattagaagatacaaattttcctcaacactttctgggtgttggaacctcaaaactattttaaaagagtagcgaagataatatctatgttgaaatgaataaaatagatctatcatgaatatcatgttttataaaacagaaatgtatcaatgaaagatcataagttaacactttaaaatatatgttatttataaacagatatacatattcggaagatcttcaaagtagtacattgattcttatccaaatttgatttgagagctactggttttaaatttgtaatacaaattacgatggggtgcggatttcctaggccagttttttatgtacaattgaatgtagaaaatctacaaaaaaatagtaggatacaatcctggattttggattctggagacagtggaccacattgtataggtgattgaatgaatgaaatgagaagatatatagatgaagaaaaaaaagaaagaaaatatacaaaggaggagatgattggaggaaaaacagatgccaggacaagattctgaagtatatatttttggttttgcttttatccctcacctattaaaccctgtttcatttgactcctactctattttctaacctcatctcccattgttgctcttaccattgccctctctactccaaccacacaagtcaatttttctgcttctctttttttagtccattcctccctttgtgcttcctgtttccctatatagaattctgttatccagatcatcacatgtataggtctgtctattatctcatgtatcagctcagctatcactgcttcatagtggccttcccttttctttgaattgagaagcccttaaatccagattcactcactataggttatgtgattatccctcaaaatcatattctttaaatatttgatttttatcttttctcactagtaagtatgctctgtgaaaaccaggcgatgtctctttttcaccctagacctgtcagtgcctaatatagtaccttggctatagcaggttgtcagtgactcttgcattcattgagattagaactgagctacaagtgacagaaaatccaaaataaccaatatcaggaacaatggaagtttgcatctttctgaaataagaagagacagttgagaggcagtacagtggctccatgatcatcagggacattggacaatttatattattagtttgtcttcttcaacatacaacttccattttgtagtccagatggctattcaagctccaatcatcacattgccatccaagtaacagtgagaaataacaaggaagataggggaagatggacttctcttcctagaagtttcacacattaattcttattatgtcctatcagaaccaggtcacatgatcatacctagctgcaatggaggatgaaaaatttaaactttattgtaggatgttcatttaagccctctctcgatacctgcctctaggctaaacatataaaaggaacccgtttctcactaactcaccccaaaccaataattcatagtgtagctaatattaagtatgtgtccaaaaggtagataactgcccaaacgttttatattcttcctcaccaagaggtaaagggtcaacttcattcttctgcatgtgaatctcaagttttctcagcaccgtttgtttaaaagatgattctttctcattttcatggtcttagcctctccctcatttatgagaggaaggatctgcgctaggtgtggtagctcaggagatacagaagcagccacatctcttcagctatgaccagacgtggtgataagccacagcagcttctgctgataagtaaaaagaagaagagaatcacgtagaagaagcaccctgtttttggccatgtctatccagagtaaagtttctgtcacacagagctagagagagtggggttggggtggggattgttgctcaaatgtcattaactttcactgttctgactgagattttgcaggtttttttgttttgaataaatatttctccatttgctatatgctcttaagaccatttccagagactttccatggttattttattacaattttcaccagttacagttgttttactcgggacagcatccatggagcccctgacactacacactaccatttcagaagtgtttctctccaaaatgttcatgtttatatttcgccatagttttttagttaatatttcacaaacttgtaaaatgtgagtatcttcaccccaaccttcaggactgcagtggcagaggccatgaataggaggtagagtagattgatttagttttaatttagaaaaatgaactcatataagtaacaattgcaggtaaaaattaggatttagactttgcatttgtaggctctgttttcttatatttattaagtttaatatatttgatactaggtagtaaaatgtttactaccgaaaaaaaaaacttttgccaaaatgtgtcaaattttttattttatagcaaatactcttctagttaacatatattttatcttcagtgcccagttatttcagcttcattaagagaaaaaaaaaagggaatcaaagagtaatatagtgcctttttgattttaagactagctcttattacccttggcaatagattatagaaatcatacaagcagtatatacaatttcaaagtcacacacaaaagtatattcttgaattatttaaaaagtttcaactcacaaatattcactgtagaaacatacaaaacatcgagaatttaaaggacatatgaaaacaaccagaaaagagttaaagcatggattacgtttagttttacaatgaaaagcaacagagactttgaaattaaagatttactatggattgtgaaagctgaatgctaaatcttaaggaattttgagggcatactattaaacatagcccttgttaaaattaaataaacttatgattaaataaattatattaaagcaactgtaataaatgttcaaaactcatcacttcttaattattttactacatttcactgtcgtctacacttgtgaggttatttgtatccttttatctgtatggtgaaaatgctatataataattggccactacctatctcatcccagctccacactcagcaacatcatgttgatagcttgaaactggatgtggttgaagtatttacaccacagaaataagcaaacactaagaatcatagcttgagttctttctcactgagctggtggttaaaatatacctacacagtacacatccccaaagagacatatatagagagatacagacataagtatatataatataaatatatggagataaagataaatacaaatagtgacatagatatgtaaattcagctagctatatcagcaaggtaaatgagtaaaaactgaaaattcgtcagcaactcaagttatatttttagtaaaaataaagccttgttctaaacaaattcagaaacaaacacagagactaaccagtgacaactggttatgcaataaacatcctgacaattgcggtgtgcaataaacagacccacatctaccattatttccacagggatgttgtaaatccattcactggccaaacatttactgagttattgactactccctatcagtttctgtgctatctagataaaacagtgagtgacaaatagtggctatccttagggagctaaaattacacaaatggacacagaattctatcaaccgtatgacaagagacatccatgggggatgagctaatatgtgatgacaaactattttgtgacaaatatgatactaaaatatttatttgcattatctcacatatattctatatgaattctgatatgtaactatcatttcttcattttacctatgagatccaggtaagttaaatcatatcacattatttagattctatatccaatcagctgttgacttttatccatgtctttcatagctttattggcttttctcctagtaatgctttctcttgtgaaaggtattccatataattattaaagcaaggttattccaagttaaagtaatccattgtggtgatgtctcccacatgaaacatcactgtctgaatggagcaaactaaaaaataaataataaaaggcagctttttaaatttaggtgacagagcacaagcagattctataaattatagcagtttcataaaaggtaaaatcccaagaaaacctctcagaactattcacatttttgaatttatgtcttctagggtacactgtaggatgtagttaaagaagaaaaaagaaaaaaataagaggtttttcaatataatatgaattccagttttatcatgataggagaatatagactgtaggaagtataatggtaccagatgcttttatttgtcaattattactaaattttagaaaaaagaaaaattctagtttttgagtcttccagactgagcacccatttgacatacaatttaacttaccaaaatatgatagctacgttatgaagctagacacaatgatatgtttcaaatgtataataatcagaaatatcccattatttggttttatataacatatacatagcccatatgtcaaaggaagacacaaaaaatagttttagtacctggttgaaatttttgattaaaaaatttagctgatccttgagaaatttaactgaatctaaacttattcacaaaagcttacattcactttggcttatttgatgtttagaaaattattttaatgattttattcttgcagcatttgctgaatagtgttattgttaagaataacacctctgaagtgatacttcctgagatccaatacacttactgttttagataacttacgctgtagttttcatctctgtagatgaggtgggatacactaatacctacttatcaagcagtctgacaagttttaagaattattatgtccaaattaaatttaaaccaaattaatagtatatgccaaattgtgaatgtacacacacacattagtgtacataattatctttttttccaaaaatatttaagtaaaagaacataaagtttaaaaatagactttgatagtagacagactttttttttgatgaattggtaatattcattcttgttctataattttaaataaaaagtttgtctcattgtatctttaaaaatacgtgttggtgaggatttggagaaaaggaaaccctcatgcactgtttgtgggaatgtaaattggtacagccattacaaaaaaaatagtagggaggtttctcaaactattaaaaatagaattaccatgagatctagcaatttcactgttgattatttacctgaagaacatgaaattagtatctcaaaaatatatctgtactctgacatttattgctgcattattcacaatagccaagatatagccacaacctgtgtttgtggatgtatggatgaataaagaaattatggtatgtatacaatgaaatattattcagccataaaaagaaggaaatcttgcgatttgcaacaaggtgaacttggaggacatatgctatgtgaaataagggcagaaaaaaatgaaagacaaatgttgcatgatattatgtgtggaatataaaatgttgaacttatagaagtagggagtagaatagcggttgccaggagtggtataaatggggagttgttggtcagagagtaggaaccttcagttatagagatctaacgtacagcatggtaactgtagttaatattaatgtcctttatacttgaaacttgctgagggagtagatcataagtgttctcatcacaaaaaaaagagactactatgcccggtgatggatatgttaattatatcaaaataccgtgttgtatatcttaaatatatagaatgtttttatttctcaataatacctccataaaaattaacaacaaaaaagtatccctaaatgatttcaataacatatcattacagcagctacaaaaaggacaaactgatatttagccacaagcatgtgatgatcaactgattttcactattaagttactgttctcttaccgtaagaggaaaatagttccttcatgttttaataatcccatttcatccagaaacacagagataattccctgtgttagccgcacatatctcaattcttactcaaaatttaattaatcttcagtgatggaaaacaatttccttctattaagaccatatcattgctgaacgtctttaatttcaagaaccattaacaaaatttcaaacaatttatgttatttaaaatagaagctgaaaaaaggagaaaactacacaaatattttaccatcacaacaaatgtgaatcacagattcaatatgtgattcttaaacacatttcttaaatatgtttgctgttttggctgcaaaacaatcgtcaatgttgagcgtatcggacactttaggaaaatctttagtaataacaaattctattctcttagtatcttatttcttgctgatactctgtgcctatcctaataagcaggggatggctacatactgtaatcactcaggaagataaaacagccaacattttgagtgttgttggtctcaggaagataaagcagccaacttttgagtgttgttggttgataggtctgagagaaaacagaacacagtaaaacattcaatggctcttagaacatctgtccaaaagtgacacagttcacttcttcgcacatttcattgatccggcatgtcacacagccagactcaacttcaagtgagtgcggaagtgattccacgtaccagaaaggggacagaagcggaacagctatcaagagtcttaatgtctaccacctccacctgtatcagataaccacaacttcacagaatatatttcataataggtacagagaatacataacttaaatgaaactcatcattattaaaaataaactttccaaatattttctctatttattttaaatgtaattaaatctttataagcaaggtctgcaaatttttattctaatttttttttcctgagagtaagtggttattatgttactctatagttgaaaaccaaaatgagagaaaagaaaaatgacataatcagagttagagagatataggtaaaaaccctgactttttcttttggtacttgtaggactttgcagaagacttttgatctgaatggcagtaagtttcctcaggaaaatgaaattaatatcatctaccttaaataggtggttatagtgattacatgagctaatgtttatacaaatgctgtcttttactccttcccttcttagcttctatttgaaaaaactttggtaaggagctgcagcttttcaaaggggccataaacttgactccgtgcagattctaaggaaggcctagtgaggaaagatgggctaggtagttgcttcagttctctaaattatgtgcaagaatcttaaaatgaaatatgcaagaaagatacagtctaggggtggacaggtaaagaacagggagaggtaaaggcaagaatatttggctgaataatggaatatgtttttctagccattctgacaattggtagatgttttacattgtccttttttacatactgctgatattttcgactttaacttttcctccatgccatttttacaattacagtttgaataaattttaataatataaaagtctcttcttgaattttgactctctccactttcccattcaccttgatgtttccgatgatcctttaactgtggtagcagttgcacttaaatagcatgctgcaaatcctacagtgtgagagctctttctttctttatgttaaatttctaaactgtatccactagagacagctcagaagagacaatgaatactaatcaaaagagaaagaatcacttggttgtggtcacgccttagcaagaaacccctttaccagaaaagacaactgttttacatgctacctatatattcccagtggaaacagccacttcacaacgactttaaagtgaagatgaatgagttttatcattgcttttttgtggtgcataaactagacctgaaactatccagtattttatgattgttgcattgaacatgcaaattagcaaatattagctttgatcaaataccacagccacacccagaatgcttgtactagtttaaagccatcattggcaaaggccagaattctttgtttttaatgaagaacatataattcccataaaggcatgagattatcaggcacccatgtcaatatgatcaggtgaaaacttctggttcatcctcaactaaccttttcctatcttgctgatgaggaaaatttaatactaagctaactgtggagacaaactataactctttgtaatgtttggatgccatactgtgattgtttgtgtcttctcaaacttcatatgttgaattctaatcaccaagatgactatattataaggtagtgcctttgggaatttattgggtcatgagggctctaccttcatgaatgggattaatgcccttataagagaggcccaagaggccttggaagctcagtgagcgtgcctgcaccttgaccttgaacttccccgcctccataactgggagaaataaatttctgttctttataagccaccctgtttatggtatttttgttacaccagtctaaaaggactaagacactgatttggggaagattttggcagtaattgctgtctcttttacatactcttccccaatgtaaacttctataatctaatcaagggagtttaaacataatagccatgtaacagacacagtgtaaaatatcaaagattttttaagatgtagaaccagtcgcgttagtattgtggcttcagggacaatgtatttcttatagcaaagagaccaattaacaaggttcgataaagcagtatccatgcactcgctgtccttcagtattttgcatgaagccaaaggcagaatatgctagaagtagaaaagcaggaggttaaaataaccattatcaccaggaccctgacaccactcaaggccaggcattgtctgatttagggagaagcatgagtttccttccaagtggtattacctgtaaaaaccagggcaattcactctccaggtaaggccttaggaactgtacgtacacatttttccatctcaattttgcaagcacctcttcaaaatagtgtgtggataccctgcccactccaaacagacagaaataggtggctctctacataatgcttagaaattatacttcatggtatatttttttttaaggaagacatgccaagcataatgatcttatgcccttgtgaaactttttaaaattgtgaacacagtgtatctcattccaattcgattttacaaaattatgcagtaagttttttccctttgttgtaagaaaatatttgtgtcttagtccactggcgccattataacaaaatatctgagacaggtaatttataaacaacagaaattaattgttcgcagttctgtaggctggtgaggtgtctggtgaggacccagtctctgcttcgaagatgatgccttgaacgttgcatcctccagagagaagggatgctgtgtcctcccatagtggaagtgatggaaaaatataagagcctagttagttctcggttctcaccagcctttttataaggtcattaatcccattcattagggctctgccctcatgatttaatcacctcctaatgtcctccaccttttagtactatcatattggcaattaagtttcaacatatgaattatgtaggacacattcagatcatagcagtttgtaagataaaatacatacatgacacatttcatcatgtaagatattaagttttaatattttgaaaaattttattttaatattcatttttctacacacatatttcatagtattaaacatattggctatatatttttataatgtgatcaatttttattcatcttactaaatattcttgaaaacataattttaataagtgcttaatgttccgttgcaacagatatgccaagatttgtttatctgacccttatttttcagctacttaggttgctggtcatttccacttttcttaaaagtaacatagcaaagaataaccttgtccatactatttaatcatgtctttagggaagagtctcagaagacaaattgctgggtcatagggtcaaatacactctttatgcatattgccaaaatgctttcaaaaaccattagactgatttataacctcaccaacaagaaagggcatgcccacttcactgactcttctactgtattcaccatttctaggttgataggtaaaatttacataaaaataaatttaaaattaaaaactactgatttagttattctactaattccgtgagcatatcttcatatttcttgggcatttatatttcttttgcggtaagctatttgttctctttactctttccatttttctatagtggtattagtagtgttgcacattttttaaagaacttaatttttctagagtagtattagcgtcacagcaaaattgagaggaaggtacagagatttctcatatatcccctgcctccacacacgtacagccacccacgctatctacatctcccaccagacgggtacatttgttacaattgatgaacctatattgacaaatcattatcaccaaaattccatagttaagagtaaaggttcattcttgggtgttgtgcattctatggatttggacaaatatataatgaaatgtattcacaattatagcatcattacagagaatttccctgtcctaaaattcctctggactctacgtattcatacatttccctcacagcccctggaaaacactgatcttttaactgtctacatagtttttgctttcccagaatgtcgtattgttgaaatcatatagtatgtagattttttcagatttgcttgttcactggtttcctctatgtgtttttcatggctcagtagctcatttctttttagcaatgaataacatcttattgtctgaatgttctacatcttatttatccattcacctactgaaggacatcttggttgcttccaaattttggcaatgatgaataaagctgtcataaacatccatgtgcagggttttgtgtggacataattttcaactcctttggtattttacattttaaaattttaagttatgtggtatatataacaagccaaaataagcttagtttcagttaagaattatggttttaaaatcttctaagattaaaatgataaaataaagccaacattcttctttccaccgaagagacttacatataatacaaattcagaagttttatgtctcctagattacacaaatcctgggtaataggaatatgggatgggaagaattacaaatggattatgtagatacttactgatatggtttgtctgtgtccccacccaaatttcatcttgtagttcccataatccccctgtgtggtgggagagacccagtgggagataactgaatcatgggggtggtttccccatgctattcttgtgatagcaagtaagttctcatgagatctgatggttttataagggacttccccctttgcttggctctcattcttctccttgctgccgccatgtgatgaggatgtgtttgcttccccttctgccatgattgtaagtttcctgaggcctccccagccaggctgaactgtgagtcaattaaacctctttcctttatgaattatgcattattgggtatttctttatagcagtgtgagaatgaactaatacacttaattttttaaatgtctgaatatttatcatttcaaatttatttaatgtcttttgtttcctctcttaatataattttatcaacaaatttttccattaaatcagtgaatcttctgaagttatttattataaatatgaattaattcctttcaaatttattaatgaattttaatataatttaatatatgatgtaaaatgatgttatattttagatttgcttgtaacggtcaccaatatgtaaacagattctctctccaacaattagaaatctaaactatactacaaggctacagtaaccaaaacagcatggtactggtaccaaaacagagatacagatcaatggaacagaacagagccctcagaaataatgctgcatatctacaactatctgatctttgacaaacctgagaaaaacaagcaatggggaaaggattccctatttaataaatggtgctgggaaaactggctagccatatggagaaagctgaaactggatcccttcctcacaccttatacaaaaattaattcaagatggattaaagacttaaacgttagacctaaaaccataaaaaccctagaagaaaacctaggcattaccattcaggacataggcataggcaaggacttcatgtctaaaacaccaaaagcaatggcaacaaaagccaaaattgacaaatgggatctcatcaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggcgggactgtaaactagttcaaccattgtggaagtcagtgtggcgattcctcagggatctagaactagaaataccatttgacacagccatcccattactgggtatatacccaaaggactataaatcatgctgctataaagacacatgcacacgtatgttcattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagcaaaccattgcaaggacaaaaaaccaaacaccgcatgttctcactcataggtgggaactgaacaatgagaacacatggacgcaggaaggggaacatcacactccggggactgttgtggggtggggggaggggggagggatagcattaggagatatacctaatgctaaatgacgagttaatgggtgcagcacaccagcatggcacatgtatacatacgtaactaacctgcacattgtgcacatgtaccctaaaacttagagtataataataataaaatttaaaaaaaatgccaaatataacttcaaaaaaaaaaaaaagaaatctatacctaatttaggagacaaaacaaactaatgtcagaagtttgtttgcacacttctgtaattaactacaaacatatattcaagagtattctcttatcatttcattctatgttataaaaaaccttcagtctcataagtcacattatagagcattacgttttcctcccatggtgaaaaggattagttcttagcaataacttaagaacacatcttttgtcagtgtctctgagggataaatatttcctggttgagtgtttatgcacagaggaaaaattactgaagtctgtgcccaaatatagcttctgtaaacttgaaaaatataaaagagaatttagtgaggaaaggagacagagagtagctccttttggactataatacaaacacattttctaagaactaggccttggggatcataatcaactagcctgagccacacacaatggataggtatttctgactggcactttttagctgtaaggcatgacatgaaattgcaatgagagagctacaaaaaggccatagagacaagtatccagcttaacctttctccctatgcagttgtcttctttaccacagtgatgctggctggtcaatttagctcctgcttgaatacttactatgaaaagaaactcttgctttatgttacatgtgcatcattcatttagacaaatttttaatgcatttacttattgaagtctaaaggtacacaaatgaagaagatgtggttcctgatcttgcagtttccagtttataacaaggaacagaaatatacatgatttaatataacgtatggtcatagtagagctgaaaatctgaagctttggctaaaatgaggaaggagtacctaaatgggcctggtatttgctaaatgtatagagggaacaacatttaattgaggaaataagtaggagatttccactgatagaatggtagaagtagggctgtgatgggtgtgggggacatggaggggaaaggcaaatggcacagaggcttgaaaactcctggcatgtttgggtgagaggtgagagattctatgtggctacatcacagcaatataaatgtcatgttggaaagtgagtctggagaagaaaattggggcaaacaatccaaagtctcaattagtacaaagccatggggacccagactctgtctctgtaatactgaggacagatgcagcatagagtagatattacaacaagatactatggcgctaccctgcctaagtttcaatgtgctctcaaatagttggtgactttggacaagttgtttatccccaccctgactaatacatgctctatgcctcagtttacttatctgcaaaatgaggatattaatatttagctcattggattgttttgaggagtattggacaaaattcttttaaagtatgtaaaattatatccttttaataacaacattgattaaatagattccaagtatgtattggagcagagagagtccagatgatgatccctgaaatccagcagtggccaaaaataaaagaggagagaagaatgcatgatcattgcaactcgagacagatttagctattagaaagttctttcttatattacacctaaatttgctctccttcatgcaaagaattcaatttctactggctggccctatttctaccttccacctaatagacttacatataataaaaattcagatgttatatttttcccagattatatcttttttaattttgtaaaaataaataaataaataaaagagtttgacatttcactcacgagtcatccttagaaagagtaaaagatcagaggctgggcacggtggctcacgcctgtaatcccagaactttgggaggccaaggcgggcggatcacctgaggtcaggagttcgagaccatcctggctaacacagtgaaaccccgtctctactaaaaatacaaaaaattagctgggtgtcgtggcatacgcctgtagtcccagctacttgggaggctgaggcaggagaatcacttgaacccgggaggcagaagttacagtgagccatgcgccactgcactccggcctgggtgacagagcgagactccatctcagaaaaaatataaatatatagaaataaagatcagaaaggcccattgtaagtactaatggttccagtgagatacagcaggcagcacagtaagcagcgcctctattgttagggtagaaagcagtcacaggcagaaattcaataaaaataagaagaaaaatattttagagtccccaaatcctacctccttcaaaagttactcatccaaaatcctttttaaactgtaacattctgtacagacaccagtttttcaaatataattgctaagatgtgaggcataaacataaatctaaatttcattgagtaccacgtaatgttcagctattatcatacttggaaacacatggataaaatgaatgttgaaatagtcatgactctggtatgtctaccaatgcgcagttgatttatactgtcatttattgtgaatgtgccataaatgacaagctacttatgacattgaattgaaccattctttttggaagtctctatgccagacattgttctaaaggctaagagtttaaaagattcaaaaacacaatagttccctagtttgccttccttcctacatgtccttgcctgctctcctaactcctaccccagtctttgcccaactttggcattttcccaagaaagattgcattccaagaatcacagtggtatttggaaatattttgagatttcgaaataaataattcttccttttaaaacaaataatttttctgagaatcaattaatcgtctaactttaaataaagtaaaaatggataggaattaaactccaatatattgaggcaaacagtctttattttgaaaatcctttttaaaggtttccacaaataactctttaaaggaaagggctaatatttccttcaggaaaatttacaacaatctgttaaccaaactagatcttcaagccccttaccaattcctctccccaattgagtgttttccaaaggtccaatttggaattccttttctttttctttttttcctttctgtaaagggtgagcatacttaggaaattagttaaaattactccattgaatgctctgttgttccttagtattgagggaaggttcaacatatgttaattttgggaatttttttagatactgcaagactatcacatgtagcttagtctcacagcaaggatatccacacaacgtgctattagcaagtaggatgccagccgccacagaccagtattagcctaataggatgaaagatattttgatataaacaaacatgcgagaccacacagtcagtaaacattttatagacaaaaggagaactctaatgacattcatttggcctttggagaggatgcattcggggcatttttcatgttataaaggataattgaatccaaacagtgttcatatgggaacactaaagctctaacagtacataacagagccaagtcagactttttaatatttatatgttcttttagggaaattgttctggttcctgcagatgattaataatacctgctgcatttgcataattcacggtgttaaataattaacaggattataattatattcataattctttatcaattgaagttaataactttggtctgctctagcgcgctatgttattgaactaagatctgtacttcaaaataatgattctagttaatattagcaacacatattacatatctagccctttctttatattccccagtcagctttgacaaattgagtatatggtttaagtcccttaatattcagtgagaagaaatgcattttaaaatctggaaatctgtctgtatttaaacataaatataaataaataaatgaacaaataaataaataaagagctttatatctatactgaggtgtataccatatctatctttatatatatagatatgtgatatttatttttactgcaaagagatagtaaactttttattttagaataggttacaagtaggaaacaaatatacttaaaaaataataaaggtgtacaagatgcaaccatttgcataaaatctaccagtaggtgggtcactcattggccttttgtgaagagatatatttacttcaggacctgaccaattagcctagatgaatattatatttttattacaagtatgtggtgtgattatattattattacaaaattataacaaaaaaagtaatgtagaagtactatatataggaggccttcagcttgtatcccttactcatacttccatcaaaaatgaagcatagaagtatttggagtattgatttattttagtcattcattagctatcatggtcttatccatgtctgaaaatcaaatgcaagatgtactttagtgaagaatgcaataaaaattaatatctgtgcttgtggggtaacaaagttaaaaccaaggcacctttttctactgaaaaggtgtatgaattaaaataacaacaacaaaaaactactatataattcagtctccattcaaataacttataaaatagcttggatgttttcttgaaacatcaatattattaagaagatattccaatacagaaataatttattctgtataaaccgtacttaaaaatgcatggagcctattgtagctgcctaatggttttgtaatatttttgttgaagtggcttaagtacaaaggtttaattgcttattataaaagactaaatattttatatcaatgaattaaatttaaaaaatatctgccattaccacaatagtccagtgggttgcagataatctgagtcaatttaactctcttatcaagagattctgcccagaaaattagcaaccattattatgttctgaaagaacacaaaaggtctataataacattgaaccaattattaaatgtatatttttcttctaagagaagttcgcttctttaaaatttggattacaatatagagaatatcacctaaattattcattttaattaagtcatttcctgattttgtcttagcagatacagtcaattaagaaattatccatattagccttgcatcataagtaagccctaattctgcaaaaattgagtattgtttcatttcctgattctaaatttgcaagccacagaaagtcagatcaaaaataaagattacgagtctaggcttatgatgttaatttagtggatattttaatttaaagatctcaagatgtccctaaaacattctaaaatttttatagctgtaatgttgacaatatctggcatgggatttgaagagattaatggcaagaagagggatttttatgttgtttcatgcaccagagaaaatgaagctaaagggattttgaaaacaagaatgaatcgagagttttgctgttctaagttatgtaaagatatcatggactttatatcccagttcaatgtagaacttcataattttataaatatacatatatacataaatatctaacacatatacatatacttaatataattcatgcatatatatgcatatatacatacatacttcatactgtatatacctactttaatatatagatacacatatgtatgcatacacacatacacacacttaactataatatatatatacatatgcttaatataattcatgcatatatatgcatatatacataccttcatattgcatatacatactttaatatatagatacacacatatgtatgcatacacacagacagacacttatctataatatatatacacctgtctgttcttaccacagatatattcctaggagggtggtagttaaggtactaaagtagggtcatgtaaaatgagattttagtaaattcagaaagactttggaaataatctaccttatttacataaaaaataatatggtgaaatagcaaacaaaatgatcgtatgtctgttaaaccaaatattgtattgacattacttacgaatactaaagtctgaatttttttcttgttttttgctgctgtgttcataatgttatgatacacgatgatctagtacaaggaatttcttgaaagcatatttcaagaaaatagaggtaaagggctctattttatcaatgccattagttactggccacctgctcttatgcgtagggttctgtttaggatatagacatataaataacaaaaatataaatacataaaaaagccatttgccaagtgccaaatggtgcagggagttggaagtcggagattttatcattaccatggctagcataataaaaacagaaagaaaataataaggagatacaaaacagatgggcaagaaaaagaattttcaagaaatgtgaagggaaatagtaaagagaaagactatttaagatgaaaaatgttaatatgagaaaatcaaatgatgaaaaatagcaagtttttttttttagcaagagaatttattcttcatagaacctgtatgacatttatttaagaaacacagaatggtgtcatttcaatttcatgacattccttgtactggtggtacaattttttatacacaggaataaaaaaggaataaaaaagtaaaaggataaataacatagttgagtcctgagaaaacacgggtttgaactgcatgggtccacttacatgccatttttttcaaccagactcagatcaaaaatacagtattcgcagaatgtgaaacctacgtatatagagggccaattttgcctgtgtgcgggttctgcagagttggctgtgaaatgtgagtatgttcagattttggtatacatgagagtactggaaccaataccacgtgcatgctgagggacaactgtatatagttgggagctgtacaaatatataactttactcatgtcttagaacccaaatacagctaaataatacacctgcataacttgaatgtcgttctgggtttttagtactgttggaaagtgtagaccctacactatgcaagtgggttggatgaaggatgacaatgtgcagtcaagtcttgttattcactgtgtttctataaagtcactgtgaacactgaattagtgaatactgaagcattcctcccaggagaaatacaatgatagatttctgggagcctctgctcataacatttttgtgaaccagcaatgtataatcccattttgcctgtttttctgtttaaaaacatcttattgaatatatattattgatccattaacattcaatacacagccaacagcactgtaactcaagcctgaaggaaacttacctaaggaacctattttctttctaaggtacttcacagccttcttaagcttaggaacactagacagaaattcaccatcatgcttggggccatttaaagcagcaaaatcaccaagaaaaagcataaaaatatgaaaaacatagcattaaatacaccgctgaaaggacacttgtttaccgtatgagacctgaagcaagaatgcagagtgttccttttttgatctcagctgggaacatgtgtggtgggtgacttaaatttttcaccactctatgcatacacacaaatggctgtgaaaatgctatgagcattgattttagggatacaaattaaatttagcaagttttgagaactcccaaacacagaatgtgtgaataatgagaaccatctgtacaaagtttcaatcaatatactgcttgattaggccctttttataaagcactatactgtttttagttgcaaatggttaaatcctttcatcccatttggttatggtgtttgtacagaaaactaaattacagacatgtgtattgttgactttctctaattgcccttttgaatgatctgagcagagatcaactgctggaccaaattgtacgtcgagattataatatccaggttttgtcaggcactatggttaagaagtattgtcagttaagatgtactgcaattttaagcaaaagatttttttacatgctcaatctactaagtaaccaggagaagacaaatgtacaagatatttccaagagcattcttgttaccaactgaagaactgtattaataattcagtcctatacagtgctacttagaacttcagtgtcttcttgttaagcgaagtggatgtaaaaaaaaaaaaaatgcaaaggaatgtcataaatgcagtgaatacaaagctgaatttctaaaaagtggagcttgcaaagggactgtaggtgcaatttagtttgaaataggtatgaaatcaaaattttaataacaagtgtcactttgtataccaaaacctgttcatcaatataatcaaacacctagatatccatctgccttgatgatgtttaccatgaatttcataatcccaagtcaaacccagtgtattctactcacatatttgtgagctgtcattaaaggaagctagaacagaatgtagtatgtcatatatatgtgtgtgtgtgtgtgtgtaatgtgagaatgtgcatttatgcaactgagtgtgtgtttgtgtgccttgaggttaagatgtacaagaagtaagcatttggaaagtttgctttgacattacacacgcacacacacacacacacaacccccatttatgtatatatctacacaaacatagacataataattatattaaactctactagtttcctattgctcatataataaattaccatgaacttagtgatttaaatgtacatatattttttatcttttatttttttgagacagagtctcagtcactctgtcgcccaggctggagtgtggtggcacgatctcggctcactgcaacctctatctcccaggcccaagcaattctgatgcctcagcttcccaagtcgctgggactacaggcgtgcatcaccaccccaagcaaatttttgtatttttagtagagatgggcttttaccattttggccaggcaggtctcaaactcctgacctcatgtgatccgtccaccttggcctcgcaaagtgttgggattacatgcgtgatccactgtgcccagcctgttttttttttgtttttttttttttttttatctttcttagagttctggactaaaaccaaggtgtcaatggggcgctgttcattctggagactctaggggagaatccatttcctagcttctagaggctgcctacattccttgattcatggcccctttcctccattttcaaagcaagcagtatagcatcttccagtctacatcacattactctgacacactgcttttcattccaacatctcctttgactccttgaaggatttttttcttccttttttttgatacggagtttcactcttgttgcccaggctggagtgcaatggcgtgatcttggctcactacaacttccgcctcctgggttcaagcaattctcctgcctcagcctcccaagtagctgggattacaggcatgcaccaccatgcctggctaattttgtattttgtagtagagaaggggtttcaccatgttggccaagctggtcttgaactcctgacctcaggtgatccacccgcctcagcctcccaaagtgctgggattacaggcatgagccaccgcacctagccaccttgaaggatctttgtgtgtttgtgcttatttttaattggttccatccacataatccaggataatcttaccatctcaaagtccctaatttaatcaaatctgcaaagtaaactttgcctttttatggtaaaatattaacttaacgggactgggttgttcaaactctgtacattccaaagaaatatctggctcttgactggcttctgggcaataccagatagtttattttaataatgtatggtgcagcttttaggttacactgtatcagtttgaactctggagaggctggagatgactaaagtcagccatgtgagtgttccatgcctactacaaactccaatacaattctagacaccaagacttaggcaacttttcgttggcaatacgatgtgtgtgttgtcacacatcactgttgggataattaaatgctgtccagatgacttcatgaggagaggaaaactggaaggtggcacctggtctttcctgaacccggttgtatgcaacttttttctttgttcacttcagtctttatctttttgttgtaataaactgtaatcatgagtgtaactgcttttaagaattatatgagtcctcctaaggaataattgaacctgagagtagacttgaggactcctaaatttcgccatataaggcaacatattcatagcttcctaagattagaacatgtatgtctttgggggatcattactatgcctacaacagtacataaaatacatgactcttgtgtagaaacttcttcaatttatttgaccagaggactagttttttttttaatattgtcaaaaaagcttggaaacatatgttcctttattgagtcaagattcagttttcttaagagatttttatcaaatgttttgcaatatacctcttgaaaactaccctttcctatatgtagaataaaaattaaaagcacaattaaaagcaaaaacctgtcatattactttccatgtttgttatctagtaaatgactctgtaatcaactatttcctagcaataaacactgaaaaacatactcaactttcatctaagagtacaagaagtaatcaagggaatgggaaaactcaattagctaccagagactgtaaaacatctgttctgaaaaccaaactccaacaattcaatatcaatatctttaaagggataaagattattaatgtaaaattgaactaggaaagatgaaaaacccctgcactaattctcaattatattgggtttaaaggaaaggcaggaataaatcatatatacccatagatggaaataatccaggtatacatacacacacacatacatatatgaaaaatctataagcgttaggttttatattagtatccatgatctattttgagttaatgtttgaataaagtatgaggtgttcaggtcaagtttatttctctgcctatgtgtatccaaataccctagcatcatttgttgaaaatgatagtttccttcattgaattgcttttacacctttgcaaagaatcagtttggcataataatttccttctatttctgggttctgtattttattacattgctccatgtttctgtctcaccaccaatatcacattgtcttcattactgtagctatatactaaggtcttcatgttgagtagagcaattcctcccacattaatcgttttcagtcatgaaatctatagatcgatttgggaagaattgacatctttactatgctgagtcttccaatccatgaatgcaatatatccctgaaattatttaggtcttgatttcttttatcagcattttgtaattttcaggatatatatctcatatatatattgttaatatcttactatttcatttttggggaataatagtaaatgctatttttttcttttttctttttgtgtttttaattctaaatttttaaaaagaaattttaagaatatctaaaatttcaaacgccaagttccttctagcaataatgggaaaaattaacgtttattttgaaggttttttttcttatctgacaagtgatgttgaatctcacttacacaattaaaaagaaacaatacacaataactattacaacaaaatgaacagactttggtactggtttgaagagattaagagcttaaatggtcttaaagagattatattgctcatttgccagaatccatgctttcaaagaaggctgaccacaggcagcctttggaaattaattattaagtgtatattattatatataaaaccttttcatgctgcaaacactacaatatatttctgcaatatcaactaagaattttattctttttctatgcttacattttagaaaataacagtgttttaagtcaacaacatacatggatggtaatatttatgctaaatatggcataacaaccaaataactccttttatttagattcccatatactataaaaacttacaatgcatctacaatttaataaagtatgtgttatcaaacaatactataaaatgaataattgtagtagaaaccaaggttttacccccctctttttgagaattatgctttacatcagtcctccttccattagtctgttagttaaaaagcatattgtcactgcaaaattaattgtaatgtttcctatgcagacatagtgcttaatagagcccactgtctcaatagaaaaggaatctgtctagtttcagccaaatttatttagagtcagataaatttgattaaacataaaacaagtatccatattgaacacctcagttacctaatcctttacagtctagtccattattaacagtattaagatcataagggattaataaagtttctacagaagggaacattttcccttgtctgatttcagtaaaggagcatatagctttgataaaatgaaatcatcatcatcattttctaaaatattctttatgttttatgtttcttgggcttactgtgctgattaagtggagtgataacatattgcactggtaccttatcactccacttaatcaatacagtaatagagctattagtttgaatcctaaaaacttatcattttttggtcaaaatggaccaatatcagcaaattcatatgattcaatctatgtatctatcttaggtatatatggagtggcgtatgaataaacagatatatatatgatttgatgagttaagaataattgggtccagagaaataaagttctctaggcaccactgttctactgaaacaattaatttgttttgatctttatatacatgttcgattagatgatttaaaattttaaagtattaaaagtttaaaaactagttttaaaagtttttttaaaatgatgtttacacatttaattactcagtgtattttttttttttttcgagacagagtcttgctctgtcacccagggtgaagtgcagtgacaccatttccgctcactgcaacccccacctcccaggttcgagtgattctccagcctcagccaccctaaagtgtgccaccatgcccagcaaaattttttttttgtttgtttgtatttcttagtagagacagggtttcaccatgttggccaagctggtctcgaactcctgacctcaaatgatccacctgcctcagcctcccaaagtgctggggttacaggcatgagtcaccttgcctggcctacttcctcagtcttactgagtattttcccctgagaattagataattggccttaccacattccaaaatccagtgattctcttcttaacatgctcatgttatatcccacacaacagtactaatacattattctaattttgcttgcaatgttgctatagtatgaatatttgtgttcctccaaaatttaaatgttgaaagctaatccccaagaggttggtattagggggtgaggtctttaggttgtgattaggttatgagtacagagccttcttgtttgggattagtacccttataaaagagaccctagagagccagctcgcctcttcatcatataaggacacagcaacaaggtaccatctagtagctaggaaacggtctgtcatcaggcacagagtgtgccttcatcttgatcttggacttcccagcctccagaactttgagcaatgaatctctgttgtttctacgccacccagtttattatttttttagtttacgccacccagtttattatttatttttttttatagaagcccaaatggatgaagaatgatagttatttcatagtgaagaatataaaaataatcagcatcactacatccataatcagagaagggaggggtgggataatgaacagagtcataagtataatgtatttagaaatctgggatgaaatcccataaactgaattgagttgagtgccctcctcccccatgatgagtgtgtatgaaaatgcactagagagacagaaatgaaaaatcagggccatcctcaccatgctctgaactcctatgagattcacttgtcatctttcttttaaagatcttatcgtgtattatctgatattacagttacccattatgaggaattatcataagcataacctttatcatcattatcacctttactatcatcgtcatagacagatgtaaatctagcagaatgcaaatataagaaaatgggacctgactcacgtaagaagactttgaaagtttttcttctatcaaaatctgacaagttggcttaaaagggaagatgtgttcataacagtttctttcattttttccatttccatggctaattacattgtaatactccattaaggtaaggatatagcattgtttgtggtgaaatagactctccatgagcaataatttagattgaaaaaggtaaaatatatatatttccacagtttactttatgcaaatggagtgagttgtaatttttggtgagtgggtgagaggtcagttagatgactgtatggaatttaaaaatatccaattacatatatggcagcatcagaagtctctttagcaactctcacaatattgtatagagataaaagcagtcagacagggcaataatcagagccatattactcatttataaaatctcaatgaaaattttctctgaattaagcgttaacaaagaaggatgaggctcaattgtgatggtacgacagacaccaaatgccaatggtacaatacgtttagtacaattgccatacttctatgtgatgttttgtttttatcatgatgttggagcaatagccacagggacagaagtaagcgggttagagggtaaaagttgaatgaatatgtacaggtataccttggagatactgcaggttcagttccagatcaccaaaataaagtgagtcacatgaattattcggtttcccagtgtatataaaagttatatttacattattttgtagcctaagtgtgcaaagcattatgttaaaaaatgtacataccttaacaaaaacataatttattgctaaaaaagctagcaatcatctgagcctttagtgagttgtaatctttttgctagtggaggctcttgcctcaatgtggatggctgctgattgatcagggtggggttgctgaaggtgggagtgactgtgacaactttgtaaaataagacaacaatgaattttgctgcatcaattgactctttctttcacaaaacatttctttgtagcatgtgctgctgtttgatagcactttactcacagtagaacttctttcaaaattggagtcagtcttctcaaattctgccactactttatcagctaagtatgtgtaatattctaaatcctttgttgtcatctcaacaatgttctcagcatcttcaccagaagtaaattttatctcaagaaagcactttctttgctcatccatcagatgcaattcctcatccattcacgctttattatgagattttaggaattcagcaacatcttcaggctccacttctcattttaattctcttgctattgtcaccatatctccagtgacttcttccagtgacaacttgagctccttaaagtcatccatgagggttgaaatcagcttcttctaaactcctgttaaatgtgatattttgacctcctccgatgaatcatgaatgttattaatggcatctagaatggtgaattccttacagaaggctttcaatttcctttgctcatatccatcagaagatttattatttacagcagctataaccttactaaatgtatttcttaaataatgagacataaatgttgaacttactctttgacccatgggctacagaatggatgttatattagcaggtatgaaaacaacatgagtctccttgtacatctccaaatgagctcttggatgaccagctacattattaatgagcagtaatatttttgaaaaaaaaaatatatttttctgagcacaaggtctcaaccccgggcttaaaatattcagtaaatcatgctgtaaacagatgtgctctcatccaggctttattgttacttttatagagcaaaggctaagtctatttagcataattcttaagggccctaggattttcagaatggtaaatgagcattgcttcaacttaaagtcaccagctgcattagactctagcaaaagaatcaccctgtcctttgaagctttgaagccaggcattgacttctcctttctagctatgaaaatcctagatggcatcttcttcaaatagaaggctatttcatctacataaaaaatctgtcatttagtataaccacttttatcaatgatcttagctagaacttctggataacttgctgcagcttctccaactgcacttgctgcctcaccttgcacttttatgtttggaggtggcttctttccttaaacttcataaaccaacttctgctagcttccaacttttcttctgcagcttccttacctctcagccttcgtagaattgaagagagttgggatcttcctctggattagctcttggttaagggaatattgtggctggtttgatctgtctagaccatttaaattttatccatatcagcagtaagactgctttgctttcttttcattcatgtgtgcatgggggtaacacttttaatttccttcaataatttttcctttgcattcacaccttgactaactgtctggtgcaagacgcctagatttcagcctaactcagcttttgacatgccctcctcactaaacataatcatctctagcttttcatttaagatgagacatgtgagactcttcctttcacttgaacacttagagaccactgtggggttgttaactggcttcatttcaatattggtttgtctcagaatagaaaggtccaaggagagggagacagatgtgggggggtgggggtggccggttggtagagcactcagaacacacacaacattgattaagtttgttatttcatatgggcatgactcatgttgcccccaaaaatgacaatagtaacttcaaagatcattgatcatagatcatagatctccatatattctttcagtgtggcttttgtactctaaccagtgtcagcttgttgagggcagaaatcatttctgattaatctttctatgctttcagtgttactaagtgaatgatatttgaactgcaaaaatgtgatgaaatgtgaagatatgacagtgagtcaagaaagaagatacctctgggctttattcatgaaacagcagagatataaatagctttaacatataaattggttgaaagtaagttaaagcaaaatccctatgctaaagagttataatactgtctattgtgatgtaaatatgatagttgaattcataagaaatttttcaatggcaaaatgaggcttggtgatgagattatcatctctaagaaaattcagtcttaagtattactttatgtcgtttttattctccctgaaagtggcctcaaacattctatcttcatcaacattatccttaccacagtgctacttacacattttcccaatttatcaccagctgtcatgcaaaacccagaacaaagccacttagccaaagcacatgtttgactatgaattagacttcttctttttaaaacaaaggtattatttaaacctattgatgctggcttccatcttaagcccataactggcaaccaacaggttagaaaataaaatttcctaattaattgattaggaaattaaccaatttttgttacatctaatactggttggatgtattgttacatccaatactgtttgtgaaaacttgtgctgttggacttgttgtgcttgttgtactcagtcttgcttaatttgtgaaagcatcacacatttaaagtagcccattagctgctttctagctgaggatgagtaggtaaagacaattatttctacatttgtagttggaagtagtcgtagatattatctaattcagtggctttcttcaagatctcagttttctacagctgtgtctatggggttatagggtgaaagttggaataaatggcagttgaatcaaatcgtcctcttgttttcattcaagatgtctacaccttcaattcttcttttctttgctgggctttcatatgagatttttaaaaaaatgtgtcctgtgtatttttaaaatgaaacttgatctattacagtatattctacagttggcaaatatatgaaatattttctatccttcccactgcattcatgccgagcacatacggcatcaaataatggtattttatcccacgagttccaagtagatacagtctcagtctgttatagtactcctggaaactactatcaagcaattgcacatggtgtgatcaacatttgttatcttttctatcactttctatcttctttattctttaatgatttgtaatcgaatgcttccattttttcagaagagaataaaaggcccagaatggtaatgactgttaccaagtcacgatgtagcaaaattggtgtgtcacttctgacagtttctctaactcccaaaccaatgcatattttgataattgccctcattatttcctcaaatatacttccctgtcagaaaaaaatgattatatataaaattaaatgaggaaaactattaataataaaatatcatgttgtcttgggttgccttttaccagaagtagaccctgagcaaattatttgagtgccagcaacttatttcggaggtgatcccaggaagcacagcaaagaagtgagtgagacggagaaaagaacaccagtacagtgtgagtttcatgagcatgtcatcagtgataaaatgaggttcagtaccacttgagaccactaggagaatgatttgtctcacctgagaagcaagaaaggtagggtagttcccacaaactcccatgtgtaatgtgttaagaacaataatcattataattaaataatggattattaactatcacaacattgtagttctattagtctgagccttaatgcatacagatttttgcaaacttcatggaagtttccattttatttgaaattagtttttgattaaaaataatggaacgctccttcaatcaattaaaaatatcagcagatccatctgcttggaaaatgattcttcctgatgctggcttccatcctactggttgacatcattacgttgggttaagcagtgacatgggtaattgttcttaaaatgtgatcaattctcttattctcccacacacttttgacctgcatttattctctatctttgttatattaaagattgtcaatgttttcccttaatttgacagcacaaatgaatatcaacatggcactattgcctcaaaatggaaaaggcaaaaaagcaatcatgaatcacatgtttctttaatatacagttacagattttgagttcatttccacttctgattgtggttatatcttccaccttccctttcctttcatgccgttttatattaaaggtcaatatgttcatttattaattatgcaacaagtgtcatgtttacaatgtttgtaaatgtagtcacagtatttgattttcttaatataataaaatttatcctctgctttggctaatataagcccacaaatgatcatttcattttctaataaattaaaagtataatgtatacaattggattctgtcaggcttgatgtgtcttttaaacacagcacattaaattccactatgtataaaaaggactgtatataatgtcaatagagaataaacagaattgctacaaaaagcatcgacataaatgattaaatatacatagctcttggcatgtggcttcctgttacacagaattgtgctttttaataatggataatttcaaaaccaatttgctggatacttaatgcatctttgagattttccttccacagagaagatttaggagattataaagtaattaatttgttcacttctttattaattttctaatatcacaaagctatgcattagaaggaagtaggtattaacatctcatatcatttgatacatccactgaattcctacgctctttgcagcctcaaggcacctgtgtgctggcagactttgcagagtactactgaagttgaggctgtaaaccaatcacgcatttgctctgctttcatattgctggcattatacatctgctattcgccaaccccaaatccttcagtatgtagttctcattttctgatgaaaattcagtggaaaaaatggaagtagatatttgcttttaatttcaggtatactttacaataaccatgctgcacagtacaattgggtgattggtgaactccatcattttctattagtgatgaaacaagacaaatgaagaaccacatttttgctttgtgttactttaccaatatgcctgaatccatgtaccttataaacgaaactgtcaatttactcttctattattttaggtgatgattccattaaattaagacctctggggaggtcatgtgtaagtcacaaaggaaatagagcctttaaaataccatgtagggtaactatcataccatcataactaaatatcccgacttttacggtgtgaaatagacaaaaatggtaacttgggtcaacgcatttccctaaactgaatgaggaggaatcttgacaatagtactgctcgtgtactatggttagtaatattagagggaagaaggatgcaatggaaatgatgtcaccttaggactcaaacaaatgtcttactggctgtgtaactcattactactttaagttaaacttgagtagctccctccagaagagctaagcaaagggtaaaaaaaaaaaaagaatagagaattcatggccctcaggcactaatagtttatgaataaatcaataacctgaaaagtacatcacagcaaaataagtggtgaaacaagtattaggaagattctatgcacaggggtgcatgattcagccaaaagtaaagaagaggcactagctacactattttggaggattataaagcatgtaccaagtaaatatatgtgaataagaattgtttatgactgtgggatggagtcaacatttccaaaggcacatgaaaaggaagtgtgttacagtcagagaactgtttgtatggctagggtgaggcattcacatggtggatataagattagactgagcacatggcagggaaattgttgtaaagtaccttctcttcatgcaagttatttgaattataatctataaataatataaagccacctgtggactttaagcagtggaataacttattaagttttgtctttgagagagataagcctagcagccttgtgaagggtaaactggagagaagcaagaaggaaggtacattaggaagctatcagtgtattcgaagtcagatatggggatctaaactaaggtggtgactgtcaggagatatggaggggggatggcagagctaaaagaaatttaggatacaaataggagaaattagttacatggctctctataaagaggaaataagacttcctaccttgcttacctcatatggttcctatgtgaataaattaaacttgaaagtattttgttaattttaaagctttatacatttaaggaattaagattatcaagtacttatgaattaaatgtacttgttttattgacattcctatttgttcacatacagtgaaacaactataaacatttgcttcacttactccttaagaggaaagtagcatgctaggtaactcatctggatttaaatttctaagtggaagtactattgagtatctactctgcatgaagctagggaagtgtggcaaggggactctagccaaggactagaagatagagagactgagagcaagttgtttctcaggcatctgtggaatgcttctccaatgaacaagaaagagaaagaaatatttggaactaaaatatgcatgagaagtaatcaaccttggaataggttgctaaaaagaattaaaagattcttataataagttcagtctctaaatgcaagaaaagtttagtaataatctggtctctggatattaactcacctaatccgtatttaggttgcacatgaataagagttccgtatttagaaaattgtatttattcaatacaatgaataaaatcaaggccaacgaagtgacttctctaattaccgttttggaaaaaaaagatacagaaaatgaattatttaatgatattggaaaaagaggttatccctaagacctatgtatggcagaagaactaaaggcaggtagtgacccaaatctgtatcactaactcaatttccttccaagcaggtacagaagtagatcatggaaggagtgaaatgcatagaatcttataaagatctggttctgattagagctgtttcacaagtagcttaatctcacttaggctcagcttctagatctataaactaggcataataaaacattttggcgggggttgttccaaagattagctaaaataacgcatgaactgcacctagcatgttaaaaataaatagtaaatattaatgtactagtaattatgttttgtaaactaaattttatctcactaaaagaaagtattgtaaaatttatgttgttcttcatccactatagaaaatgaaaactttttgaattagaaccaaatttggaatgggaacatccaagtaataagaataaatgtgaaaagaaactgaatataataataaagttatgaaagaggaaaaataaaatctgatgccgaaaagaacatataggttttttttgttttgttttgttttcctttgttttttgagacagaatctcactctgtcacccaggttggagtgcactggcacgatcttgactcattgcaacctcagcctcctgggttcaagcgattcttctgcctcagcctcccgagtagctgggactacaggcacgtgagcccacctaatttttgtgtttttagtagagatggggtttcaccatattggccaggctggtctcgaactcctgacctcatgatacacccacctcgacctcccaaaatgctgggattacaggcatgagccaccacgcccggcccatacaggtttaaatattgcatggccatgctatacaacagtttgttagctgaagatatttttgttcacaaaatcaatgagattaatcacgcatcactctatacttgctattaaaattactatgtcacgcattttgtggccttccaaaagagacaaggagtttgagtcacagtattagacaagactaaagaccctacatggtttactagaaaaaaaccctttacttcagtgtcaggagacttttattacgtatctggccttactactaactggaagaaacttaaaagaaatgacaatttctctataagtcacactttcctcatctttcaaactaagatatgggactaaatattctttaatggtctccgggttttgaaattctaagttcctataaaagatatctgtctagatgtttgcaacacatacaataaatgtagggaccatataaaaatgtaaagatctcatacctataaaaaccaaaattgtaaatcaatagaaaaatgagcatgagattagaaaagtgcacttttatatatttgtgttatagttcagtaaaacattttaaaaatcaagttgatagaattactttctttaatctacaaagggaaattactaatgaaagttgggaggaaatgttatccttactatagataacatccacatgagcaataaacacaaaaaatggttctcaaattaattagtcactagaaaaaaatggaaatgagaaacacaatgagatactatagtataacagccagaaaggctgaaattaaagactaataatgctaagcattgacatgtccagaacttctataaagtaatgatggttctttgtttacctaccttgaaaaactacgtggcattttcaactaaagatgagtatttcactattctatgacctaataattctacttcttggcacataacagaactacatgcatatgtgcagtaaatttgcaagaatattcaaagtggaattatttttaagagttcacaaatggaatcaatttaaatgttcatccagagtagatggaataagtaaattataggacatttatatgatggcatactacacaacactgaaaattatgggaccacaactacaagaaacaaattagatagatctcacaaacagaatgttgagatttaggagccagaaacaaaagagtacagctgtatggcttcaagtacatacatttcaggaactgtctgtcctaatcaatggtgtgttagatgtcagtattccacttacctctgggagagtattgactaggaagtggtaagacaaagtttttggatgctggtaatattcttttcttgccttgagtaattactggggtgtgcccaatctgtgaaaattcatgaagctggacacctattgatttgtgaacttttatatattcgtgttatagttcagtaaaatgttttaaaaatcaaggaggacagaaatactttccttaatctataaagggaaattactaatgaatgttgggaggaatttttctttgcctttagcctatatatctaagttacttcagcgagtcagagatataaatagatatatagataaatatatacatatatgtgtatatatgcatatctatatatgtcagaagaagggagagagaaagaggagagagagagacttttttcgataattaaattctttagaaaatgtactgcttgagagagaatgactttctggatgattcgattcttcagaaaatatcttgtttacctgtctctttttaatttcctaggaggagttgggtgtgaggctggagatcaattaaattggaagatgttgaaattggataaaaccttacggattatctaacacaatttcttattgttacaggtttatttggcaatagatctattctatctgagatgttatcctttcagccctcctttgtaacctctgaggtctgattctgtgattaatttaactttatacatgagtgaaacattttcaggtagcttctaattaaagagtgttagacattgagataaaatatgacaaggtctctaaagatagcataggaaaaagtttccagggatagacgtacataaactaccaatgggaggtaactgttttcaaatcctcctgaaagtttgcatggtcatgctcatgctagctttaatcatatttaatatcattgtatgcaactggcttttagaccagcctagacattttccttctaggtttgattccagtgaagatgagcaacaggtggaaggcatgctcctttttatttcaagtgacacttcaaatatgtcgctttaccctttactttgaattactatttttcactggatttgctttctttctgttcagttatcattttgctctttgatggacttgccagtttttccacatcactcacactaggaactccggaaacctctagctcagtcctaagtcagctttactgtctgggttcacagttgctgttgctctctgcttagctattcactgtaaatatttttctcttctcatccacataaaccacgttcgtctctaaattcctcagggactgtatcttagtcatcttgctctagcacagagcctggcagttagaatttatcaataaatatttgttggatgaatgaaaagcagcagaaacaacctttcatttcagttggtgggctctaatcctgtctggatgacctaatggagaaatagactctgtttcctgccactgtggccaccaaaaccagcccatgaatgggtcagcagccaaagggagaggaacctgagattcctactcactaatgtgtccatcacatgcaggcttttacttaatctcctttttacacttgtcatagaacataaatgagtcccacatctcccctaaaacccatacaatttcaggttagcattagtgtcactttcaataatccagcttattgttgctggaccgaacaattctacttatagcatgtataaaagaaatctgtactagtaaaaacagactatgatggtccttatcacattttatcctgggagtgttataatcagttgtaacaatgtcatgaccagagctgaatgatgctgataagtttattttcccttagctctttgtattcataaccctgtcttcaaattgcaacataatgtcaatatttcttctggaaatttgataagcaccatccatttaccttcaggtgtacattgacagcaattaatctctgcgtaccacctacgtttccagttgtcatcctgtacctcctctataaacgtttgctcaaaagaacatctcagttttacttttgtctagacaatatttttacccatttgcttatttactgcagtgcactttaggctgtaaccccaaagctcaagaaaataagttttttggaagccagtcatgttaggcatataatttatatgtttataatttaagtcatcttttcaaaagtagtatatatattgaatatttaaagtattcttgttttattcagatgtcacattttatattgcaattagtatctataggtcaaaatgtatggagttataaaaaaggttttctttaaaaaatttgctttccaacactatcaaaggagacactgaaacattacagctaacttgagttttttcatttaatttaaagatagtgtgaacaggtactgaagacactgtcttacattttactaatatctatatagagtggattaaatttgtgaaaacatatatctgcacagagtctataaatttctcaaggtcagaaaataaaccataaaaagatttaattcctctaaagctttaagcatgctaacatttgttaacttgatcttataaaatgacatttgagatgtgtttatcttccaacctaaaatattaatttttattgatcaggttataagtttttgcttacttgcaataactttattattttttctgttgaccctaacatataacaaatgaagacatgtgcagatataacatgttaagaagataaataaaacatcaacactcatgttaacactgcaaatacacatgagagctttatactaagacggccatctcctccctctgacttatattttcctgaaggacatttacatagcataaatattttaaagacttttggctatttgatgacaccttgaacatatactttgaatctaagggaaaggagagtcatatttatctcctttctaaaacaattcaaatgtgatgtgtccctatttgctaagctgaaagtaagatgaagtcaaataaatggaaaatcaaatatttttaaacttctaggagctttttgtttgcttttttgttattttaataagagaaacaaagtaaaacatgtaaaaacacaaactctcacccagcatcctcttacgaaatacccaattttcaaataagcagtactatttgctctatttattactggtctttaagagaaatagacctaaaaaagaacatcttggaaggctagtgtactttcataattccctgagaagctcagtgattatgagtaatgtgaaccagagttcaatattcttacccttggaatcaggaaaaagaaagtcctttaaaagatcaagatctttgatagcagtaacaagaactaaatttgccaggggtagagccgtcctcttaccaatttcaggcaagaagcaatcttttcttgagtagcgaaaggcaagccaactaaagaaaaaatctgtgtgacttcaattacataaaattgactagatggttaaaaaacaatactttcacagaattttttctttctgtaaaactttacttgtatgttggttcttatttcattcagagatatattaagagcaaatgaaattgtgaaattattttcaaatacacaaaaaaagctcccccacgacaactttttctcaattgcctcttttgcctttcctcagttttatagtcttcagtgggtctccctcattgctccatattcctaagccaacaggaagaatttctttcagacccttaagccttgtgtctgttaccatagagacaggcatcacaaagtagctgctcaggaacatcctcatggaaatacaataagaatcctatgggttttacaggaatttccagcgctaccagtgagcagaaattatatctttccctagaaaaaaaatgtggggattttagttgcacattatggaactatggagattgtaatatttggtggtaaattcagaatccctcagctttatgcttagaatttgattatagtttctcctatgacatgaaaaaaaatcccttctcatatccctatgttcaggaaaatataaataactcattgctaattcttaaatttagcatgtcttatcaatcatttactaaaacccttaactgttcttttatagtgcagtgcatttgttttatcttgatcccttctagaacatatttgatcaagaacacactcataatgttataaaagtaagtctctaaaactgcaattccaaagctgctgagagagtctataaacccacgaagagagaagagggtagctgcaagaagaaaattccactcactttaccttgttttccattgactttcaccctttctgtaagtctactgaaatcatacactaacggaaaagcagcaataaaaataacagaatcctaccaaataggtaaattcagcaagattaatggagtcaaactaggcagatattatatataagtcaatgattgcagagacttcaattttttatggaaacattaaataaacattcctcaacaagtaaattatctcaatagactaacagccaaatgaaaccatctttatctgttaggctgcatatttgaactacttttccaagtctctagtacttaagtagtatgggtggttacaatttctgtttatggtatagaactgttatttaactgttacattgcttgtttagatacttgagtcaataagcaaaaaacaaaatttctttatagtctagagatgaggtgagcaaacttttcctatcgagggccagatagtaaatattcctgctttgtggcccacatggtctctgtcataagtactcaactgtgttttagcatgaaaggagtcctatatagcatataaacaaataaatgggtgtggctgtcttccaaataaactatagactcttaaattgaaattttatataatctcatgtgtcagaaatattcttgaaatgaaacaattcagaaacgtgaaaaccattttaaatgactggtcaaacagtaatagatgtgacaatgtggactatcatttactgacccctagcctggatgatgcgagtggagtagtagagaccctcagagaaataaatgtctaaaaaaaagaacatgtttttaaaagaaatgattggactcacagattcttagttaaaaattatctcagacatcttcttcaatttccatttagtgcagaaactccattcttagcactgaacactttaggaataaggagtgcagtgtctcacaaagtaatcaattctctgctcacaacattaactggaagaatacttttccattgctaccaaagaggtgcaagtgagtctaaaccctcttctgcattatagcacatcgaatatttgaaatcagcttaattttctctacttttttccttcaagtattcttcaacttttcacttttctagtactttccatgcccctcaaatgttatagtttgtaggaccttttagcattcagacacttttcactgaacatacccccaaatgttaaggttcctcttagatcatggtgtccttctaaaatatgtatatattaccacatataatatatacatataccatacctatcatatatatacacacacacaccattatatcatatatatccttctaaaattcgttctcatttttttcatttcctttttcaggatacatgtctaacaatattactttgtttcattgtattttgatgtcatatgaattatgactgataataatgatgaccaacaaaatcagtaagatttattcaattaattattactaagctttaactctctcatgtcctgtacttgccagattgattttatgaaccttagcttaggatgttatacttattcctattacaattattctctttgacctcaccacagtttttaggtggtcataatcctttggtaccctaatagttcaatgtatttgttctgcttcccagatagacaggctatctggatcgtccttcagtttttggacattaatatttcacaggccaagtaggttcaagaacagagacataaggcacattacagaagattaggttcaagtcagatggaaccaattttatagaactatgctatagtcctgtgaaaggccctcttcctggtttactgtgattcattaattgatacatcacaggcagggtcatttagccagctgatttattgaccagactcttatgtcaaacagcaaatatttctccattttcaccatatgggcatcataaaaatctttaccaaagtccatgctataatcaagataactagccatattacatacttttcagataacattggagaatcacagcatatattatctttgcactctttctaaaccatctcaccttcttcaggaattgtcagttactcccagtgaagaaaaaatattgcatatttttctggaaaaatatttccagttttaagtaattatttactctccacaatctaattatggactttccttcctatttttcactttagtttattaactccaggaccaactaaaatattgtcgtggctttctctttttaaacagttctgacttttttttttttccaaagcgtgtgtgtgtgtgtgtgtgtgtgtatgcacatgcttaagtggtttgtttttatttgctttttccttcttaaaagatggattatatgagaatgggaggataataggatggagcaagcttctcaggcaaaacatttcaaagcatatttcttaaccgatagtgtcttcccctgctcatctttctgaagagcaacacctgagaggcagctactctagctcatgtgggaaatttcacttgacagtcttatcacaaaaagagaaataagggagatttttttacttaaaaaataatgatgctcaataaaatttttacctaaaagagataaataattgttttagaatataaatgccttagagaaaacaatctgagtttgagagaattggggaaaactcacatagatttataaaagtcactaattctggatttaaaaatatattaaaatgtttgcagtctatttcattgtgtcccacttctctttcacaccttctatttttatgcatttctccttcatcgttttttcttccttaaagcacttcagaagacacaggattaagcaattgggatttgaagacttcacgtggtctcatcactctgcaggctgaccctgttttagagcaagaaatattggcagacatttccagctcttacaatgcatttatcaataagggtttgcctgctcttcaggtgcgtggcatatagactttacgatttcattaataatcaacagctggtgccacctagcgtctgtccaatccattcatcagtgggaccaaatacagagcactttctaaccgcaaatgaagcaagcctaaactataaactaaaaaatacaaaaacacagtttggggattccagtggctgatttaaagtacgctatcttcattgaaaaagaaaaaccttcttttaaaagtaactatggtaacaagagagtgaggctagaaggaagctcacattttttcgaaggagacaattcacaaaaggagagtcctactaaagatgcagtgtaaaagagtttttacagtcttgaatggtcacttaaaacggttataaaaagttgaaaagtaacattggccaaagagggctgtattttaaacaacagtatagacagagctgaattttctcaaccaaccacaaaataaccctgtagcatttggatgcaaaattctgtcagtctttgagcttcccaaagattaaccaagttctgtaacacactatacaaaagcatctacagtacttaaaagtattaaacggaaataatcagagtgcctgaaccacattataaaaaaaaattctttgctgctaaaatgatacatctagaaaactattttctttcctgctgtatatatgaattatgaatgatattcaaccacggtaatgtatgcttcaaggttaaaaagtagtcatccaaatccttgactatttttcaaaacagaagttagcaattattttggagaaatcctagtgtaattagcccaccacttgctaattaatttactgatatttaaatacatgttgtttttaactcaccctttctaagaggaatacgtaattgaaaaccatggactaacattcagaaaaaaagttacataacagccaatagtgttccttaaccagactgactgggatattacaattactacagaaaaggcacagcacatacgagtagcactgtgtacactgaaaggtcatattagatgtacatatatgatagtctattaacttggatgatttagctcctcaggctatggaggagactgggtagagagccgaaagattctgtattacatagacagttaataatcaggcttttcacacttaggaaaatctatttctatattatttaacatctgttttaaacaatcacttgttaaatgtttgaatgttttatttgcttgttaccctagtggtgataaagattatttcaatatgttcagtctgattacagtcactgacagatccccatgacagcatgtgaagataggttatagaaacgatgcatagtttatacaaaaagcataaattgctcccctttctccaaaaactttatttttggagccaaatactgtccatgctcatgctccatttgcttaaaagtacttataattataatccactgattgtaggggaaagaaatattgcaaaacagagaaagggttctaaaaatcgtacgcaggcaagaaagaatgtaagacaaaactcattaaagggcaaaataaataaataaataaataaataaataaataaatgctcacattttcaataatttatcacttctgtcatttttcattaacagccttcaaagccctatctgaaacaagctgatacagagaaattaagagcagtaatcaagcgagaaatcatagaccagctgggtcgacatcaacttggcaaaacgtgaatacagttcaatagctgaaacagatgctagagttgttgaaaaaccctgcaggagatattgatatattttcttcatataatgcagaatgactgaataaatgtcaaaagctagaaattgatgaggagaaatgactgacagccaaactccttataaaatagaaaccaagtataacaattttcaacctatccaaacattctgtacattctcatttctctcactgtctgaatatgccaatacatcaatcagttcttgcaactaaattgcatataactaatctggggtagatttccccgaagatttttttccccctgtcatcatctacctgaagaaacctagactcctgaacaatactttattctaaaatcttctaacactgatttctatcccagaagtgttttcctgaggttggaggcaagcacaccccctccccaaaatctaacgcagcacaaggcaattttaaaatccattctgtaaaagcaacactgtttgcagagtttgaagagctcggcaacaaaccccagctaccaacagctgcttgttcaaacatatgctttgtcatggccagcttctaattgtatttgtaatgatgtaatagctttaataatcctaccttccatgccagctgtttttcctgtcactccatcatgccaataagttggctgctgtaacaaatcaagatagtgcaaaacagcatctttctcctgattctgtcatcttcctgaaagcattctattactgccgactgctgggaaccagaaagtctatttgaattccaacagctcccctttcgcatgattcaagttaggttaggtgggcatgcctaacatgattctttcagtcatttattatgcagctgctacaacgtcggtgtggtaaccactctgactatctgatacgtcagtcgaacaaaacctatacctcggagcaaacacatgagccagagcagcgtttgcatttaacgagcattcttcctgcctaaaaaacagtggatctgcaaatctctttcagtatctactcgctcttctgtacagatgcaaagcctttggattagattattttcctaagtgtaacaatagtagagttcctcgccaaacatcatattattcacactgaaattttggctgatttttacttatcttcacagccttttaagggtaaaaactctcttctgaattgtacttttgcaataagatgttgtgtgctcagctccacatttctgcgttgtaaaatatagcatgcactttctcaaatggaatttgcctcttgtgactctatagcaaattttcaaataagaggatatttcaagaaaatattatttattttgcacactggagatatttaaagtctggcaccctgtatgcttctcccaagggtagactttatacttgatattttgactttagatgagtgatttcttcacaaagtaagaaattagattagctgaatctcttacacaacttctttaacaagtaaataaatgctattcaggaaaatgcattttgtattttaaaaatactaatcgtgaatcagtatttgttaaaagaaactgtaattgttatcaattataccgtataattttctctaaaacttccaagtttgcctgtcttgggggcacttatggtttgaaattataacacaagaaagtttaagtgttttcatgagaaaaattaataaaatcatatgtttcctctcagatttgtattaggtatttagtttgttaggaaagctatcccccctaccacaaaaagtaaacagacagctggtttcatagttacattatgaaactataaggaataactcatttagcatatgtgaaatatgccaatatcgctattctgaaatagtgttttcctaaggggttatggtgtgtgtgtgtgtgtgtgtgtgtgtgtgtgctttgtgtgcaagtactcatacattttagctattctacttccatttgatttttgtataacaaacacaaataatccctatatatcaagatatacacaacaatcagtaacttatagtttattagatataatttataaatgcaagaaataaacctgaaagataagttgagtccatatgaatccaccaagatttctctaaaataatatacatatcattccacacaactctgaaaatactggtatatcaattactgctattttacataaaaagtcttcggtgattagcatatctattttagagattgagaatagcataaatgccatgtgttttttttgttgtattcttggcttctactagcctctccagcttaaactcttgcctctcttcctctttatactttattccagccacaatggacttctattttttcttctaaaatgctggactccttcctgtttcagatattttccgtattctgtttcatctattcataagtctgtcttgaggcttgtgaaaattaattttttgtaaaaatgtatacaagttgtacaacatgtttcaatatacatatagtgaaatgattactacagtaaaagtaattaacatatccatcctcttacatggttaccctttttttgtgtatttggtgataacactcaagattactctcttagtgcatactgtagtgttattaactatagcccctatcctgcacattagatctctagaacttattcatcctgataatgaaaactctgtgtcctttgaccaatatcttcccattctccccctccctctgcccttggtaacaatcaatctaccctctgcttctttatagctgactgttcagattttacatgtaagtgagatcatgcagtattattcttcctatgcctggcttatttcacttagcgtaatgttcttcaggttcacccacattatcacaaatagcaggatttccttcctttgtaggctaaatattatttcattatatttacatatatcacaatttctttattaatttatctgttgatgtacactcaggttgttttcatgccttggctattgtgaataactctgcactgaacatgggagtgcagatatctcatctagatactgatttcatttcctttttatatatacccaaaagagtggtaatttgatcctagggcattcgtattttaactttttgaggaatctccatactgttttccataatggctatacaaatttacattcccgccaacaatgtataaggattcccttttatccacattcttgccaaaacttgttattttttttatctttttgataatagccatcctaacaagtttgaggtgatatttcactgttgctttaatttgcatttccttgatgattagcgcttttgagaatcttttcatatacctgttggccatttgcatgtcttctttggagaactgtctattcaggggctttgaccatttttaatcagattttttgttttttgtttgtgtgttttgcttgagctctgagttcctcatatattttggatgaaagctgcatattggtcatatggtttgctaatatattctcccattccacagttgtctcttcactctgttaattgtttcctatgctgtacagaaggtttatggtttgccgtagtacaacttgtttaattttgattttactgtctgtgcttttcatgtcatatctaaaaaatcattgccaagaccaatttcgagaatttattttttcatgcactttcttctaggaattttgtagtttcaggtcttacatttaattctttaatcaatttttagctgacttttgttgtgtgatgtaagggtccaattttattctttagcatgtgtatatccagtttttcaaacaccatttattaaagagaatatcctttcctcatagtgtactcttgttgcccttctcaaaatttagttgaccatatatgaatgggtttatttatgggccctccattctgttgcattggtctatatgtctgcttttatgccagtactatattattttgattactaaagctttgtcatataattcaaaatcaggaagtgtgatacctccaatgttgcttatccttctcaagattgctttggctattctctttcttttgttgtttcatttgaattttagattttttttaaatctatgaaaaatgctattggcattttgatagaggttgtgctgaatctgtaaattgctttgagtagcatggacattttaacaatattaatccttctagtccatgaacacagaacatacacccatttatttgcgtcttttaaaatttcttaaatcaggccacgcacggtggctcatgcctgtaatcccagcactttgtgaggccgaggcaggtgaatcaccttaggtgaggagtttgagaccagcctgactaacatggtgaaaccccgtctctactaaaaatacagaaattagccggacgtagtggcgggcgcctgtaatcccagctactcgggaggctgaggcaggagaatcgcttgaacccggaagatggaggttgcagtgagcagagatcccgtcattgcactccagcctgggcgacagagccagactccgtctcaaaaaaaaaaaaaaaaaaaaaatctttaatcaatgctttgtagttttcactgtataaatatttcaccattttagttaaatttattcctcttttattcttcctgatgatactgtaaatgaaattgttttctaagtgccattaacagataaatggataaaaaagtggtatatatatatatatatatacacacacacacaacggaacacacaacggaatattcatttatataaaaaaaacttaccatttgcaacaacatggatagaactgaaggacattttgttaagtgaaataagccaggcacagaaagacaaatattacacgttctcactcatatgtgggagctaaaataattgatctcatggaggtagtgagtacaatagtggttacgagcgtctgagaagggaagtgaagagaaggggatgaagagaggatagttaatgggtacaatacaaaagtacagttagataaaagaaataaattctagtgtttgagagcatagtagggcagctatagttaacatgaatttatagtatatttcaaattgccagaagagaagatttggaatgttcccattacaaagaaatgataaatatttgagatgatggacatcctaatcaccttgattcgatcattacacattgtatgtatatattggaatatcacatgtaccccataaatgtgtaatgtatcaataaaaagctaaatctaaacattttattgatttccttttcaaaatgaaatcaactgatttcatttttagagaaaagaaatgctaccaatatttgtatgttgattttgtatctagcaattttactgaattcattgattagttctgacaaatttttaatgaaatcattagggctttctacatatagaatcgtggcatctacaaacagataattttacttcttcctttccaattccactgccttttatttctttctcttgcctaattgctctgactaggacttccaatactatgttgaacagaagtgttgatcatgggaatccctgcattgtaccagatcttagaggaaaagctttcaattttttccccgttggttacaatgttagctatgagtttttcataaatggcctttattatgttgatgcaagatcattctacacttattttgttgacagttttcaatttacccatgaatacatgttgaactttttcaaatggttttttctgcatctattaagatggtcatgtggttcttgtcttttactccgtttatgtgatatatcacattgattgatttgcatgccataccaaccttgcatcttggagataaatcccacctgatcatggtatataatccttttgatgtactgttgaatttgttttgctagtattttattgaggatttttggatctatacacatcagagttaccctcctgtagtgttcttttattgtggtatctttgcctggctttggtgccagtgtgattctggcttcataaaatgagtttggaagtgtttcctcttctcatttttttttttttttttttttgcaagagttaaagaagaattggtattaattatttttgaatgtttgatagaataaatctgtgaaggtatctggtccagtggttttctttgttgagaaatttttcattactgcttcaatctctttgttaatggtctgttcagactttctatttcttcttgattcagccttagtaagttgtacgtttccaggaatttatcaatttctagactatctgattttttaagacatagctgctcataatagatcctgatgatccttattacttctgaggcatcagctataacgtctccccattctttatttcagtctttcttttattcttagtatatataagggtttgctgattttatcttttcaaaaaaccaaccgttagtttttattttttatattgtttttctattctctatttgacttacttctgctccaatcattattatttacttccttatactaactttgggcttagtgtcttctttctcttctagttccttgaggcataatggtagattgctgatttaaaatcattctttttaaatgtatatgtttagagctataaacgtcctcctcagtactgttttttctgcattccataagttttgatatctttttaacattattttttgtctgaagatatttcttaaatactcttctaattttctctttgacacaatggttgctcaagagtgtgtggcttagtttctatgtattagtctattttcccattctcttgctgttactgatgtccagtttcattccactgtggtcagaaaagatacttggtgtgatttttatatgcttaaatttatttattaagagttatattgtgagcatgccctctttaatcaattctgttcaacatagcaccggaagtcctagtcagagcaatcagacaagagaaaaaaatgagtggcaaacaaattggaaaagaagtcaaactgttgttgtatgctgataatatcatgtacctagaaaaccctgataaacaaattcagtaaaatttcaggatacaaaatcaatgtacacaaatcaatagcactgctacacaccaacaatgaccaagctgagaatcaaatcaagaatccaaccccttttacaacagctgcaaaaaaaaaaaaaagcaaaatgcctagaaataaacttaaccaaagaggtaaaagttatctacaaggaaatatgcaaagcactgctgaaagaaatcatagatggcacaaacaaattgaaacatcccatgctcatggacaggaagaatcaacattgtggaaatgactatacagccaaaagcaatctgcagattcagtacaatcccatcaaaataccatcatcattcttcacagaactagaaaaaaatcctaaaattcatattgaacaaaaaaaaagagcccacaaagccaaagcaatagtaagcaaaaagaacaaatctggaggcatcacattacccaacttcaaattacactatgtggctacagttaccaaaacaatggtagtggtatgaaaataggcacgtagaccaatggaacagaacagagaacctagaaatgaagccaaatacttatagccaactgatctttgacaaagcttataaaagcataaattggggaagggacaccctattcaataaatagtgctgggaaaactagtaaaccacatgtagaagaatgaaactggatccttatctctcaccttatacaaaaatcaactcaagatgaatcaaagacttaaatctaagaccttaaagtataaaaattctagaacataacatcagaaaaactcttctgggcattagcttaggcaaataattcataactaaggcccccaaagcaaatgcaacaaaaacaaaaataagtaaattagacccaattaaactaaaaagcttctgtatagcaaaagaaataatcagcagagtaaagagacaacccatagagtgggagaaaatcttttcaagctctgcatccgacaaaggactagtatccagagtctatgaggaactcaaatcagcaagaaaaaaaagtctcatcagaaagttatcaaaggacatgaatagacatttctcaaaaggagatatacaaacagtcaacaaatacatgaggaaatgctcaacatcactaattatcagggaaatgcaaattaaaaccacaatgagctgccaccttatttctaaaagaatgaccataattaaaaagtcgaaaaacaataaatgctggcatggatgtggtgaaaagggaacacttttaaactcctggtgggaaaagaaattagtacaaccattatgtaaaacagtatggagattccttaaagaactaaagtagaactaacatttcattcaccaatcccactactgggtatctacccaaaggaaaagaagtcactatatgaaaaagacacatgtgcagacatgtttatagcagcacaattcacaattgcaaagatatgaaaccaactaagtgcccatcaaccgagtggataaagaaaatgtatatatacaccatggaatactattcacccacacaaaggaatgaaataatggccttcgcagcaacttggatggagctggaggccattattctaagtgaagtgactcaggaatagaaaaccaaatatagtatgttcttacttataagtgggaggtaagctattaggacacaaaggcataagaatgatgtaatggactttgggaacttagtggggaacgttgggaggggattgaggggtaaaagactacatattgggtacagtgagcattgcttgggtgatgggtgcactaaaatctcagaaatcaccactaaataacttatgcatgtagccaaaacccacctgtaccccaaaaataattgaaataaaaaaaagttgtgttgtgacttaacatgtaatctatcctggagaatgttgtgtgtgtgtgtttgagaagaatgtgttttctcctactgttggatggaatgttctatgtatgtctgtcggtccatttattctctaattttgttcaagtacactctttattaattttccatatgaatgttctgtacgttattaaaagtaggatattgaagtctcttactaatattgttttgctgtatatttctcctttcagatctgtcagtatatgcttcatatacttaggtgctctgacagtgagtgcatatagatttgctcttgttatatctttcagttgatttcacccttttattattatataataacagtctttctctagagtttttgtttaaacttaaagtctattttgtgataaagtatggccacttctgcttttttttttttttttttttttgagacagagtctcactctgtcacccaggctggagtgcaatggcatgatcttggctcagtgcaacctctgcctcctgggttcaagcgattctcctgcctcagcctcccaggtagctgggattacaggcgcccgctaccatgtctggctaatttttgtgtttttttagtagagatgacgtttcaccatgttggccagactggtcttgaactcctgacctcaggtgactggcctgccttggcctctcaaagtgctgggattacaggcatgggccaccatgcctggcctactcctgctttcttttggtcactatttccatggaatatatttttccattccttcactttcagcatgtgtttccttgaatctaaaataagtttccttagacaacatatatttggatactttttaaaattcatgcaggcccactatattttttgattggggagtataatccacatttatttaaagtaattattgatcagaaatgacttgatattgccattttgaaattttatttttatttatttatatgtttttgtagagacagggtcttgctatgttgtccaggctggtcttgaactcctggcctcaagaaatcctcctgccttggcctcccaaattgctgagattacagacatgagctaccacacctggcctgactattgccattttgttatttgtttttcatgtagtaattttgtccttttttctcttgctgttttccttcatgatttgctgttgttgtttttttgcattgataggctttgattctttcctttttttcttttatgtaacaatgataggctttttctttgtggttaccatggagtttacataaaatatcttataataatctatattcagctgatagcagtttaacttcatgtacacacaacaactccagacttttacctctccttccccattttatgccagtgataaaacaattttcttgtatttattttatgtatccattaatgttatctatttatggttatttttaatacttttgacttttaacttttatagtataattaaaacaatttacccaacactgttatagtaatacagtattctgtttttctctatgtatttacatttaccaatgggttttatactttcatatgctctagtgttactgtttagtgtctgttaatttcaatttgaagaactccctttagtatttcttataaggcagttctagtgctgcaggacaccctcagcttttgcttgtccaagaaaatctcttgccatcgtttttgaaggacaagtttgctaaatatagtatttttggtagacagttttctttctcttctggcttgcagcttcccctcacgtttgtctaccttccatccaatctttaggtataatcttgaaatataattttctgtgcgaggcattattgatccccagataaaattatattctgctacgcaatttcacagcaccttgtatttcctctatcttcataatagtaatggcatatactatacaacatgggggaataggcactgttataaaattatatacgcacaaaacatatgtgtgtgtgtgtgtcactttgtctatccatccgtctacctatctacttatccataattcatttatatattctcattaaatccttactctgaacctatgagggcgactcttacatgcattttatagataaggaaactgaggcacaaaaaactttaaaaagttggccaagtctaccttctcagcacagtaggcagcaagtcagtcttgtaaaaacctggccaggccacacaactttatttaattgtttgtatttcctggtatactatcagttctcgaaactggatattatgtttgtcttgttaattgctaaatcctaatgtctaggatggtacccgaaaagttgtgtttcatgaattcacttatccagtagaacttgctttatgaaatgttctgtactaagcactgttgatatggagatgattaaaataaacatggattctgtgttgctggcatttgtgaactagtactaaactcaggtccaagggttcatagacagaactgagaaatgttcattgggatgaaagaaatactacatctttattttcatcaatgtctcattaaaatgtagcagtatttttatttatttttgtaggttataaaccatagtagtattagaagtacctgtgacttttgttactaaaaggagtaacaaatatttcatatcattttatagaagctgtataaatcttaaaatatttttacattcatgactactttggcattatggttgttattaagcccacaaatatatattgttatttaatgtgttaataaagaagtatgcatattattatattacaacttttaaatctttagaaaaccgtatttcgatacaactagtttctgttgtaatcctaaatgttttatcttgcatatgtaataaaattcagacacacttcacaagatgtgaaaggctttaaaggaacaggtctttaaatttcaccacatgtcaaagaatccctggtttaggggataggagaatatagcattttagaatccctggtctaggggataggagaatatagtgtatttttaatagcactgtctccatagtcagactacttgggttcaaattattgataggtgacttacaattgatgtgttctatggcaagttacttaacctcagtttattcttctgtaaaataggaataataattgctcctttgcattcttgtgataatacattaagaaaatgattgtaaaatacttagtataatgcctgacatctatttcacttttaataaatgttacatatcattagcaagagagttagatactaaagggttatgaaaaataagattataaaaagaaatacaaagtattaacaaagatttttggaactggaactcatatacactactgatggaaatgtaaaatggtaaaaaactactctgaaaaatagtttggcaatttttgagaaacctaaacgtatacatactgtaagagtcatgcttcctacttgaaatgaaagcatatgcccatacagatttatccaagagaaaaagaaagcattagccaccataaaagcttatacatgaattttcatagcagctatatttgtaataaccctaactgaaaatgacccacatgtttaccaatgtctaactggataaataattgtagtatatctatataatgtaatgctactttgccatggaaaggactggaaacttgatgcatttaaccatgtaaataaattgcaaaacaatgatactaactgaaggaagccaaacaaaaagagtacataccgtatgctttcattcatacaaaactctagaaaatgtaaatatatctgcagtgacaataagcatatcagtggctgcctagggaaggtgggggtgatagatgaggaggaggagctacaaaagggaaactttttggataatagatatatttactatctttgttgtagtgatggtttcatgtatgtgtgtgtgtgtgtgtgtgtatatatatatatataacattttaaatatgtatggtttattgtatgtaagttatacctaaaaaatcctaaaaataacacttaaaaaactccttttattatattttagagtattcctattaatttaacaaaatagttaaaatataacaatcacttccttaaaagataatctacaaaacttcatatagaaataatgcatgcggtaaataattttatcaactgcatataacgctgaacatcccaacgaaataatttttctcaccacttgttatttgcagttctttatgccatcattgaacaatgttgcaattgattattgtccaataacaagagtataattttgtcccatttaacatatataattttatctattgtgagcacctaagccagtaaaataaattattagtctggttataaaatggtcagctgcataaaatctaaggtattgatcaatattagcttgttgccatataattctatgttatgtgaaaccttggaataagcttcctttgttaaacaatgattaaatgttgaataacttgattttataagttatccttatttcacaacaatggataccatatcaaactcaatgattatttaggggagaagaggactaaggaaaagtcaggcactgaaaataataaaatttattcacccataaaattttctcacatggcattttaaatatgttaatatatttttaaaaagccagataactaaacttataaaaattatcacatctgtgaagttgtagttggattaaggaaaagtagaaaatcctggccttattattctattttaacactcactccctacccagcctaaatcagccaaaggatatttttaaaacacagatacacataaaatatcagattatgtctctgtctcaaatctcttcagtggcttctcaatacctttagaacaaaagtccttactatagcctgtaagatcacaaataatatgtccccttactttcctttttttttttttttttactttgctctaatcccactgatagtcttatttctcttctaacttatgaaacttatttccccttgggacatttcattaactcttccttcctaccaagaatatccttccgcagatattgcaagactcacttctttctttgtagtctctgcaaaaatgtcacctcctcagaaggcccattttttacttgtgtctttaacacttccatgaccttgatccatttctcttttttttgcttcacttttcctttcagcacttatcaccacctggtatcaaattattaatcagtcagcccagtgattttctctctcggcagaatacaaactccatgatgggtgttccatcgtatgcctcattcaccgctccatctctggcatgttaaataaaaataacaaaaccaaacaaaaaccaaccaaccaaacaaaagacatttggcacagagtcagcacaaaatgaatatttgttaaataaatgaatggaaaaatagttaatatataggattactgttattatttggcttccaataggtgactttagaaagctgtctatactcacaggtttttctcacaatatacgggaatacatgtttccactggaaataacagaagttactgtaaaaaatcgaggaattttcttccagaaaactatctagacaggacctaatatactaagtttattaggtctctacctacaacaatatttcaccaccataattattacaagggaataactaatatatgatattgtgaatcacctatctattaatttgcacacatttattaagcacttattttatgctagacacttttctgggtgttgggaataccactgtcctcgtagagtttgtggttttgtgggatagatagatattagacaaataaaagtctgataagaactaggggcatcaatacagaatttttagaagcatacagttatagggctaattttatcatagaaaattcttcttaaacgtacaactaaaggataaataataattgcatgggtcaagagataaaagcagagagtactataggaagaggaaataaagcaggaaaacattcaaaaactgaacaaagtcctccatgcctggagcatggtgaatgtgggggagagtgaagcgtgatgaataagattagggtctcaatctaggtagttgtagattatgtggggcttctcttctttgttagcaatggtaaagatcctggagtttattgtaagtacattggaaagccacttaaagttgttaagtcaatgagttacatgactaaatttggtaacaaacataagcgtgaatgtactggtaagaatgaattaaaatgaggcgggcagtaattctagatgcacataggcttgttaaaagacagtttcagaatatcaggaaatataatttgactagattgctagcaaagaagatagaaagaaatgatgagattccagagatgttaagaagggagacttgatagaacaaggtgattgcttcgaaattgaggagggttcagggatatgaaggagtaagcatgtactttcatgttttcaacttgagcaattaagagaatggtggtgtattttctggaaaagccaggttggaaagggaatgatggcttcaattttgtttctgttgagtttgcgatacttgggagacctttaagcaaagatgtacaggagaacacagatattagggtctggatttcagaagacataaacatttaagatgtggcagtgtttgatggtaaatgaagccatatatctggacaaaataaagacagagtaagccaggagaagagacaagagcctaggatggcaccctgaggaactctaacaattaatgcttgggtagagaagaatgagattgtcaggattttgagaaggaatgttcagagaacaagaaaaaaagtaaatagatatggtgctatggaagttaaggggatagaaatttaaagaaagaggaaattgtcaactttgtcaaatatggttgggagatacttctttatctgcatgttgttttagttactggaagagatacattaagatatccaatatgattgttgatttgtccagatctctatttagctgttaattttgctttatccattttgaaggtacattattaaaattgtatttttctatatatcctattgattcgacccattttttcaaggtgaaatgctttgcatctcttattatatttcttgcctgatactaatataaacaaattaatattttgggggttagaggttacatgcatctggagacctatctgtgtcattataaagtagttttattctaaacaacccagggctgtttttttttttctcagtattacaatttttgtattttaaccaaagtgtttaatatataatctatcatcttgttattttctcttcatcctatttttttctttatttttctactctaccatttttgctactcttaattattttacttctacatatagtggataccctacattcattgctattattgtttctttaaacagtcagttgttttttatatttaccaatatttttactattcataagaagctcatttatttttgcatgtctgtttttcatccactaccattttccttcaatctgcaaaatgtgttttagaaaatacattggtgtacaactactggtgtgatggttaatattgagtgtcaacttgaaaggattaaaggatgcatagtattgttcccgggtatgtctgtgagggtgttgccaaaggaaaggagactaacatttgagtcagtggactgggagaggcagacccatcctcaatctgggtgggtaccatctaatcagctgccagcgtggctagaataaaaacaggcagaggaacatggaaggcctagactggctaaatctcctggcctgcatctttcccctgtgccaggtgcttcctgtccttgaacagcagactccaagttcttcagcttttggacccttggacttacaccaatgatttgccagtggttcttgtaccttcagccagactgaaggctgcactactggctttcctatttttgaggttttggacttggactagcttccttctcctcagcttgcagacggcctattgtgggacttcaccttgtgattgtgtgagtcatttctcctaataaactccccttcatatattcatttatcctattagttctgtccctttagagaaacctgactaatacaactagtgataagttatctcagcatttggataactgagactatctttattttaccttcatttaaaaaatactgtctattttgcatgattgcagatttgtatgcagttgtaagaaataatacaaaaagatcttttttacctttcaaccagtttctcccaatgataacatcttgcatagttacagtacaatatcacaaacaggaaattgacagtgagacaatcttattcagattgctccagtttcacatagtcatttctgtgagtgtgtgggtattattttcaaagaaattttatcacatatatatgttgggtgactaccaccaagttccatcacaagaatcccttgtgctaccctttcactgtcacaaacacttcccccttaatttctggcatctaaagaagctagaaaaaggagagaaacataaatccaaagcaagaaaaaaggaaggaaacaataaagacaagggcagaaataaaaaatgttgaaaatccaaaaaccatagagaaatataattgaaacaaaagatggttctttgaaaaaaatcaatacaattgataaactcttagcaatagtgacaaagatcaaaaagagacaagacgcaaatcatcaataacaataatgaaacaaaagatatcactgcaaatcttaaagctcttaagaggataataagataacactatgagcaatgttacactaacaaattccacaaattaaaagaattggaacaagtccttaaaaatcagaagctaccacaactcagcaaagatgaaagagagaacatgaatagtcttgtggatattaaaggaattgaatgcattaatttaaaatctgcagaataaggaatttctaggcccagatgatttctctggagaattctaccaaacacttgaagaattaggccaagactggatccaagatggccagctagatgcagccagaagaaacattttccattgagagactgggatatcaagaagattggcacactcctagcagatcatcagagtaaaggtattgagagcaaacagagggaagacacagacactgggatgaaggtgaaggaagatgggaaccctgcacagggctactgagcactgggactcattcctggcacccaacgactcctgcggagagagtgagttgaacaggcaaggagcaacccgctattgccatataggcctctggaattctggcaggaggagactcctcgaccactacggacacttaagttatcagggagagctgcttagagacgtggtagaggcagaactccagccgaggtggagcccaaaggatttggtgcaggagcatctgcagcggagcacggccaggggcacccatccccctaggctctctatgttcccataggagactttagccctagaagaactgtcagacctgaactctgtagggtggtcttgcccatgagaccgggtggtctgacctgagcacgccttagtcagttggcctctcccaggacctgcaacctggccatgcctgcatgcagtgcagcccccaggtacttcctgggggcctgtatcatagctcctgcactggcagaccgcgccttaccagcagagtgcttcagcaaagtggcctctggacacacacaagcccgcctgcaccctcctgcactgcagcctctccgatgctactttgcctgcaagcactcacccatgcccacccccacatcacagtgccagcatgtatgtgtgcaggtggaccttgatttctcttccttgttagtgcacgtgtgtgtgtgtgtgtgtgtgtgtgtgtctgctgtgccactgctgccagcatgagtgcaccccaccctcgctgtcactgctgcaccgccattgtcactggagtactggtgagcatcaagcctaccagacctacccccgccagtgctctgagcctatgctgacactgctgctggtaagaaaccaggcgcacaaaaaagaggacttgcccccggccctaagtgaccgccactgccagtgtgaatgtacacagagtgtgcacacagtactgtgcccaacagcaccctgtcctcatactaacaccatgatcggtgcaaatgtatgcacatttgccagaggggactccctgcccctccaagccatactgctactgctgctgctgtgatgcctgcagagaggccagcatccttgcactcactagcaccctgccactgccaaggaatgtgcattccaccttgctgctcctgccactgctgccagcacatacaagtgaagacagatctcaggacactgcccaatgaagtgctttggctggcaccacccattagggcgttgtgatgagaagcctgggagcacttcgccccctccagcacagcaagttttaatctcaaggaaccaaagaacaaaactgggtcccaatactattctcccagaattagggcaagcagtccaggagtcctgagctgagccttggccccttaaaatcttctaataattaagccagttgactgaagaaatcttatacaacaatcaaaccccaaagggcaccaaatgggataaaagaaaaaaaatccaaagaacagcaacttcaaagattgaaggaacattagcccacaaagatgaaaaagaaccagcacaagaactccggcaactcaaaaaaccagagtgccttctttcttccaaacagctacactagttcttcagcaagagttcttaaatgggctgagatggctgaaatgacagaaatataattaagaatatgtatagaaatgaagatcatgaagattcagaagaatgttgaaatccaatccaaggaagctaagagtcatgaaaaagtgacacaagagctgacagacaaaatagccagtatagaaatgtacgtaatcaaccttatagagctgagaaaacactctacaagaatttcataagacaattgttaagtattaacagcagaatagaccaagcagaggaaagaatcttagagcttgaagactggatttgtgaaataaggcagtcagttaagaataaagaaaaaaaatgaaaaggaacgacaataacaaaacattccaagaaatataggattatgtgaagagacaaaatctatgactcattggcacccctgaaagggatggggagaatggaagcaacttggaaaacatatttcaggatgccattcatgagaatttacccaacctagctagagaggccaacattcaaatttaggaaaggcagagaacccccacaacatacttcacaagaagatcatacccaaggcacataatcatcagattctctaagggcaaaataaaagaaaaaaatgttaaaggtagctagaaagaaaggacaggtcatctgtgaagggaagcccatcacactaacagaagacctctcagcagaaactctacaagccagaagagattagggacctatattcaacattcttaacatgaagaaattctaggcaagcatttcatattcagacaaactaagctttataagtgaaggaaaaacaaaatcattttcagacaatcaaatgcagagagaatttgttaccagtagaccttccataaagagctcctgaaagaagcactgaatatagaaagactgttaccagccactacaaaaacacactgaagtaaacagaccagtgacactacaaagcaaccacatgaataagtcagcataataaacagctaacaacatgatgacaggatcatatccacacatatcaatactaaccttaaatgtaaatgggctaaatgctcaaatcgaaaggcacagaatggcaagctggataaagaagcaacacccaaaggaatgctgtcttcaaaaaacccatctcacatgcaatgacacccataggatcaaaatacagggatgaaaaaaaatctaccaaggaaatagaaaacagaaaaaagcaggggttacaatcctaatttcagacaaaacagactttaaaccaacaatgataaaaaaaaaaagaaggacattgcataattgtaaagggttcatttcaacaagaatatttaactatcctaaatacatatgtatccaacacaggagcacccagattcacaaagcaagttcttagagactttcaaagacacttagactcccacacattaatagtgggagacttcaacacccctctgatagtattaaacagatcaacaaagcagaaaacatatacatttaagacctaaactctactgtgggccaaatgtttctgagagacatctacagaactctacaccccaaaaaacagaatgggctgggcgcggtggctcaagcctgcaatcccagcactttgggaggctgaggccggtagattacctgaggtcaggagttcaagaccagccagaccaacatggtgaaaccctgtctctactgaaaatacaaaattagccgggtatggtggtgcatgcccataatcccagcaactcgggaggctgaggcagaagaattgcttgaatctgggaggcagaggttgcagtgagctgagatcacaccaccgcactccagcctgggcaacaagagcaaaacttcatctcaaaaaataaataaataaaaaaaccagaatgtacattcttctcatctgcatatggcacatactccaaaatcaaccacacaatcagacataaaataatcctcagcaaatgcaaaagaaccaaaaccatatcagctactctctcagaccacagcacaacaaaaatagaattcaagactaagaaattactcaaaaccatacagttacatggaaattaaacaacctgctcctgaatgactcctgggtaaataaagaaattaaggcagaagtcaggaagttctttgaaactaataatgagaacaaaggtataacataccagaatttctgggccacagctaaggcagtgttaacaggaaaatttgtagcactaaatgcccacatcaaaaagttagaaatatctcaaatgaacaaccaaacattacaactaaaaaaaaaaaaactagagaagaaagaccaaaccaaccccaaagctagaggaagacaagaaataatcaaaatcagagatgaactgaaagagactgagacatgaaaaaccatttgaaagatcaatgaagctaggagctgggtttttttttgaaaaaaaaagacaaataaactgctcactaaattaataaataagaatagatagaatatccaaataaacacaatcaggaatgacaaatgggatattaccattgaccccacagaaataaccatcagagactattatgaacacctctatgcacagaaactagaaaatcaagaagaaatggatacattcctggacacatacaccctccaaaaattgaaccaggaagaaaatgaatctctgaataaataacagacaaatccctgaacagacaaacaacagataaataaagagatccaagaatgaattgataataagtaagcaacctgccaaccaaaaaaaaaaaaaacaaaaaaacaaaaaaccaaaaacccaggaccagatggattcacagctgaattctaccggaagagctggtaccattcctactaaaatgattcaaaaaattaaggaggagcgactcctccccagctcattctgtgaggccagcatcatcctgataaccaaaacctggcagagacacagcaaaacaagaaaacttcaggtcaatatccttgatgaacatcatgcaaaaattctcaaaaaatactaccaaactgaatccaagaacacatcaaagatctcatccaccacgatcaggtaggcatgtggctggtgtataggaattctattcatttttgtatgttgactttctattctgaaactttgctgaagttgtttatcagcttaggaatcttttgggccaagactatgggcttctctagatatagaatcatgccatcttggtatatgtttcatgggcacttaaaaagattgtatattttgcagttgttgagtattctaaaaatatcaaatagaacttgttggttaatggtattgctaagtttttctatatcctcgattcaatgatatgcctatgaaacttaacattggcattcttcacagaactagaaaaaactaatttagaattcatatggaagcaaaaaagagaacaaagagccaaggcaatcctaaactaaaagaacaaaggtagaagcatcacactaactgatttcaaagtatactacagggctatattaaccaaaaccgcatggtactggtacaagaacagatacatggaccaatggaaccgcatagagaacccagaaataagaccacacaccaacaacaatctgacaatctaggcaataccactcaggacataggcatgggcaaagatttcataatgaagatgccaaaagcaattgcaacaaaagcaaaaattggcaaatggaatcaattaaactaaaaagtttttgcacagcaaaataaactatcaacagagcaaacagaaaacttacagaacggaagaaaaaatttgaaaactatgcaactgacataggtctaatataaagcatctataagtaatgtaaacaaatttgcaagaaaaaaacaaacatctctataaaaagtgggcagagaacataaacagacacttttcaaaagaagacatacacgtgaccaacaagcatgtgaaagaaagctcaatatcactgatcattaagggaatgcaaatcaaaaccacagtgagattccatctcacaccagtcagaatgactattattagaaagtcaaaaaatatctggtgctggtgaggtttacactgttgtaaaggtgtttgctctgtgggttggaatgtaaattagttcaactaatgtggaagacagtgtggcaatttctcgaagacctacagtcagaaataccatttgacccagtaatcccattactgggcatacactgaaaagaacataaatgattctattataaagacacatgtactcacatgtttattgcagcactgttcacaatagcaaagacatggaatcaacctaaatgctcagcaaagatagactggataaagaaaatctggtatttatacaccatggaatactatgcagccataaaacagaatgggatcatgtcctttgcagggacatggatagagctctaggtctttattctcagcaaactaacacagaaacagaaaatcaaatactgcatgttctcacttataagtgggagctaagtgatgagaacacatgggcacgtagaggagaacaacaggcactggggcatatcagaagttggaggttaggaggagggagaggaccagcaaaaataactaatgggtactaggcttattacctgggtgatgaaataatctgtacaacacacccccatgacacacgtttacctatgtaacaaacctgcacatcctgcacatgtattcccgaacttaaaagttaataataacaataatctccatttattagtggatataattggttaaagtaattattacattagagggcacaatgaccaaaactaagtggaacaataatgtcaagtaagtttgtagttaaagaatgtaagagctccccgcctgaaattgtcatagaagaccaaacaacactggaccaattttaggaccccgaaagactaatgctagtagcctcaacgtgcttagtagtagatccaggaaggggaaacaccatatgacggcctctaaaggaaaaaataataagcagaagagagggtgaatacaagcaaaacaaaagttttgcctctggtattctttttttttttttttttttgagatggagtctcactctgttgcccaggctggattgcagtagtgcgatcttggctcactgcaagctccgcctcccgggttcatgccattctcctgcctcagcctcctgagtagctgggactacaggcacccgccaccacgcccggctaatattttgtattttgttttagtagagatggggtttcaccgtgttagccaggatggtcttgatctcctgacctcgtgatccgcctgcctcggcctcccaaactgctgggattgcaggcgtgagctatcgcgcccggctgcctctggtattctgacataccatcttatggagcatagcagttgacaataaacagacaacgtgagataagaagcatgttactttttgtgctccagtcaattaaagtagaatgtgatataacaaatggcaaagctcatctataagaaactgagagtcattagtgggatggggagtgtgggaattccagatgcaaagagcattcccttcttccccaattcataaataagataaaaataaaaggtgaaagtaatagagaaaagttaggtctaaaccaaactttagaaaaatcacaagggctgtcataaagttcagtaatatttgacaatattctacagaaacctagagtaatggttattttacaaattttacttaaaattagagggtaagcgattaagcaaatttatttcagaggaatgaataaaattggcagagaaatagactgataaaatgattgctttatagaagcaacaaaagattaggaactaagatctttggtcccttggtttgtcacttttattaactagttgtggaatttaagcatagtacctcatgtattaaatacatcttgggactcaaaggaatgcttgttttccatgactcattttttggggagaattttacaaaactaggatgagaatgaactttgagatggataaaatagccttttctttttttttttttttttgagacgtagtctcgctctgtcgcccaggccggactgcggactgcagtggcgcaatctcggctcactgcaagctccgcttcccgggttcacgccattctcctgcctcagcctccccagtagctgggactacaggcgcccgccaccgcacccggctaattttttgtatttttagtagagacggggtttcaccttgttagccaggatggtctcgatctcctgacctcatgatccacccgcctcggcctcccaaagtgctgggattacaggcgtgagccaccgcgcccggcctaaaatagccttttaaagttagtagtactttatagtaatattaaagataggatacgcaggtagaaatttaaaacatatcacatgtaaagttgactttaaagtgaggaaggagtccttgtgctttgtcgtcattggttataaatggactgtttcatgtgtttctttactttctttgtggctacagtatactattataaaaggcacaattttatttctttgtcacttcaaaactaatcctcttaagtgccaaagtataaagtattagctatctattttattaattcataaatatcaactgttacaggagaattaaagaacgggtattctgttacttaatttggacaaaccaggaagaaagaatgtattcagaagaaagatgatcagagccttgattaaaatggtgataatatagagaaagttaaataacattagtttatacaactaaaactgatgtagtaccaaatatatgacagggacaattacaagtaagacccaaaccatgaggattcaagtagaagagatttcagactgtatttccatgacaaagaagaaagtccttaaaaaattaaggaggtataaaaatattttcacataaacaatgagatcacatggacacaggaaggggaatatcacactctggggactgtggtggggtggggggaggggggagggatagcattgggagatatacctaatgctagatgacgagttagtggctgcagcgcaccagcatggcacatgtatacatatgtaactaacctgcacaatgtgcacatgtaccctaaaacttaaagtataataaaaaaaaatattttcagataaaaaaaaagaatttgttttgaggaatcctaaccttaaataattactgaaggaagttgtctgaacagaaaaaaaaaaaaaaataacagaaaaactctcgaacttcagaaaggaaggaacaccagaacggggaacaataaaatcagtataatagaccaggattcttattcatttcttaagtcatattttatggttgaaacaaaagttataaaactacctgaggtggtgcataatatgtgtaggaaaaatacctgacaattataagagccatatatgacaaacccccagctaacatcctactgaatgggcaaaaatgagaagcataccccttgaaaaccagcacaaatcaaggatagcctctcaccactcctattcaacatagtattggaagttctggccagggccatcaggcaagagaaagaaataaagagcatccaaataggaagagaggaagtcaaactatccctgtttgcagatgacatgatcctatatctagaaagcccccagtctcagcccaaaagcttcttaagctgataaacaacttcagcaaagtctcaggatacaaaataaatgtacaaaagtcaccaacatgactagacatcaaaaatagtcaagccaagagccacattaggaaagaactccccttcaaaattgccacagaaagaataaaacacctacgaatacagctaacaagggaagtgaaggatctctacgaagagaactacaaaccaccgctcagagaaatcagagatgacacaaacaggaaaaaactttccatgctcatgaatgggaagaatcaatatgcttaaaatggccatactgcccaaagcaatttagagcctcctgctctctactttttgcttaggattgtcttggctatttgggggttcttttctggttccatatgaattttaaaatagttttttctagttctgtaaagaatgtcattggtagttttataggaataccactgagtgtgtaaattgctttgggcagtatggccattttaacgatattgattcttcctatccatgaacatggaatgttgttctgtttgtttcatctctgatttccttcagaagtgttttgtaattatcgtcgtagagacatttcacatctctggttggttgtattcctagatattttattatttttgtggcaattgtgaaaagaactgcattcctgattttttttaatttaatttttaacttcaggggtacatgtgcaggtttgttacataggtaaacgtgtgtcatgggggtgtgttgtacagattatttcatcacccaggtaataagcctagtatccattagttatttttcctgatcctgtccctcttccttacctccaacttctgatatgccccagtgcctgttgttctcctctatgtgcccatgtgttctcatcacttagctcccacttataagtgagaacatgcagtatttgattttctgtttctgtgttagtttgctgagaataaagacctagagctctatccatgtccctgcaaaggacatgatcccattctgttttatggctgcatagtattccatggtgtataactaccagattttctttatccagtctatcattgccgggcatttaggttgattccatgtctttgctattgtgaacagtgctgcaatgaacatatgagtacatgtgtctttataatagaatgatttatattcttttgagtacatacccagtaatgggattactgggtcaaatggtatttctgactgtaggtctttgaggaattgccacactgtcttccacaatagttgaactaatttacactcccaccaacagtgtaaacgcctttctttttctctacaaccttgccagcatcagatagtttttgactttctaagaatagccattccgactggtgtgagatggtatctcatcgtggttttgatttacattcttctgatattagtgatgctgagcattttctcatatgcttgttggtcacatgtatagcttgttttgagaattttgtgttcatgtcgtttgcccatttttttaatgttgttttttttattgtaaatttgtttaagatctaaagggagattcttgagccacatataatattattcctagataacgataggcagtgttttttaaacattcatcttgagattaggtgaaaacacttattgtttcaaacttaagaaatgaccttagtgttggaaattcaaatttcagaaaatagaaataatggtgacctcaaagaaaggagcaaatttacctctagccataaacattctgcacttaacagttacctcacctagaagttcataaatataattcataaatgataaaaattgcttttgtcttcaaattattgataaaaattatagtcattataaacacagcatataatttcgactgagagggaatttgtttttgtgtatgtttttagcaatttacggtaactctaatctctatcatttctgttttaggtgctaaatgatcagataatcaaaatcatttttttttgcaacccacagccattagtttgtataagagggttaacgattgcatactggatcatttacctgcagacagtgtacaattagattcattgctgcaattagattcattgcagcaattagattcattgctgcctctctttgttcctttcctgcttcctgtattctaaagtgctaataattcgtgaaagataagagagtacaatatcacagggaaataagttaatgtataacatttgcattttgttccaaatgtccaaagtgataacctatacatggtctctgaaatttagcagcttcttacaaatgagacagttttaaatctctcttcacacataaataaattttcttcccttttttgtttttaaataatcacaaagataacacattaagagaataatctaaaacaggatgaccaaacctaaaaccaaatgtatgaaaaaaggtttacatgaaccatctcatttagttaaaatcaaaactaattcagataatcacctttaattttgccttctaaacatgctaagcatttgaattcataagatttctcaccagtgtaatattgtggaaattattccctattaaaagtgctgcttctgcgaagcagccaatttgttttacatatctgatgtgtatgacagatcagagatttgtttttcattttttaaagtcacagttgagatactcaactgcaatgattttgaggtagaaaacataaaataagcatttcctattgtatttttgcaaagacataggcacagggacagctcaagaactttcccacagtccagctacccacaagtggagatggacccacctggtcattgagtaacatattcctttgtctatgccaagaatctgctcttgaaacatagcaacacagggtgttaccaaaaatgagggaccaacatcttagatcgttctaccacaaaaagatagaatcagaggatattagaaaaagaagagactgacctttcagatcatttttttcaactccctctatttatggataaaaacatactacctatagaaaaaaaaaaaaaaggagagcccacaatagaaaagagttagtaatagtgtggagacaaaacctctgattgtcattccagtgcacttgaccctttggtaactcctgaaggtcacaatcccttaaagagtgctggctccaggtttctacactgtcttactgcatatgttttgaaatagtttctgtgtaaataaactttcctcaccttgtgcaattttgagtgtgctgtctgttttctattatgatatgatggatacactaactcctagtcatcttacaaacattctgagcttcagtttttcatctgtaaaagagaggtataatgtagatctcacacagtcgaaatgaaaatcaaatgagataatgtatataaatcacttatcaaagtacctgacacacagtaaactcccaattaatgctaattatcactagtgggtatactatgtcttactcttctctataaatagagatgtgtagaaaattttaatatttcacatgtttaagggaaaaatgttgtaggaatatcagtagctacttgagaaaattattctattatgtatttaccaattctaattaattaaagatacacggtctaattttaatttatcttcttattccacactgaaacctccccaaatggaaactgtgaatattttaatatctcataattttaccattttctatctggtattataagacaatgacttaggataagaatccatctatcacattaaaaatactttgggaaagaataaagtttcttaggtaacaaaaggggcatcataaaagttttcaaaaattgtttatcttccagataataaatatcaacatgaccatttatcactgtatcaccgatatatacagggggaatcaaaatatattttttcttttttcttaattttatttcaatagctttggaggaacagatggcatttggttgcatggaaaagttctttattggtgatttctgagattttggtgcactcatcacccgagcagcgtacactgtacccaatgtgtagtcttttatccctcacccttctcccacccttccgccaagtcaccaaagtctattatatcactctgatgcctttgcgttctcatagcttagctcccacttaaaattgaaaatatacgatgtttggtttttcattcctgagctacttcactttcaataatagtctccaactccacccagattgctgcaaatgacactatttcattcctttttacggctgagtagtattccagcgtatgtatacacattttctttatctactcattggttgatgggcatttaggctagttccatattcttgcaattgtgaattgtcctgctataaacatgcatgtgcaagtgtctttttcatataattacttcttttcctctggatagacacccagtagtgggattgctggatcaaacggtagttctacttttagttccgtaaggaattgccatactgttttccatagtggttgtattagtttacaacgccaccagcagtgtaaaagtattcccttttcaccaccatctgttatttttttattttttaattatgaccattcttgcaggagtaaggtcgtatctcattgtagttttgatttgcatttccctgataactggtggtgttgagcactgtttcatatgtttgttggccacttgtatatcttcttttgagaattgtctattcatattcttagcccactttttgatgagattttttttcttgctgatttgagttcctcacatattctagatattagtcctttttcagatgcatagtttgtgaacattttctcccactctgtgggttgtctgtttactctgctgattatttcttttgctgtgcagaagctttttagtttaattaggtcccatctatttatttttgtttttgttgtattggcttttgggttcttggtcatgaacttccagaagctgtgattttttaaaatttatggtatctatttctgtggagcatttttcatccatatcctgtattgtcctttttaatgtttttaaattggttttcaccttgctctggtatctccttgtgtagcttaataatcagcctcctgaatttcagagatttcttcttggtttaaatacattgcttgggggactagtgtggtcttttggggatgttataggaccttgttttatcatattacaaggattacttttctgattccttctcatttggattaactatttcagtggaaaaatctggaactccagggctgctgtttagattcttttgtcccacagcgtgatcccttgatgtggtgtactccccattcccctatggatgggacttcctgtgagcccgtctgcagtgattgttgttgctcttctgggtctagccactcactgtgcctaccaggctctctgctagtgctggggaatgtctgcaaagagtcctgtaatgtgatggatcttcaggtctcccagccatgcatacaagtacctgctctggtggagatggcagcagagtgaagctgactctgtgataatccttggttgtagataatgtttagtgtgctggctttcccgaatgctggttatgctagcagtaaagttgtcacatggacagactcaggaccacgggttagcctgaatgttgcaggcagtagaattagtttttgttttctccttccttggagcagggttgttctgtcatgtgttgctgtaatgttttgggttggttggcctccacccaggaggtggtgcattcacaagagcaccagctgcgatattaaaaggggaatataagcttaaaatatcttaaataaatgccaaataaatgttcttttgcactgtttagaggtttaatgtagactatgtatatttctacaaaatctagttctcttatgagaattcgatatccatttaagggagctcttttctttcgatgaaggttgatatgaatttaggagacttggtttacattttcttcaacctgaaactttaaatgatgattgagaatgtgtaaagttgtcccatatttttaaaataaactttccaaattggaaagaaatttaggtccgaaaagagcgtaatggttcctttagagtggaccacagatagaatacaagttggaatcaacttgcagttagatgagagtgtcataaaaataatatgattgaattaatttagcttatatcagcatctctggccaaccctgcttacagggtgcccagggctgaaataagaagtgtttctgccatttatttgctggggttttggcagacattcatggcagtgctcatgcggaccttaaagagtacattatttttatttcccttctcattttcttaagcagtagtttttgctttatgactaattaggagataataattaggttcagaatttttttcttcatttttaatatactttgaaccttgcataggccccataaactagttgtatacatttaactttcagttttaattccttagtcttaagaaaaatagcaatggactttaaaatatactttatttttcagagtacatttaggttcacagcaaaaacgagcagaaggtacggaaatttctatacacccactgcccccatacaggtataacctcccccattatcaacacgccccaccagagtggtacattctttacaataatgagcctacattgacacatcattatcatccaatgttcatagtttgcagtaaggttcactgttggtgttgtacattctatgggtttgaatgaatgtataatgacatatatctatcactatacattcattaatcatacagagtatttttactgttctaaaaattctgtgatcagcctattcatccctctctctgtgccccaataataaggtttaaatctaagaaaatatgtacagccccaggcaaccactgatctttttactgctgccatatgcttgccttttctagaatgccataggtttgccttttctagaattacagttggaatcatacagtatgtaggctattcagattcacttctttccctcagtaatatgcatttaaggttcctgcatgtcttttcccagcttgatagctcattctttttagcactgaataatattctattgtctggatgtactatagcttattttcccttcacctactggaggatcttttggttgctttcaagttttagcaagtatgaataaagctgctctatacatctgtatgcaggttttgtgtagacataagttttcaacacctttgggtaagtaccaaatagtgtgatttctatgtttcatggtaagtgtgtgtttgtcttgtgaaagactgccaacctttcttccaaagtggctggctgattttacattgccactaacaatgaatgagagtttccattgctctacaccctggccagcatttgttgttgtcagtgttctgaactttgttcattctaataggtgcgtaatagtatctcactgtcattttaatttgcatttcaccgatgacatgtgacatagggcatcttttcacatgcttaattgccatctgcaagtcttctttggttagatgtctgttaaagccttcagctcatttttttgtactagggttgtttatgttatataaaatttttagttattttgaatacataatagttgtacatatttatggggtacatgtgatattttgatataaatatacaatgtaatcaaatcacagtaattggggagtccatcaccataagcatttatcacttttttgtgttatgaacattttaattctactcttttagttattttgaaacatgccataagttattgttaactatcactctcactaaaaatcaagggaaattttcctctggaaatccaaattaatgtcaaggcctttaagaccccaaggaaaatttaatttaacttataaagaagatatcaaaaatatctcaagaaatttttgggacaaagctagacgagttcagggctaaacaagatataatcaaaatgtaaaaagcaatgcttgaagtttctatgacaatttgttaacctcgagttgtagaaactccctttatccttgctgaatatgattttatcatctaaaggattaaatggtttttttgtgtggagatgttgggtaagaaaaatgagacagatacatttgccatatggctgtaggtagcaagatattttagaacacatcagacaaatatatgctcatccatgcttcacggtacaagcatataccgtggattaaataactatggtctccaggttcagttcctttattattatcatattctacaaacctactttaagggatattgtattgatttaatcatcatttatgtacttattaaaatatttcttgtttcttacgtggtaagcactactataggtactacggatttagtagttgaaaaccatggtctcaagcttttaaagcttacagtctatggaagatagacccaccaatacatattaaataatgtgtgatgactattattaaaagagaaatgtagaagatatgatgacatatagctgaaggaagcctcactggagaaatacataatattaggtgatacatataagaaaaacttgcaaagaaccagtcattttactatgtatgaagagtaaagttgtttggtaaacatattaaaacagttaagacagaagtagcaaagttagtaaatgcatgtatgtttggggacctctaaaaagttaagaaggtcttaggctaagatgaggttggaaaagtagcttgggaaatatgtttaatgatacaaattccaagctaatgattatggacttcaatctacatgccctgttaatattatggctatgccagggagaacttaaaatcataggacagagaatatggcacatcttcatcttcccagaacatgaattttactggaagatatgtaaaaattagcagaagacacattgtggaataggagcatgatactgatgtgacttgtaaaggaaaaataaattaggctgataaattttcaattgttggtagcaatgttataattcaaatttattcagcacaataattacagaactgaagggatagatatttggtcatttactggcatggagccattgacaagtttagctaagcaatgtcatgctcatggtacctagcaaggcttcagttgatgggcataaactgagtatagcaatttatcttgagaacatttttaatttgttaaatatttattttgtaactaagaaattatttggtgtgagatggtatctcactgtggttttgatttgcattttctgatggccagtgatgatgagcattttttcatgtgtctgttggctgcataaatgtcttcttttgagaagtgtcagaacggcaatcattaaaaagtcaggaaacgacagatgctggagaggatgtggagaaataggaacacttttacattgttggtgggactgtgaactagttcaaccattgtggaagacagtgtggcgattcctcaaggatctagaactagaaataccatttgacccagcaatcccattactgggtatatacccaaaggattataaatcatgctgctataaagacacatgcacacgtatgtttattgtggcactactcacaatagcaaagacttggaaccaatccaaatgtccatcaatgatagactggattaagaaaatgtggcacatatacaccatggaatactatgtagccataaaaaggatgcgttcatgtcctttgtagggacatggatgaaactggaaaccatcattctgagcaaactattgcaaggacagaaaaacaaacaccgcatgttctcactcataggtgggaattgaacaatgagtacatttggacacagggtagggaacatcacacaccagggcctgtcatggggtggggggaggggggagggatagcattaggagatatacctaatgtaaatgacgagttaatgggtgcagcacaccaacatggcacatgtatacatatgtaagaaacctgcatgttgtgcacatataccctagaacttaaagtataataataaaaaaatcccaacaattaaaaaaaaagaaattagttgattttagtctcactctatgtatatataagatttccttaggaaaacgacatataaaaaagataaatctatattttagcggtggcattttgcaggcttttttgcactcagatatcttccagggaataataggccaagtcaactgttcatgattacattcctagagagggactctggatcctcgggtttgaatgaaaagatactgggctacctagtaaaagatgtttatattaactctaaggcggcaatagataaatgatagatatattaggtagacaaagttcaaataaatacatttgaaaatcaaaataataaaataaaatctcttcggaaagtttcagatacaattcctaaatttaccttaacttaaagcattgcttgactgaaagtaatatggaatttttagtttggtgagtctaatgcatgcaggtgccttctgaattgtctgcttttctcaagcatctaggagatgataagcaggaggtcgggattaacctgtgacagccaacctctccagatctctaggtaatgccaggtaatccaggagtgcatctttcagcttgctccactagaattcaaaatgccacataagcgtccaaggggtagatacagcttgccttcagaggacattgagatggaaacatcttggtcagtaccccataaagagtctagacgtacattcgagtccagatttgttttgattgttgtagtattatctttcattattttattgttttcttataaaattaaaagataccaaagttaaagaaaataagatttcctgattaaaataagtacttgtcaaactaataataaatataattaatatatttaactaaatatttgaattttgtgagaaatgttaattattttgctggcatttcatgggaatgttggttttacgaaatagagttgtgtttgaaattacaaaggagtatttatgtttgtgtgattgttaattttaggtgtcaactttcctggattaaggaatacctgaagagctaataaagcattatttttgggtgtgtcagtgagggtgtttccagaggagaatggcatgtgagttggtgaactgagtggggaagatacacccttagagtggtcaggcactatccaactgctgggagcacagataaaacaaaaaagcagaaaaaaagagaatttgttttttctctctgctggaaccaggacacccttcttcccctgcacttgaacatcagaacttcaggccctctggccttttcattccaagacttgcaccagcagccccctcgctcacaggccttcaatattggactgagatttacattacttgcttctttggttctgaggttttcaaatttggactgagccatgctaccagcttagctgggtctctagcttttagatagcctgttgtgggatgtctcagcctccatgattacgtgagccaactcccctaacaaatcttctttcatctatctatctatctatctatctgtctgtctgtctgtctgtctgtctgtctgtctgtctgtctttctgtctgtctgtctatctatttatctatcatctattatgtattcacctatcctattggagaactctgactaatacagtttgtaataaaacaaattttgctaattgtgtgtacttacttatcctcctaatctataagacagaaaaattctaaaaaacagcactactatttcactgcattattcaaaccattgcttctttggaatttgacaaatgaatcatgacatagatttatacacaaaagctcacaaaatatgcactttagaatcacaaaaaacttctcatccacagtccatttacataaaaatagatatcatagctatctctccttttcactcttcctactttttcaatttccgctactcttctaccacttttactaacattttccccaatacaaagggaaattgttttcttcaagattttagaacaagaatgattaatttgccttttagccattgttttacattttcatgaattttgactttatatagtttttatcattgcctgattacatactcaagtaagtatacatttgaagatgacaactatatataactacatttaagtgtttaaaaatggtatctacatggctttgtcaatattgttgaaatgaactgaagatttttaagcaagcatagtttggattccacctgaaagaaacagtacattgatggttcccaagctctagtcataccgcaagtgaccatctaggatagtttcatatgcctgtgaattgatgcagaaatttacctgcagatcaaaagtgccacaggatataaacattgtgtgatgatcgcattctagccaaggttaaaaagaatatgtggtgctttgaaaattttgagatttttatgttttaaaagctagatatttatacaattatgatatttaaaaatatttaaatatgttattaaaactcattaaagatatttttccaatgaaagcaacatattttcaaccaggataaatttggtttgtattagtggatattgaggaacaaaaagaagagattagataaacagtgcttcagtcatgttccatgaagaattgtacctataacttctttagtgagtcaagagaagctagttcacaggtacattaatattttctccatgtctgccacattaggctcttaaagttctttcctgtttctatacttgctctcctaataccttcattatagaacatagcacactaaaagtattgatttacgtgacggtcatcccttctaggtcagtaatactcaaaaatagctggaaagcttgttaaacatggggattcttaaagcctcacttccagagtctgatataataggtttagggtatgcacagaaatctgtgattttaatcagcaccccaagttatttgtcatagattatcctcggactaccatttgaaaccaaaatctagtctatagggcaggatcatgtcatagtaatttttattttaaatcaggtgatgaataaatgttgaattttaagcaaagttcaaagttcaattgtagacatttcaattcaaatataagaagtggcccatgataaagtaatatctagcttcataatgttgaacaccgtcctttatcacccgtgtttctcaactgagagcaattccttccccccatgaaacatatctggcaatgtctggagaaatttttggttgtcataagtgaagagcgagtttgttactggtatctgtccagttgacgccacagatgctgctaaacatcttacaaagcatggaatggccccagcaacctagagctatgcagctcaaaatgttactagtcccaagtttaagaaactctgctttgtcatgatcccaccttacatccctgatccccctttgtttgggacagagtcccactctgtcacccaggctggagtactgtggtacgatctcggctcactgcaacttccacctcctgggttcaagcgattctcctgcctcagcctcctgagtagctgggaatacaggtgcctgccaccacacccagctaatttttgtatttttagtagagacagggtttcaccatgttggctaggctggtctcgaactcctgacctcaagtaatccatctgccttggcctcccaaagtgctgtgattacaggcataagccactgcacccggccttcctgatcccattaagaacttctcccccatttttccaatggacatcctatatgcacatccatgggatggaacatattctgcagatagtcaagtatttttccctagatattttttactttgctctacacatatgctttctctatctactgaactaataatgttactcactagatcaaacttggcctctgaattacaaaagtcttttgaaacatatggcagagaaaatcttgaaaaccagttatattactttcaagagtcaggtattttgcaacacaaaaagctaagcctggacagaaacttggcaaaaaaatgtgtgcactaaatgatagatttgaaacagataaaaaagattcaaaccaccctatctttatagattagataaagattgcgggagctgaaaaaatagctcctgagaggggggctggcatcattccatcccagaatgatgaaaacaccaggcaggtctggggcaatctgagagcagaggcgaattgtgattcattctctgggcaaagtccaaagaagaagcaggtttcacggtgaatttctttattactgcatggaattacatttgtgaagcataaatgatgcgaaggcacatgtaaagaaagagcactttagagcaaagagcatctacagccacagaaagtattcctaaatttcctatgccatttaagagaagtgcaggtatgtctaagagaggggcagatatattttccctaccgacaacgtaatattatggtaaggtctccaccattttccgtctttcttattactaatcacctccataacctgtggtcaactctgaggataagggaggaagaaaaatttcccaaatgactgaatcaataccttaaatgtctaaggaggaaaaaaccccaccgaccaaacaaaactatactatcataatttatctggaagtgactaaattttatgccatgtagaaggatgtgagcttcaactagagattattattctatagaagtttacattttagaataactattttgttgctttagtatattttcccatatatagatagagacttgtagatacacagtagttgtttcaatcttcgttttgctcatccaattgcctgagctatatctctttataaaaattttctcacttctgtcttgaccctatcaaaactcctgctgacctccacttgggagcattcactgtgaagtgtatgcaataatatgatgaaagtaattcacatcaacttatgataatctgaagtgaaaaagggaatagtggatttcagagcagtgagtctatatacttgcatattttggatgttcaaattgaaatatatgtaactagttatgccgtttatagtgtctttcacttgccatgccaactcttacattcaaagggtataaaagtagactcatgctttcttcaactttgcaaatgatcctcactttacactaaacaaagagtttttgctcatcaaatttgaattaggatcatgtgtactcaatatgtataacatactaggatacatcaaatacacgggtattctcccagactacaaaaaatatgtctactatcttaaaatcattccccatgtacagatgggtgatatatgaatatcagaggtgtgttcttatctgtaaaaaaggaataataataataatacctgccttaaatagacatgcttttgaggattaaatgagataaagttagaaaactttcctcaaaaatgttggttctttccccaggaacatgtctctttcaggctcagagatgtcaaatatattgacatttttaatataactggacaaataaataggactaactacaagaattaacagtcgtacaatgtcaacatatagtgagaaactagctatggaccatgacttatgtgatttggatgaagtaaactactatgtaataagagggagactgctaaaacatttctaagaaaagcaaatgagaacaaaatcaagtataattagaagttctgaagaaaaataagaggacatagctaaacacgtttttggacttcaaaatacgttcttatattgctttttctcctacaaaagatagatgctattatagtactggacttataatagataagagactagttcttgtttgattttgtgaagcactgtgagattaacctggctcctttctgcccattccaagcctaaagtcctgagggtggtgggctgtcactttggcatctcattccaaaatttgtacagaattcagccaggcaatggatggatgaagtgattataaaagtgaaggtatttcaggaagaaacataactgcattcataagttgttcctccattatctccattgcctttcacaatctcagatgttgggaaaacattaaaatgcacaaacatcacagtgtatgggcaaaatcatgaatgtagaagtaaatattcaagctcaagtattttgtagctctgtgatcttagtaagctattttgccactctgtcaatttcctaaaggctaaaatgtgagcaataatatttcaaatggttttgttgtgaaaataaatacagcctttaacttagtatcagcatagaataaatgattgtttttttcaatgagtgtgttgaaaaaatgaattatattaactaaaatttgcttggtgtttggcatataataggactcaataaatgttaatgacataaatcgataaatgaatgaaccaatgaataaaataagcaaacccagagaaaagtctctaataatatgtcatgaagttctatctttggccatttcttgttcttgccttcattgcttatatagaagagaagccattctcagaccagggatttccatatatcttctttataacattatctgtggctttatcgtgctgatgtttactaagccaaagcacatcttagactctttggtcaccactgtttcataatctagttcaactgatgttccaaaatattttactgagaacattttactcttctatgtattccttaaaaatgaaactgactgctattaaaattaagaaaacgtcctaattaaaattatggcttttttcaaggtttccaggttttattacctttacaactttacttgaggtttacaagtgttccatacaattaactcttgtttcatatataataaaaggctaggcattttattataaatattagagatgcacatacagttgacacactcgtctcctaatatcaattttaaggcatgtcttagtgctttattatgtatatgaaatttgccacttggaaaacatatgtatcatacttgggatttctgtacctaaggagataattttttcaagctattgtgagataaatatgcccatgggaagactgtagaacaggagacgttctctcatgatcattctatagcatatatgaaggtaaagagaatacctcttaacctacttatcataataagcattgcattgttacaaaaaaactgttgcattaataaaaaatttcctaaagtacatatatcattttaaaagtagctccaatattaaatcagcaattaccttcacattggaactcttttctgtgttgtgcctgaggcagcttccagaagtcatacagaggtaacagctgccacaaaaaactgaggacttagggaagcccacagtaccagaaattccatcttttagatggatgccaagtcagactagggaatatgacttaaaccttgatgatcagagaggaatgtctgtctctgtgtgtgtatgtgtgtgcatgtacatacacgtgcacacatacacccacacacactttgcaagtcagatagcattcgattgacaattactgtcacatttaactttgctatgcccctttgaatatgcacttagataaaaaacttttctcagtatcttaaattaatgtatggagccatggagtcctattcttatagctagagttggcgctgtgtaaaatggctattacgagacatctcttgttcacaggatgacctggtttttcaatttagaaaatcatctcgtatgttaaggaactaaaatgacatggtcagtaaagcacagacatggatggtacggatctagttagcgggctgacatattgcatcatgaactattcatacatgaagttttccattattttaaagggcagcctgattgaaattgagattcactatgttaattcttaaacatacatagtgtttagatcaggaagtaactttggtggttatcctcagtacatcctttcttcctgtgcatattcatccttttgttacgggagcaaagcaattggttctcttttatttatttattttatttctcgagacagggtctcgctctgtcacctaggctggggtgtagtggcccaatctcagctcactgcatcctcaacctcctgggttcaggagatcctcctgcctcagcctctcatgtagctgagaccgcagatgcacgtcaccgcaccaggctaatttttaaaaaattttttgtagagatggagtctcgctgtgctgcccaggctggtctagaacttctgagctcaaaagatccttccccatcagcctcccaaagtgttggaattacaggtgtgagccactgtgtctggtctgttatcttctattttctaaaattcattggaataagtcatatcccaaattaagatttaacagcctataaacatttctttacaagtgctttttttcccgaaagactatcaaaataagaacaatatttttctaaagttgatatttagaaatcttttccaaaaactatgtaataatgtgcacttcataggattgtaatctattaacctgataacagtgcttgacacacaataggtagtaaatacttggtatttgtcattgttcgttgtggacactacttaaaaatctctcattgtacacataaaatagaaaataaataagtttaatggcttattcctggtaatgataaataaataataaaatttattttacatttatttatttatttgtttattttgctatctgactagcaaagcatgtgtggatgtatgtgtgcatgtgtatgtacatgcacacatgtatacacacagagacagacattcctctctgataaatataataaataaaataaataacaaataaataaaaaaagtcaagaccagaagcaaaatatcctggctgtcagtctggtgctccttcccaaattcagtacctcttctctaagacacatttagaaacaagaatatcgaatgataaataatcaataaaacctagttattgaaattatatcattatggaagtaactagtatgtttcatacaatcagaaaccattaaaggtcgacaaagttataataaaccatatgttagacagttatagctacaagtaataatatacacaacttgtcactagcagacaccaaaatttgaaagtgacctccatcagtggacactgagaaagtgaagaatctggcagttcaaatagggccacattcttatttgtgggtctttattttcctccaaaagactccatgtcctcctcccctaaattcatttaggtcaattgtgtcaccccacatcacagtgtccaattttcatggatgtgtaaaaattaactggactgaagaaaatgcagaaagaaagagaaacagacaagttatgcttcccaattattgtattcggtggtcctacagatgtcataaacagattatctcaacaactaaaataaaaatgctttacttctactattctattctctctaccagaaaacattctgttatattcatgacacctttaaatataaattatctaagagctataagatatccatatattcattctcagaacaaaacaaaaaagtgtgaaaataccaaggaaacaaaagtggatagttttgagaatttatctccaaaatattcatttggcaattccagaagtattctatcactccctcctcagtcactaatcctaccaccacccagattcatctgggaagaaataccatattagtattatctgcactaggtaattatctgcactacatcaattatattatggctacacagcattttgtgagatgacccaggaacttaactgccataagttccaaacaactgattcacagttggaagctgcatacattttggctcaagaaagaatccctcatggagatgtgagagagagaaatatgagtgccaggcctaccacgtcagccaaattggcctcagcaatcactggggcagcacatgttgtatccagagtgtctccataactatattgttttcctttaattatgagcatacaaaattcaggcactgggataatgagaaacagcagaaaaataagggcctataacatagagtcatgtgcaccgaaatgatgtcacaaatagatgcagcaccatcgtgaagtaatgtcacaacatagctaaatagcacaaagataatttaagcacagatcttctggaaagtacacaaatatggataacacatataatagtgtcctacactaggtataacagagttattttggtaagacaatgagaacgattaaaaaaaaacatgcccaaacatatggattcttcacagaggtaagctcacattttagcttctatatttgtgtcatttatcacagatcttaagatggctcctgtccaaggcattgtgtatttagagtcaataactgttaagctatctcagaaaaacatacaggcttttattataacctgaaattcacaagaaaatgctaggatttaaaacatgtatttctaatattgtaggttagaaatctgaatttgggggtttctctcatcatatatggactaccagggctataaggagctatagttttagtgtgggtaaccctgtcatttttgtcctgggcaactcttgaaaaaagttatgccaaaatcacagtttttttggatgaaacatttacaactggaaaaagatcaaagtcaacaccttgaatagagcccagaatctgattggtaactgatctggatataattcacggatgttacacgctctatgcttttggctcttccatctgctctgcatcattcttattttgaatagctagcacttcagtcagttcatgctaatctaatattccaaactggacactgggatcataggaccaaattatctgccttaaatgaaaaagacgaatatatccaaagaatacacgactacatggctatatgtgcatatcactggggaagaaattgtcttggatttttaattttttttaacagttgaataatttaagacatcatatatgtaacattttcaatcatggtatcacagagtcttgcattagcatatagtttacagaaatctagtctatacttacctaacagtaatttacactaactgtgtctgaacacagggctaattccaaaaattaaacaacatcatgtttctagacataaaagtaagtaagatattattactgacttttaggggactggaggcaaatgtgggataaaaaggtggaaaacgatagcacatatattagtgcttatatcatatatgcaaaataaaaggtaattgctaatgtagattgtcaacaagtcatggtggttcaaaggaaaataaagaacattatatcaggctggggaaggtgaggtaaagatagatttcatgtaagaggttgtacttaacagggtcttgaatgagggctgataatgttaaagacgtgataatcatttataagaaagaaccttgaaagtgacaatctaccttaaggatataacacaaacatatataccaatatgaaaatgttagcctacagtgcattagagatctgtgggcatagttcatttcaaatagaacagaaagaaaatatcagggagagtatggggcataaagacagaagctcagtttgacgtcatgcacaaaacatcaaagcaagaaaattttacataaaactataagcaatggggagtcattaaatttatggaatggaaagtcaacactattagaactgctcttaagaaagagatttatttccagaaaatataatttacaggaatattacatagataattatctagtgactatgtaagaggctttgaaagattttaggacgtaatgcaggttgatgacattggtaatgtttaggaagggagaagagagagaaatattaagtcagactctatggactttggcaattgaattggaggctaaaaacagaagtggagagggattatgatatgaagggacccatgggtcaccatctctggtcttggcccaccattgtgtactaagagttacttcttcttataacaataatggttacttttgttatatatctcaaataattctgaactagatgaagttcttgtaagaaaaaaaaggagggaggaaagatatactcttcttctccctctgcccccaggcccccgctatcccctacagattgccaggccattggagagacatagataatgaaaaattaccagggaacaaaaaattaaaaaaagacatattgatatgatacaatattcaagtaattattgaatgcaaaagaagtcacaacaaaaatgcttaaaatatgattaaaagagattagaacatttatatttctggtaatatgatgtgcacatatcagtgtgaataaaaaatgctgaatggaattgtgtaaactgaattatcaccaagtgagttacgctaaaatattcatagttttctttttgatccttatgaaaattacatgactttgatggtagagcaaatatataaccattagatgtcatatatttacatatactactcaaatactcttcaattagtcctaaaaattgcacctacatggctctttatatttccctaatgctatgtttatgggtgaaagaataactgtgcttttaccagaactagggtaatgaatatgagcttatttagcaaaagatggtaagttcagtttgggctagagtttgatgaactacttggatagtctagagaaaataaccactagaaaatatggggctgaagttgtgaaagacatcaaaatcagagatttaaattgttttttttttagagacgaggggattaaattactattgaagagtggagaaaaaaggtggtcaagttcggatatcagaacatttgcttgagaagatatatcagagtaaaagctcttggatatagaaagaaaattataatctgagtctataattgttatgaagtatgcctgtattttccttatggaatttgatgtcaaaaacacaatttcaagtatcttctgatgggtatgccacaatatggtctggctatttggagaacactctttgataccagcagtgatcgagaggaacgcatgcaaaagaggacatgttctgactgaagagttacagggtactttgcaggcatctttctggctctagaactgaattattttcacacaaaagaaacaaacctcagtctggcaattaatgtgctatctgtgttagtagttcactgttaatagtctaatgagcagaatatcagtttggaataccactttatttaaaatctacaagccacacataagacatatataataattagggatcctaaaatgaaagtcaaatattctcaaccatgcatgtgtgtgcgtgtatgtgtttgtatgcatatttagacattttgtaaatcaccaaagatttaatttagatagaggaaggttggaggtaaggtgcatatggggaaattgactaagaggatcttcacatgagcaaagaatccaggagggcctggtagcaagaaaaataaagcaatttgcagacaaaagaattgtctgtactacaaggaagagaaggcaggaaaaggaacattttctatccatccattcacttattcattcaatatatacttattgaatacatcttaagtgtcaaagactgttttagcagtagggttatagcagtaaacaacacaaatttcatattctcaagaagcatgcatttggggatggggatccattttacaaatgaaacgttaaagccaaatataaagttctatgttagataggatggtcagagaaagcccgtatggggagtgatgtagacaaagtgagagaggaatccatacaaactttttgtcagtaaaagggtgatcatcctagacaaaggaaaacattgactgcaaaagccctaagtcaggaacatgcttggcagagtcagtcaagaaaaatcaagaaagctaataaacttggaacagggcaaatcatagggaaaaggatgggaaatgagatagaacagggatccaaaggccagataagataaatcttacaggcaaaagttaagaactagaattttgttgtaaggctggcatgaagcaattagacagacataatctgccatatgttttacaagaaactctccggctgcattgtgaataacagactgaaggcggatataattgggagtagtaaaacaagttaggatgctactgtagttgtctaagtgagaataattgaggattggactagatgagacaattagtgagatgcctctgaagactggttctcaaagtgcaacctggaccagcagcatcaacaacccttggaaactggtgacatgtacagattatcagatcctgccccacctactgcatcagagactctgggaatgagacccagcaatctgagtattaacaaacccagtaggtgattccaatgcctgctaaagtttgagaactgctgctttacaagtaaaggctcccctaattctgatttgggttctgaatcattcgagcacttttgtgtcactcagtaaattaaatgtacatgtgtatgtatgcatgtagtataagaaatattggccttaaaacgtaggaaattatttaatgaggacatttggagcaatgtgaagtagaaaaaaattaaatatggggtgtataacccatgtgcacattgtctcagtacctaaaaactgaatttcttgctctaaatgcaggccacattctgattcatttataatacggtatcatgctactttagaacaagctttaatttaaattgccagcactctttcatgcaaaaaatatagttgaatttaatgatctcattataagtgataaacaattactctgcagattttcaggcaagccatattttcattttttaaaaagtcacttgtgttaccagtgatgggcatctacattaacaaaaactgtaaaccacaaatctacatgagttgtatataattaatgagtaccacagtctaaaatatagaaatgagaggtgactaaaaccctgaatattttgagttgctgttttgagcagaaagcataataggtcataacagaggcttcaaaatcaagaagattctagaaggttaattaccaaaaataaacccactggggaaagcctctctgacttgatggtctgcatttccccttgtgattacatttaacatatatttcagggtccctttgctggaagaaaaaaagtgaagaaacaattaaaaacgtttagtattaacacaataaaagttattttaaatacatatatgtatgtttgtttacctatgcatctatctgcattaaaaatgactgtacatttatatactcctcactgaaaatacattgtgtctcaattaccactctgatgaataggagatagatttagaatattgctgtacatcccattgtgtttacactggggattttggcaacctcataggacccccaggaacagataggctggttttgcattagagctatctgccagaagatagtgttcaaagggtacgacgggctctcttgatcactgtggtaatgtatattcacagtatattcagaagacagggaaatacacttgacgccatatatgtttttgttcatacatataatttaatttttccaagaaagggccaaaagatagacaaaatacaattgatgtgtgatttctgcagcttgatcttcctttctggtattattgtcttttgctgtctttcactgttacgatttaccattttctcactgagattttacaagcatctcctatattatcggttttcagacatggtttcaatacacacccttaacaaactggagcatccagagtaggaaggagagaactggcactagaagttgtgcttaagttgcctgtgaccactagtaagtgaccataaaaatgtgggctccccatagcatatccacttctgacactatattccagcagaaaaaacaaatgtcaaagaacctctaggacccaaatgtttcaccactttccttatcttccagatgtgatcacatcttaccatgactttgaattgattttctaaaagaactttgaacattccctgtaatgtatcaaactaaacataaacagtctgcactggaattgtacaggttacataactttatctcaaaatttatatgttagggatatattaatattgctatttatcccttattctctactcaactctactaatgaatattcactgaatgtattcagagctcctttcttcctccgtttctctactcatgagtctcatgtattaataatttgcattgtaaatatacgtgtacaaatccttgtgctcaatatttaaagaaatttgaaaagagggaaagaacattaactaaaacttgccatgaatcatatgaggatggtattataaaaacactgttaaaatatttaaattttttttcataaatgaagaaacagatttagggaatatttcattgcactaggttacttgtctatggtcatccaactagaaagtagtggaatccagatttaatcttagatctgatactgaagcctctaggttcttcctcttttccatgttgcttatcctatccctttcaaatagtgcacattatagactgtaaagtctcaagagcagcaatcatctctattgatttttggcctatccatccacttagcacataatatatacacaattattcaccaaaatttaactatatataaaatcaactgctaaaggaatctagtatcttacataatacatctagtaggtgaataacaataatataaaaaagtacacattaaatgccaaccattacattaaaagaacaaaaaagaaagattgaaattaattctgtctcacagaacaggtcagacaggtaggagacactgttgatgtcccatttagataggcttttaacagctctgtgaatctctgccccagtttcttcacactttactgctaaaagctgactcctgggacattgtgaagattattcttgagcactagagggggcaatcaagaagtaaccccccagaaatacaaaaaacctcatagactattatgaatacctctatgcatacacactagaaaactgaaaaaaaaattgataaatgcttggaaacatataacttcccaagattgaacaaggaagagactgaatccttgaacagaccagtaatgagtcccaaaattgaattagtagtaaaaagcctactaatccaaaagagcccaagaccagatgaattcacagccaaattctaccagatgtataacaaagagctggtcccattcctactgaaactatttttttttttttttctgagatggagtctgtctctgtcgcccaggctggagtgcagtggcaccatctcggctcactgcaagctctgcctcccgggttcatgccattctctgacctcagcctcccgagtagctgggactacaggcacctgccaccacacctggctaattttttgtatgtttagtagagaagggggttcactgtgttagccaagatggtctcgatctcctgacctcatgatccgcccgcctctgggattacaggcgtgagccacagcgcccagcccctattgaaactattctaaaaaactgaggaggagggactccttcctaagtcattctacgaggctaacatcatcctgataccagaaactggcagagatacaacaacaaaaaaaagaagactccaagacaatatcctcggtgaacatcaatgcaaaaatcctcaacaaaatactggcaaaccgaatccaggagcacgtctaaaagctaatccaccatgatgaaggaggcgttacacctgggatgcaaggttggttcaacatacacaaataaataaatttgattcaccacataaacagaactaaaaaaaacacacataatcacctcaataaatgcaaaaaaggcttttgataaaattcacatccatgttaaaaatcttcaccaaactagggattgaaggaacatacttcaaaatagtaagagccacagccaacatcctattgaatgggcaaaagctgtaaatattcctcttgaaaactggcacaagacaaagatgccctctctcaccactcctactcaacatagtactggaaatcttagccagagtaatcaggcaagagaaagaagtaaaagacatccaaataggaggagagcaagtcaaattattcctatttgcagatgacatgattctatatctacaaaaccccatagtctctgtccagaagcttcttgttttgatacacaacttcagagaagtttcagtatacaaaatcaatgtataaaaatcagtagtattcccatacatcaacaacatccaagctgagaaccaaatcaaaaattccaccccatctacaatagccacaacaagaataaaatacctaggaatacagctaatcatgaaggtgaaagacttcttcaatgagaattacaaaacattgctcaaaaagaaatcagagatggcacaaacaaattaaaaatcatgcttatagaatcaatatcaataaaatggcaatactggccaaagcaatttacagattcaatactattcctatcaaataccaatggcattctttaaataattagaaaaaaactgttttacaattaatatggaactaaaaagagcctgaatagccaagaaaatcctaatcaaaaacaagaaagctggaggcattacattacctgacttcaaaatatactataagggtatagtacccaaaacagcatggcactggtaaagaaacagacacatagacaaatgggacagaatacagaacctagaaataaggtcacacacctacaatcatctggtctttgacaaacctgacaaaaacaagcagtggggaaagggcttcctattcaataaatagtgctgggataactggctagccataggcagaagactgaaactagacccttacttacaacatatacaaaaatgaactcaaggtggactaaagacttaaatctaaaatcaaaaactataaaaactctggaagataacctagtaaatactattctgaacatagaacctggcaaagagttcatgacacagatgccaaaagcaattgcaacaaaagcaaaaattgacaaatgagacctaactaaattaaagagcttctgcacaacaaaagaaactatcaacggagtaaacagacaacctacaagatgggagaaaatttttgcaaactatgcattggataaaggtttaatatccagaacccaaaaggaacttaaatttacaagaaaagaagaaaagaacaaacaaccccatcaaaaagttggcaaagacatgaacacttttcaaaagaaaacatacacgtggccaaaaagcaaataaaaatgctcaacatcactaatcactagagaaatgcaaatcaaaaccgcagtgagataccatctcacatgagccagaatggctattgttaagtcaaacaataacagattctggtgaggttgtggagaaaagggaatgcttctgcactgctagagggaatgtaaattagttcaaccattttgggaagctgtttggtgatttctcaaagaacttagaattaccattggatccagcaatcgcattattgggtatatacccaaagtaatataaatagttctgcataaaaacacatgcacgtgtatgttcattctcaacactactaacaattgtaaagacatggaaccaacctaaatgcccatcaatggtagcctggataaagtatggatatactggataaagtatatggatagcctggataaagaaagtatgtatatttccaaagtaaatatacaccatggaatactatgctgccaaaaaaaaaagaatcagatcatatcctttgcagcaacatggatgcagctggaggccattatcctgcacaaactaacacaggaacagaaaaccaaataccacatgttctcgcctataagtgagagctaatcattaagtacacatggacacaaagaagggaacaacagaaacaggagcttacttgagggtggatgataggaagagggtgaggattgaaaaagcacctgttgagtactgtacttattagctgggtgacaaaataatatgtacatctaacccccatgacactccatttacctacatagcaaacctgtacatatacctctgaaccttatatatatatatatatatatatatttctattttttaaaaattatactttaagttcggggatacatgtgcagaacgtgcaggtttgttacgtaggtatatatgtgccatggtggtttgctgtacccattaacccgtcatctgcattaggtttttctcctaatgctatccctcccttttccccctaccccctgacaggccccactgtgtgatgttcccctccctgtgaccatgcgttctcattgttcaactcccacttatgagtgagaacatgtgctgtttggttttctgttcctgtgttagttttctgagaataatggtttccagcttcatccatgtccctgcaaaggacatgaattcattttttatgcctgtatagtattccatggcgtatatgtgtcacattttctttatccagtctattactgaagggcatttgggttggttccaagtctttgctgttgtaaatagtgctgcaataaacatacatgtgcatgtgtctttatagtacaacgatttataatcctttgggtatatatccagtaatgggattgctgggtcaaatggtatttctggttctagatccttgaggaatcgccacactgtcttccacaatggttgaactaatttacactcccaccaacagtgtaagtgttcccatatctcaacatcctctccagcatctgttgtttcctgacttttaaaaatatcttataaaaggaaaaaaagaattaaaaaaaatgtgatttgcaaagagactaatgtgtaggctgccttgtttgtagtagtaaatcatttcagagagaaggttaaagagatgataggcattttcaaagaagtaataaagtctttatttagtagatacgtgtaagacattgaaagtttattttccccctacattgaataaaatgagtaggtgtctatatttctgcctccatacattttaacaagtaacattctaattgtttttcaagattgcttgccatgtttctatattattcttgatatttctcttgattccgaaaacctaaaggtattcttcttcctcttcccagtcatttgtgtgtactctttctctatataagaaactttgacttttgtcataattcattatatacttctggcctaatttacagtaaatgtaagttttctcaatgcagagtcaatttccaatgacttcattcccgaaacctttgctactgtcttttccatggagtctatacccagtatttaacgaattaaattgaaaactaaatactaaactctagattttattgcatatcacctttcttcctcctccacacgccctttgataggaataggatagcaggtgctcagaaatatttttgcttctttctcaatacaatgtaggcatctattttgacattctatagaatagcaaggtcattcaatcaatggttatctgaatatcctctcatctgcaattctctgggcatgggggaggagagaagagagatgtagagagaatatttcattgctctttctattgttataaaaacaatctaatttaggttcttccttattaaagccctgattaaaaataacagtaaaataaatcatatacgactcatttttaattattctgtactgtaatagaagggttcctgttatttgcaaagtctacaaatattggtcagtaaattaaatgatgaattctgagaaaaatcccatctaattacatctagataaattgacttagtgctgaagtgactacttaggagcgtcagtagcatcctttctataaattatgcctccaacagagtatattctacttcttttgcataggaaaaagttcttcatagtcaccctggtagtgactactacaagagatgtgtggcagtttaaaatgatgctttaagtagatttaatacctattatctattttctcttgatttttctgctgccccgctatattattttttctgctaggaaacttgaagggcatctatacaattttaaaaggacacactttagaaccaagtgtttctggctttagaacaaagcaaataatatatgaacttgaaatcattagaagttttgttcttgtgaaaaattcaataaaatatacaatattgatcattgacccaaaatgcctttaatagtttctatttatatgctttcatgttaaaatataatttttttttacttttagctcaaatatcttattcatgaaggcttctcttgaagagacaattagtataatcaaatatcccatgtcctctcttacatttcccagctttcctgatagtgattttgaagtcatgtgacttgttctgtccaagggactgtatagttggatgcctgtcatttctaggtttataactattaagtgctgttgggcttctttcattcctgctttcttgtgacaatttatactaagtgtaaaagatgatgtaaggagaagagggaggagggccagctaaactacaatcagaaagataacacttgattgtagtaacacactgagtttcaaggctttgtctgttttgacacttagccttatttatcttaaataacatccattccctgattactttcaatgtacaacccaactttccaggtcattctatcacccttttctgttttccttagcacttgttaccatgtaacatactataaatatcactttattttctataaacttcaactagatcaaaagctccataaagcaagaatgcatttttgtttcagtttagtttactgctgtatccctaaaaacttgggctgtatctggaacatagtagattctccacaactttgctacttgaggaagttacctaatttcttagcctcaattatccttcttatcgtatagtcaagaagataaatgagaacatgtgtaaatcttctagtttcatatgtagtatacatttaagacatttaatggatgaatattttaagaaaacatcaccatctggttataagataagctctaccataaattttctcaagatgatcttaaaataaattttgagctatacaccgtaacatgtttgtccaataagtaggattcacgctttttatttgtatcactgttctttgcaatttatcaagatacaatgcaaacatgcataaaaacacacatatttttatacacacaaacataagcacacacatatgtgtgtatgtttgcctatgtgtgtacatatgtatgtacctgtgtatgtgtatttatatttgtataggtgtgtgtctatgcatatatgtgtggatatatatttatatgagataaataagtaaaccttatttttctaggtatcatctaataaatctgcagtttcaattctcaatgctgtgagaggacaaagaaatgtaaatgtatgctgaataaacatcggcttttcttgaggataaatgtgaagggcaaaaaaggtagagaagaagtagataatatgacagttactgctctgagtatacaatgtatatactctaaagttatctttgttcatttgacgtatcaaatgcaggcaacattttgccactcttctagcagatgtcaatgcctatcaaaagatttttttgaagggtgactcaacctaagaagaaaatcaaagtaattcaacattatctgcagtaacacctaaaactcattcctttctgctaaaatactccctgaagatattttttcatcccagaacatttctctcatactaaacactaatatcagtaatacattttaacgaaaatttatttcataataagggaaaaaatggaaagaaggtaaaataaaattattaaccagcattgtgcttgaagacattctgaacaggtcagaacagaaataaactttctaaatttactcagagaggaaacaactatacagatacagaaatatattttagttctgacttttaatatattttacctgtttgaagagaaaaacttctacagagaatggaactaaagcgaacatttctgaatcatacattttattgtgtgaaatgtccttcattttcacattgttatttacagtttatttcagaggaagttactgcatcttaactctcacttaaccatgaatgaaggaggtaagagaaaataatagaaataaatgaaaaatacgtaaatgaagaaagatcattaggtgtacactcagtagagctatgtaggtggagaggtttcaagggatcagagacctacatatgagtattaatactcatggtaattatattttctactaatgttttaaaggcctcactgttacacactaaaagtcatgaagaatgagatttcactaaagttttatagaattccaaacaataattttccctacatagtccctttactgtgaagcagtggaaaaccgagaaccaaaaccctcagatgactgatttttataagggccattgccatattctgttttacctgctgagtgtttgagtgttttcaaaggcaatgtaataccagaaatgaagcaccaaaccagactaaagcatccatatgccctagattttctgtgaaaaaattgcagtgctggattcctgctttagacgatattccctgtcttgtcaaaaataagcccaaaatatcaaatttcaaaattcacagataaacttcagtcctcataaaaaaaataaagttgggaaagaaagattgaaagtacactaaggcaaatccttaggaattttcatgtgcctttaaaaataaaacaagttaagtcaatctgcagcataaagaaaatacaaatgacatctcattgggcttcttttcatacttgcttcaatgacagttttattcttctttattgatgtgctgaggatgctcacgagcttttctactttcatttggaacaaggttatgaaaatttaaacatattgcttctaaatacattttcctttctgccaacttggcagtatttaccccaattttatttcccacctctttgttgcatatttagtggactcacttcgatttcagtgattctcataggttgctattcattaaaataatcacttcaatgaatgatacaaaatattagtgttgagggaaggcagagaagtgaaactagaagaagaaacaacaagatccatcacttttagtgatatgaaaaaatgatatggtgacaattcttttatttgtctattcttaacaaccagctattaagctaggttccatttggaatatatactgttaaaaatagtatacagaagtagattttacatattctacaatttgcacaagggaatttattttggtacatcattaatatattgtctagtgacaacatatctaactcatgcagagaagacgaaggaaagaagaaagagaaatggagagagtgaagagggaaggaggaaatgaggaagagaaaacaaattgcatagtgctgtcacactcactattcccctatgtacctctctctcctcaaggaactaagagaaaagatctgtagtttcttttgcaatttcagctcctgagccctttcttgcatagtgtccatctacgaatgtgacctccttgtcatgcaataatttatagtagcttaagaattttcaatattaatttaagctgcactggttttccacgttacgctctgagttccgaatcaaactcctacttaaagtctgactccagtgtactttctaatcttaaagaatataaataagaattgtaatgataaaatagatgggggattattgaattgttaattgcctactagtactacagtgtaatattgcagatttcaaatgtgtaaattagacaaatgaaaccaggctcaacgaatttttcggatgatggaatgagataacatacattaagtccctggtgcagggcctttctcataacatgaaaacaaaaatctgaagttaatatgattatctgcaggtttgatatttatttttctcttgcctggatcagcattaaatctttacataagtttagaaagtttgcataatataaataagctacctaagcaggttgcatctttaaagttcatttgccaaaaactttcatagaagtgagaaaaacatttctcataaaatattaccagttgttatgactcatattaattgaaagtctactatgtcttagatttggtaataagagctttatatgtcattttgtttaatcttcatagtaattatggaaataaatatttttcttttatagatgaagcttctgaggtgcagagagctatagtaacacatctaaggttaagtggcaactgaagtatgttatgatgctgttatgacacatattaattgaaggtctactatgttttagactctgtaatgagagctttatatgtcattttgtttaatcttcacagtaactgtggaaataaataattatttttattttatagttgaaacttctgaggtgtagagagctatagtaacacatctatggttaggtggcgactgatgtatgtccgactttaaaaccagtgttttgtttacagtcagcttacattagttgatgatatataccatagagcatatagcgattatgcatcatcttagggttagtgtcagtgcttcctggtatcctctatctatattattgttgtaatgaagtgctttttatacactgaaaatggaatatgtcagcattgttgaaacatggcttccattttgtaattcccagagggacccgtttgtaatttaacagatattttcctataaagaacaaagtatgcctgatcaagtaataaaaatctctcataataattctcatatccacttcaaggaatatatatatatatatacacacacacatatatatacacatatatacatctatatatatacacatatatatacacatatatacatctatatacgtacatagtagtttaagaattatcaatattaatttaagctgcactggttttccacattacactctgacttctgaatcaaattcctacttaaagtctgactccagtgtgctttctaatcttaaataaataagaattgtaatgataaaatagatgggtattattgaattgttaattgtatataaacgtgtgtatatacacatatatacatatatacacgcatatgtgtatatacgtatatgtatatatacatatatgcatatatatgtatatacgtatgtatatacatacatatatacacacatgtgtatatatgtgtatacacacacactttttttttgcatttctgcattatcaccaaaactggtttgattagcaaaaactagtcaaacacagagtcaaataaatgaccatgaatattataccttccttaaataatacttgttttttaaaaaaactcataaatataatttttcgtaccctggaatttactataaattgtctattccactggaaccaaagacatctgatgtttgaggcactagtgacttcccattttttccagtttttctcctttcagaaccataatggatataaacccacccacttcagcttggttgagattacatgatttttttgaccaataaaatgcaagtgaaatttatatcattcttgatctttgtgagatcaaatgaataacataagtatcaagtgaatcatacatttaatcgtaagtaccaaatgaataacatgccgattctgaagagcatccctgagccttcacatggaaaatagttgtcttggattgttaccaagagccacacagacttgatgtaaggaaggaaaaacatggtttttgagtcactaaaattttttgtttgtttaaaatttttaaataagtaaatgatacacttgatgtaacaggacactacatcagcacagagaagtgaatttcactattatgtaggaagtaaacattttcaataaaatatttaccaatgacaaacattagtgtgtataattatgtttccatataggtagtaattgattacagttgtttcacaagtcacattctatattcaggccaaaatattgcaaatatcttaaatgttatacctagcagttttctaactatgtgaatcatgggttttcttattcccctccacatccttaaagtttttcaaaaattatttttactttcaaattttaaatttgctgtcaaaaattctctcatgtgtagtataaagatttaaaatcaagagagaccgtattctatgacatatatgtatgtgcatatatacatatatttcatatattttatgtactgcatgtatattatatacatacatgtgtaaattatataaaatataatacatacatgcaaattatataaaatacatatgtaaattatttcccaaaggaaaaccctgataagatttttgttattaattacattatggtaaaaaaaaaacactaacagaaaacaaatattcatacaagataaatttttagcaactggctatgtccatacaaacactaccaccataatttacaaaaagtaaatcaaaatagacaatggtaaaataaaagaaagcacagtgctttttggattctgaacaatcagaattttgtgtatttaaaagtcattgtatggtagcaaatgactaactgacattttctttttcaacttttaagtttgaggtacatgtgctggtatgttatataggtaaacttgtgtcatgggggtttgttgcacagattatttcgtgacccaggtattaagccttgtacccattagttatttttcctgatattcccctcctcctatcctctaccttccagtaggtcctactgtctgttgtgtctgttgttcccctctatgtgtccacgtgttctcatcatttagctcccaaatataagtgagaacatgtggtatttggttttccattcctgcttttctttgctaaggataatggcctccagctccatccatttccctgcaaatgacataatattttttatggctgcataatattccatgctgtatatataccatattttctttatccagtctactattgatggccgtttggttgactgtaagcctttgctattgtgaatagtgctgcaatgaacatatacatgcatttatctttatgatataaggatttatatccctttgggtatctacccaggaataaaattgctgggtcgaatgttaatcctttttcacgtctttaaggaattgcactttgctttccacaatgatcaaactaatgtacacttccaccaacagtatataagtgtttctttttcttcacaacctcatcagtgcctgttaattttttgactttttaataatagccattctgactggtgtcagatggtatctcattaggattttgtttctctaataatcagtaatgttaagcttctttatatgcttgatggccacgtgtatgtcttcttttgtaaagtgtccatgttctttgcccactttttaatgctttttttcttataaatctgtttaagtttctcatagattcaggatatttatcagatgcatagttggcaaaaattatctcccattctgtgggttgtctgctgattttgtttcctgaaaatttgctgaagttgtttgtcagcttaaggagcttttggaccaagactatggagttttcgacatacaggacaatggtgtctgcaaagagggatcgtctgacttcctctctcaatgcccttcatttctttctcttgcctgactgctctggccaggacttccaacactatgttgaataggaaggtgccagagggcatacttttctgtgcctgtcttcaaggggaacgcttccagcttttgcccattccgtatgatgttgactgtcagtttctcgtagatggctcttattattttgaggtatgttccttcaatacctcgtttattgagagtttttttttaagcatgaaggggtgttgaattttatcaaaagcattttctgcatctattgagatagtcatgtggtttttgtctttagttgtttatgtgatgaatcacatttattgatttatatatgttgaaccaactttgcatcccaagggtaaagcacacttgaatttggaggatatgctttttgatgtgctcctggatttggcttgccagcattttgttgaggatttttgatttgttcaccaaggttactggcctgaagttttcttttttgtcatgtctctgccaggttttggttatcaggatgatgctagcttcatagaatgagttagggaggaagactcaaccaggaagaagttgaatccctgaatagaccaataacaagctctgaaattgaggcaataattaatggcctactaaccaaaaaaagtccaggactagacagattcacagctgaattctaccagaggtacaaggaggagctggtaccattccttctgaaactattccaatcaacagaaaaagagggaatcctccctaactcattcgatgaggccagcatcatcctgataccaaagcctggcagagacacaacaaaaaaagagaattttagaccaatatccctgatgaacatcaatgcaaaaatcctcaataaaatactggcaaacagaatcaatgatagactggattaagaaaatgtggcacatatacaccatggaatactatgcagccataaaaaaggatgagttcatgtcctttgtagggacagggatgaagctggaaaacatcattctcagcaaactatcacaaggacaaaaaaccaaacaccgcatgttcttactcataggtgggaattgaacaatgagaacacttggacacaggaaggggaacatcacacgccagggcctgtcgttgggggtggcgggggagtggggagagatagcactggggggagtggggagggatagcattaggagatatacctaatgtaaatggcaagttaatgggtgcagcacgccaacatggcacatgtatacgtatgtaacaaacctgcactttgtgcacatgtaccctagaacttaaagtataataaaaaaaatcaactacttcataaatctccaaggtaataaaactgtaacctttaaacactaaataaataaaaataaaaactgaaaaaaaaaaaagaatgagtcagggaggagtccttcctcctcaatcatttggaatagtttctgtagaaatggtatcagctttattttgtatatctgatagaattcagctgtgaatctgtgtggtcctggcctttttctggttggtaagctatttattactgattcaattttggagcttgttattggtctgttcagggattcaatctcattctggctcagtcttgagagagtatatgtgtccaggaatttattcgtttattctatattttttggttcgtgtgcatagaagtgttcatagtagtctatgagtgttttttgtatttctgtggggtcagtagtactatctcctttgtcatttctaattgtttttatttggatagtctctcttttcttctttagtagtctagctagaattctattttattagtttttcaaaaaaagaccccacaactcctgaattcattaattctttgaattttatgtctcaatcttcttcatttcagctctttttgattatcgtttgtcttctgctaacatggggttggtttgttcttggttctctagttcttttagttgtaatattaggctgttaaattaagatctttctaactttttcatgtgggcatttagtgctataaatttccctgttaacactgccttagctgtttcccagagattctggtatgttgtatctttgttcacattagtttcaaagaatttcttgatttctgccttaatttcactatttacctaaaagccatttaggagtacattattcaatttccatgtcattgtattgctttgagtgaatttcttagtcttaatttgtaatttgattgtgctgtggtccaagagattgtttttcatgatttcagttcttttgcatttgctgaggagtgtcttactttcaattatgtggttgattttagaatatgtgccatgtggcagtgagaagaatatatattctattacttttgggtggagagttctgcaggtgtctatcaggtccttttgattcagtgctaacatttggtattaaatatctttgtaaatgttctgccttgatgatctgtctaatacatttggtggtatgaagtctgtcactattattgtgtgggaatctatgtctctttgaatgtctctaataagttgctttatgaatctgggtgctcctgtgttgggtgcatatatatttagaatagttaggtcttcttgttgaattgaaccctttactattatgtaatgcctttctctttttgatacttgttgctttaaagtctgttttgtgaagttagggttgcaacaaatgctttttgttttccacttgcttggtagatttttcctatccctttattttccacctattggtgtcatgcaagtgagatgggtctcttgaaaacagcatgctaatgggtcttggtttttcatgcagcttgccactctgtgccttttaattggggcatttagcccattttcattcaaggttagtagtaatatgtgtgcatttaatcctgtcatcatgttagctggttattatgcagattttttctgtgtggctgctttataatatcactggtctgtgtacttatgtgtgttttttagtggctggtaatggtctttcctttccatatttagtgcttccctcaggatctcttgtaaggcatacatattggtaacaaattccctcagcatttgcttgtctgaaaaagatcttctttctctgaagcaacactttcatttgtaagcatcacttaatatgttaaattcttttaaaactattttggatcaaaacccaaattacaaatagttacaaattttacttcatccatgtatggagaagaatggaaaaatatccatagtgaggtaaagctagtacctactaggtaacaatct
